United States Patent 9,487,797 (GENOMIC PLANT SEQUENCES AND USES THEREOF) - sequence listing, part 37

SEQ ID NO: 61958 - DNA, 33762 bp, Oryza sativa
agatgcatgccatcaaaactagcagtggtagtagtctagcagagatcagatcaccatttgtttggtatttttcctctgaccaattcgggatgactgacctcaagccagagtgttccatggagctaacagcctctggtcagttaattactattatgcacaattacacatgggtgcacccccatggtcgcgtttaagttacttcacgttggagaaaactgatttggcctagaaccttacgccattggtgtgaaattgcaccatggtgcatgtctgatgaatctgtttaaatccattgaaatacattgaaagaattctatcagaaaccccgctacaaaaataggaaataatgtcctaaagatgggctttcagggaaaagcttgcaaagagtttagtgtaactttttttgtataaaagaaagtatttttggctaagaaggcgaagagcatctctgtcatcatcggcgacaacccaacatctcacactagcttcactttggaccatgttctaacacaaacttgcttttatggaacgaacaaattagagaggtaaagggaaaagaaactctctagcaatcagaccaacattatggataaggcttttcactgagtaggatccgtgctagcatcatcaatttggaatcaaaataatctaccaatccagacacatttgaaagctgcatgattacccaacttcacgcagtaatgatgatttctccgcagcatctgtgccacgagtgaagagtgacaagcttaaaggctcaatataaacctctgaagttgcatgatcaagttacaacttagctggcccggttgaccccatcgattttgctacatgtataaaggttaagaaaaaaaattatttcgacacacaattgcaaaatcccatgaagtatgattaattttgggtatgtttaaagcacccttggagagatatgaaccgtccatttaatttaatataacacaccacaattagttctagtacatctgataaaatggtaggtttggaaaaaaaataaaatgcatggtaaataagtaatttattccatctgtagagtaaatcgactgaattttagctaactacatgtgtgtttcttcgtccgtaatgcacgcttgttccctaatgccatgcatatatctttcctgatttgttggcttattatttgtttttaatttgaggaacgcatataacaagtagccatgaaactactccgcttctttcttcctctttccttcttcgatccgatcgaacatgatttatataagttaatttacagtctaattaaatcaattggtgatcctcagataacatggttgcatgcaaaattcagtttccacatgcattattaaggatgtttacggaagctggcattatttagcatcacaatattgagagagagataccggcaacctcaccggcggcgctcatcgaccgagtcgcaagtctacgacggatggacaagataaccttcgcgggattggatttagaaaagtaatttcaacatacccctattactactattttaacaaaatatccaaaataaccctataaatcaacgggacatgttaattccactgccttactaacactaagtaatttattattattgtcaaagtactgtaaaagcaccctaattattaatgatatatgtactgttgcagtaatttgggaacaggccggggaaaaacggagagtgtcaggtaccgtaaaatctcgattgttggtatcctcttaaactgcacgtaggggcggagctacagactacagtgacaggggtgcacaggaacccggtcgaaaaatcaattacctgtagttatctcatgttcaccacttgacaccccctcagagctcctgcgtgtacccccaaccatcaggccgagcagcaagccaaagagaagcttgcattcttgtagctaattaagtattctcgtggctgcatcatactcctatatgctctcagctctgttatatcacaggacacaggtctacaaattggccatgcatggagtgtagccgtcaatttcatccagcatttcttaacctctctttttgcatttacaatcactatcaaacaaatggaatatccttacccaccacactaccaaaggtctcatcagccattgattgtagtaagcatagtcaggcatgttgcatcccttataattttctcacgatcattctgatttattgcaagcaaattaagttaacaactttgcatgttaattagggtctcaatgggatgatattggttgctcttatcaaaattgagggttacttttcaattaagcattttagatgataaattaattggaggaaagcttgggtttagttgaggcccttaacgcttgagatgcaatgtcaagtaagttgcttgactttgcaagaatcaaactatggtatagcatacaggacaatttcatagcttttaaaatatgatgtatttacattaggaaattctgtagtttatgtagtataatataataaagcattatttttctgtttctttaagccaatgggttggactaagtacttatccaattctgggaaccttctttgcttttgattttattctcaacatgttcgttgcactatactaatcgatgttttcattgtgttctccattttggtaagcactttttgtcactgcatttttctttctgcacagactctttctcacattgaatttgctgatgctaaaatgtaatggatatactactatttactacaacactgctagaagaaaacatataccactaaactatatgaagctatggtgtactccctccgtcccaaaaaaaaaaaagacaaaccctgggttttcatatccaatttgaccgtccatcttatttgaaaaaattatgaaaaaaattaaaaagataagttacgcataaagtattaatcatgttttatctagggatggcaatgggttgggtcgggcacgggtagagcaaaaccatgcccgacccgatgcccaacattgcccgccgaaaccctacccattagagttagcgggcaaaactccatgcccgtactcatgcccggcgggcgcgggtatgtctggcgggtacccaatggatctcacatgaataataacttaaaagatatgtaatttaaccaagaaaaataaaatcaataatttaccaaattattggttatcaacgataatttgaattacatcacaacttagtatcagttagcatcacgaatgaaccaagagaaatggtataagaattaaaaaatgagtcaaaattagataatacatatgtatcgggtcgggcatggattacccacgggtaaaaaataaaacccgcctattacccataatatcttcgggtctcgggcgggagtgtccatgggtaaaaagtcacacccacacccgtacccatcgggtcgggtatccacggatacccggagggtatccacggatacccggacccatgggtaaaattgccatccctagttttatcatctaacaacaatgaaaatactaattataaaagaatttcatataagacggacagtcaaacattggacacggaaatctagggtttggcttttttttgggacggagggagtgtagtactaccttcgtcccaaaataagtgcagccataggtatccgtgtccaacgtttgaccgtccgtcttatttgaaaaatttataaaaaaaaattaaaaaaatagtcacacataaagcactattcatcttttacatttaataacaataaaaatattaataataaaaagttttcaaataagaaaaatgtcaaaagttggacataaacaatgtaaaattacacttattttgggatggagaaagtacggatgcacccctctatgttgctctagctcttttttttaagtggaaatgaatttaactttgaaagccggtatttgaaaaaaaacactcaaaatagaactggggaaacaaacatgcaacacgctcctaacgatgcttgtttctacaacgacaaattcaggttactagtagaatatttgccaattggaaaatatcatcccaattggtcgtacgtatcctacctaccacgcaggaggcaccgtggcaccgaacagaaaagtgacgctgctgctcacttgcttgcaccggtcgagcacaaagtttctccatttttgtaagactcgcaccaaagtttctcaaaagctataacgtgcaagggaacacgacgtcacaccgcaccaaagcaacgctacgccgccggtggcgacaaagccaccgagtccgagaccaagaccgacgtgacatatcccaacgtcgccttgatgatctccccgttctttccgcggtcaagtcggaaaagagtcgcgaattacgcagagggatcttgaccgcgatcggccatgtgtagatcgatccgacacaacacaaggtcgaaaggtttcgtgagaaaaggttgccgggaatcaaccggaggagcgatcggtttttggacgtttggtccttgcaatgccggtggtcagaggttaccaagctccagtcaacacacatgacgcagggcatctcgcgagcgcacgaaagcgaagggagaatttagaatttaggacgggctcgtgggatggggaaactggcatcgtactacagtttttgaggcagggtgatcagatttgctggcttttggtctctctctctctctctcccgatacggtgacatgttttgctatatagcctataggtatattttattctaacttttttgtatttgtaccgttgctaacattagggtgaaaatttttagcgtgtcacattggatatacggatgcacatttaaaatattaaatatatactaataacaaaataaattacagattccgcctgtaaactatgagacgaatttattaagcctaattaatttatcattagcaaatatttactgtagcaccacattgtcagaccatggagcaattaagctcacaatttacacgcaatctgtgtaattagtttttttcctatattcaatgtgacagggtaaaaacttttgccagaggatctaaacaggctcgaagttgaattgaagttgtcctacaattggaattagtatgtaaaaacaacacaattaattactaacagattaaaacaaatagatgcctttggatcgaaggttttttgaattgcagaaaacaggtattgagtactataggaaattttaccgttcatccctttggaacaaaggtattgagccccccatttttttttaatttcctttgcttatacccaaggctcttatataagctatagtgtcaaatgacgataacttcacagctcattagtaagattccatgacttgacgactttaattacccgttgcaaacttgcttatgttgttccttcaaaatacgtgcttagggcatggccaacggtggcagcctacgttacctacatatgggatacggatacacgatacggtgatacgggatatgatatttttcggaaaataaagatacggggatacgtttgtatatatataataaaaatacagaaaattataaattgaattggggaaactatagtattagtgtagccgattggtgattacaatgtagcaatcatctctaattcccttttgtagctaattcacgttgattaagcccaaactaccagcttccaataattcaaacaaaaaaaatcaacacatacacgtttataactaaaagactaaataactgatgaatctgcaggaacattagcagccgaactaccgctggattgctagatgtgctagggactgaacttccagttccaaaacccattgcatcttttaaaacaaaacatagttattgttgtgcccagaaaataaggacattgcagtcttgcggattcattcaagaaaaaagctgaagagcgttgtaaatctgaaaggctaaaagatgggatttatcttttattacctcgtatggggaacaagaaaagaagagctcggttgtgatggagcgctttgctcagcatcagaggcgttgtgttggtggcagcggccctaacccctggcagggcatgacggcggtcggcggagatgctgcctgcgtctggcagcagcggccctaccagtacggggaggttctacaagctgaccccgaggaactggaagttgggggtgactatttccctgttggggccggaacacccgggcctgcgggggtgggttggatttttggacccatgggtgagcctccaaaacaaaccgaactatccccactccactccaaaccctacactccccgcacgcgcctgtgcgcggtgcaccgccgcgcactgccgccgccgccgccacaaccgcgcgccgtcaccgccgcgtgccgtcactgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctggggggactgttcttggaagtggttcttgggagcatcctggtatggtaccttggctatttttgtgctttttctttgtttcaatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaaagatgttggagatttgaacaaattggaattacacaaattgattgctagcaatgttctattattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagttccatataactactaatctgttgatttaggtggctgtctttcactgtagtattaagtagctaactattttatgtgttgacatgacatgaggcctgtctttcttgttcaaagatgtgatttgatattcattatgttattagtggagtttcaaaaggtgaaaaaaaagtgcacaagaatatttatgcacggttctttgaaaagaaacatgtccagcccccaaatgctagatgcatgattacggtgtataacaggttgctgttgggtatgcttatcatttcactagtttttagcacaagtagtaaatgtaaatattaattctgcacaagtagcaaatgtagatattaattttctattcttgtcaaacataggtttattaaacatgtctatgcaaaattctgaaagttcatctgccaatagttctagtcatgagctgccttcacaaacacgtaagagagcaaaagtgtgggaacattttgagcaggagcttgtcatgatagatggtcttccaaaagcacaatgcaaatattgtggcttaatgttgtcagcgactagaaaatcaggaactagccatctcataaaccatatttgcgaatcttgtccactagttgatggtgaagttagaaataggtttatatcaacagttaggaaacaacccgtggaaaattttatgtttgatcctaaaaagactgaagagttgatgataaaatatttcatccatgctgagataccattccataaaattgaggatccctacttggatgattggatggcatccatgcagccaacttttaaacttgtgggtcgtcaatcaatccgcgacaagatttacaactattacaataggctgaaacaagaattgcatgctgaattagagaatcttgattcgcgtgtatgcctaacatcggacatgtggacctcaaatcaaaacctaggatacatggttgtcacagcccactatgttgatgctgaattcaaaatgaaaaagaaaattataagtttgaagcctgtgaagtatccacacactagctttgcaattgaagaagccatgatgaggtgtttgactgagtggggcttgagtagcaaactgttcaccttaactttagacaatgctagtaacaacaccgctgcttgtcaagaattagtgaaaactctcaaggatgagttggttttggaaggcaaacattttcatgtgaggtgttgtgcacacatcctcaatttgttggttcaagatgggatgagggtgattcgtgcagcaatagataagatctgtgagatcctaaagtacattgagcattcaccctcacgcattcaagcgtttaattcaattgcttctagtaaaagtcttcctccaaaatctggtttcactcttgatgtaccaacccgttggaactcgaccttcaagatgattagagaaatattgccttacaaggctatcctcaatagctatgcctctgaaaattgtgaacttctaccaactaatgaagaatggttgcatgctgaatcaatttgtgaatttcttaaggcttttgaagaggctactagaggtgtatcagctcataggacaccaactgcacacacattcttgccccatgttctttgtatccgtcatgctttgagtgatcctgattggcaaaccagcgatcttttaaaacgattggctgctcctatgcacaccaagtttgcaaaatattgggatgaaaaattggcaaacaacttcaatttggcacttgtcattaccactgtgttagatccaagaaggaaaagagactatttggatttcttttatgagaaggtgtctccccatggttctaatgttgaaagtaaagtggactctattatagaggagatgaaatcatactttcatgtatatgaaggaattgcaagaagaaggggtgtatcctacatgtcacagtctagtgagagagttagtgttgtaggctcacctgttttgggaaaaagaaagctagagcatgaattcaccctcttcaagtcaaaccgaaaggttgcacatactcagaagtcagagattgatacatatttagaagaagtatgtgaggatgatagtgaggattttgatgttttggcatggtggaagaaaaattccaaaaagtttcctgtgttggcaattatggctcgagactttcttgcaattccacttagcaccgtgccctcagagtccgctttcagcagtggaggaaggattcttggagacacaagaagctcattgacaccagagatgctcgaggcacttgtttgtgcaaaagattggctacatagagccaaaaaacaaggggattaaaggtataatatctcacgccttgtatttcgtctcagactttgtggtctgtgccatacaaatagtaattgtagatgtgttttcattttatattgtttgattagtcacaaaatctagattaatttgtctgagtgcccaccagtattactaatatttgtgccaaattttctttgatctaggttcgtactgagtactgaccatatgatgttttgtgaagaaggtttggtatgatggctgttttttttttacaatggtggggtccctgtgctcagtaacttaatgttgttttttgttcatcagttggtgaaatgttaggcggaatttgtaacaccttgcaatgccttttatatctattagttgtatccttacttgtatatattcttatttgagcagctagagcatgttcaggagatagatgagagcattgtgtatgtgaaggataagcaaggaaggtggcctctctcttctcccagaggggcaaaaaaggccccaaccttgttttcttcctctctttttttttccatttcttgaaagtccttgtggttgtatatagtagtatagatatttagttgaatagtggggatggatggattcattcttcattcttactagtgtgtccactaactcatgctagtcatatcttatagaaataataatattcaacttgtaatcattcaatgttatttctgaaatataaatttctgatggcttctttctcttccagattatctacaactgcatatggatcaaggcatagatgatgttttggtagtttttgttgaagatataaaccttattatggcccttattattgctgtagtagtgagcaattgacttaattgtaattatatgacatcattagtcttctggtattcatttcagtgctggatcagctaacaaacaatgcgatgcgtatcattctgagtatttttttttgtttcattttcttgtttttgcccaattttcagtgtttcagcaagcaatgatgttcttttaatatatctgttttgaattaattgtctgcacgtgtgtctacactgctgctctctatactgtagctgagatccatggctaaagaagtaacgaggcctcctggctccaagctctctgtagtgtagctgggatccatggattgaatccattccagtgaagtgggctgaacccattttagtgtaatggtttggggtgggttggactgaaatctgatgcggggtgggttggtttggattttggaggagaggaaatggggtgggttggtttggcatgccattccatgaggaggtgggctggggtggattcaaattggatctcaacccactggcaggcttaggtgagtggtggtgaggccccacaaaatttcgggtgtggggacagggatggaaagctcagggcctgtttggtatagctccaactcctaaatttagctccaggagttgggtctggagtggagttgtagaactgcctaaacccagcttcacaactctagttcattttgtgagagagctccacccaactccactcctaattttggtggagctaaaactgtttggctgagctccagctccagtaggggtggagctggagctggagctgtgccaaacatgccctcaattgaagcagtaggtggaatcatatataaagtaaaccaaaccctaagtcctttcttctactctttcacaaccacaagcccctaagaaatcaatcctatccttatttgtcacataggaaaaaaaggttgctgggagctaggacgccaacatctgcttctctgcctcggctcatctccactagctggcgccccacaccatgccaccctcccaccttcctcatcactgcgtcacctcgaagtcacccgcctcatcccttcatcaccagcacaagccgcctcactagtcgtcgctcgttgccacatcacctcgacgccacgccattggctcgtcgccacccagcagccactgcctcaactctggtggtgctggccggccaccgctaccttgacgctcgcatcctacttgtctcgacgtcacgctatcaacccaccaccatcccgcgtgtcttgctcctctcgccatcagagggagactagttccatgcaagatagcagggccctagaggtgtcgccgccacgggctgattttcacccactcagtcatccggggccgggggttggtcaacccgaagggaaaagtgagcagggatgttcttatcctccccactaaacgatggagctaggtaggaggggggttcctttagcatgtatgcacccctcaatctaaattcagacacttatatcagtctaaatttaatcaaaagtatattaaaacaagcgagtgatatcactctccattttgttctaactccaattgccacccctaatcgggagacacaccgtggctggtggcgtgccaccgtagagtacagtgcgtgccgcatccaaatccggactggcgcattacccaaccatggaatgcagcggtggtcgcgtccccaagcagaggagaccgcgtccccgaacccaaccaccgctgcgacccaaacaaaaggctgcagggcccaacccctagctacggctcagagatgcctggccccagccctactccctcgccccagcacatgtgttgacgcccaggctcaggctcagcacacacccaaatacccaatggccatggatagattcatcatccaaacatagataatgagagtgcttagctgttgcaagtggcagacagggaggggctagtcaatggcgactgctttgctttgcacccagcggaaaagcagtttttcactagtgcagcggatggcagctccctactagtactcggctgggtgggagggacccaaaagctgcaagatctgggaggcgttttagggtggctgtcgaccttgtagctaagctagcttgctgtccggttaattgattgatctaccagctaggtcgtgtggatgttgtagtggagctgtactccagttgtgtttgtctttgtccctcatgaaccagcgccaattggacgacctgcacttggttgatacgagtacaatagtaatgataacaacaatatgattaacctgaaaaacaatccaggatttgcctgtctataactaaggatttgtcaatcatcgccttcaggctgcaggaagaatccaactgattaataagtgattttatattctacttacgtggattgctgacatgacatgtatcccagccgtctatacatccaggtctaagcagaacaaacacttcgtcaaaggagagttattcgactccgtacagcaatttggtcctgtacggttgccgtacacgtccgtttggacctgccacgacaaaccccgaaacgaactgtacagaccacaactttcaagcggttgagaaataacgcgaccaagcaaggaacgggaaaaaccccaaacggcaagacagtgtcatggcagaataaaggtggaatgaaattgaacgacgatgcgacaccattcacagtttcacagccaattgggataagtatctaattgtgcaatatgtaatggatcaacaatgctactaaagtttgactggatggcattttttataaatcaagccatgtgaacctaccaacttggcagtgtggatcaataacttatttgcaaggaaatgaaggaatgatgaagctgaatgttgaaggaagacctaacatgtggcaaaaacaagcagatgttgatggggggaaagaaagaactatagctgcactgcacaacatcatgatcatcaacgaaaaaaggaatttagcacacacatgaagcaaccccaagagatttacatatactcctccctaatctatctgatgtaacttaacatgctattatttgtttgtccacatcacataacagcaccaagcatgaaagaacttcatcactattacacgacaaagcttgaaaactctcaactcactcgttagctaactaggcataccagaggttgtgttcggctggaatcaaaagccaactccggtggcattgaggggcctatgccggtccttccagaagcaggcatcgggcgccagccgtgccgaggatcgcatcggctcggatttgcagcgcttcagaacaaacggtgcatatgttgcagcgccagtaaccagtggcagctctatcttgaacttctgctccgcagcttctttgagtggtgatttctgcacaaccggaggtggcatagacaccaagtttgctgatgcaggcgctacactctcttctgtgttcttagcatcactggttccttcagcattgtctgtatccttgagctcctccgctggagcggcattgcaaccagccttttgttggcggcggttgcggcggttctggccctggtaagacttccagtggacgaagtccgtgctgcagacccatgtctccttggagacctccatagagagcttaggctcatacatcatcaagaggaggcaatctggcaattcaccacttttctttcttctctgcttctgttcttcgaccacatcttgtgcctcaacacctccgacttctaccttctcacccttctcatcaacttgtgtctcttgtgttgttccttcttcctgtccatccaatgttgcttcttcctttccgtcgtcatgagattcaagagtttcctctgcactgtttggggcagcatgaacagcgcaatctttttccgactctggctcagatgaaattttctggccctttctggatcccatcagcaccttaggctctgcaacaagatgttcctgctcaatagagaagctccatctgcggccatccctgtcgatggagaaactagctctccttgagtccttcaagctcgagaagcttgaccgacgtgcttctgtctcggctgagaagctgtgccgccgcccaaccctgtcactgcccgatgaggccctactactgctacctacccgtctgcggctgctcaaccgtcgcagtttcctgtcctccttcagtgctgtcgatggggagcagcaattgcttgacctcctgcccttcatctcttgctcctctttctcaggtcctggaacagaaacttcttcctgagcttccgccacagtctccaccatctccagcaacggcaattggatatccctccctgtagcttctcctgacaaagctacctccaaaactgagtccttccgaacaattggtgcttcctctggctcaatcttctcttcatcctctctgcagtcaccgtactcgctcgcttcttcaccaagatctccgcattcagaggtctccactgcttccgtctccagtggatctacttgtcctgcttcacaaccatcatgtagggaaccatcacactcacggcatccagcttctttagtggaaaccgctgaatcacgagcttgctctttgcattccttatctgtgtcagcaccatcttcgtcttcctcatcctcttcctcctcttcgtcgtcgtcgttttcgttttcatccttgacattgtcaacctgactgacatttgccgctgcaggggagccccagaagcgagtggctaatgcagccatacgaacagggtccgacctgcagcgcatcagcagcagcgcgtttcgcggcgggatgcagacgctgaccctcccttcctcctccttcccaaccaccaagatctcgtccttcttctccacttccacctccccgactaccaccgtgctctcctcctcctccacgtcccacccttgcatcacgagaccgacctctgaagcctttacatcctcggccggcacgacggctgctcccttgccgatctcatcgtcttcctcctcctggatcgccaagaggcacctggccacggcggctccgcagagccagctcccgctggcaggcgggcgccgacgcttcttgtcggcggcagagagagagccgcgctcgccggcgccggcggcgcgagacggcgagcagagcgaccggccaccgcaggagccgaatgtcttgagcgcctcgcagatgttgactgggatctggtacacccagccctggttcttccccgcaggaccgtcccggtcgtctccggcgcggcggaagctggcctccgcgctaccgccgccgccgacacccccgcgcctggaccgcgagcgcagcgcggcggcggaggcgtgcttgggcttgcgctttcctcccttgacgcggacctggccgatgcaggtgaccttgggcgacgaggctcggctggctcgaacccgccccggccgcggcggccgccggaggaccccgaggggaacatgggggactgcccacctttcaggctcccgctgttgcggaggcgacggctgagggaggggtggagcggcggaaccggcgcgctgtcggcgccagcaacggcaccggctccgccgccggtgcggccggggctgagaagcttggaggagctggaagggcgcagggtggcgggcgcgccagaggatgcggaggcggtggaggggcgggaggtgaagcagatgaagagctcagtgccaccgccgccgccgccgccgccccggtccgagtgcttcttgcggcgcatgagggggggaggggatgtgaggcgtgtgacctcgctgtttttttctcctctctgtatttatgagaggagtgaggcgttgctgctgtggctggctgcgctagcgtgttagatgcggtggaggggaataaattagggtttgttggtggtggcgctggcagcggagagttggagaccggagaggagaggcgaggtgtgcgctgtgcgggaggaggagaggggaggtggtggaagatacagataatggtggtggtctcgggtgggtctgggtctggatggccatgggactgtgggaggcaggagcagcgcccgcgccacgctgggtttgtcctcctccggcttggcgatggaaagttaaaaggaaaaataatatatatacctatttttaacctttttaaaattaggcatcgttacattatcaagttttggtaattatagattaaatatgatattgtcaaattctttagacatgaccaatatatcgtaataaactaaacaccgccttaaattttgtcgattttaccaaacaatggtataatttaaaatggcatgaatctgaataggcccaaaatgtttttcccattttgtttcttttttctttttgtttttctttggaggactgatttgcccatagttttcggattgagatcatatacattactaagtcaaaaagaagtggacctatccatgaataattttttttttgcatatgcatcatgtcgcctatccaaaataaaaggttgaaatgtatgaacaaaaagttttcaaaataagttgttatgtatcccgtcgtctattcaagctttacttcactgcctccgctctggagccatcatcgagttatcgaaaatgcttacgatcggacgaccgatccagcgcaaactatcggacacttggacgatggacgcaccgtacaactcttttttcagattatgagccaacatgcatattgtctctttttcaataccaaaacctttctctcacataagatagcacacatactactcttgccctctctcccctacacatgcatgcattttttttaataagctttaaatgtttttttccaataatcatctatcaaatttgtgattcgattacaccattaattcattttaattaaatctgtataataagatatcacatgactatattctgatcgaaatattttatttttatttttttttgcaataaatgttttttaagtttttcacattattttatttatatatttcaataagtattcgattatcctacgcctcggtcgccgagggaggggaaaaatcggtcgctcccccctccccccatgacgcgcgtgcgcacgtgcgccctgggccccacgatgtgtcactgactacctactacgtgtctccaccacatactccgttgcaacaaattacccatatattttggaaactctctattaagggaattcgttttattttttttccaaaaaaaatgtttcacctagtgtactcacaatgtttcactatgtatatatctaatattgcagagaaccgaaatattcttttgcaacaaatcacccacatattttggaaaccctctattaagggaattcgtttcattttttgttccacaaaaaatgtttcacctagtgtactcacaatgtttcactatgtatagatctaatgttgcagtgaactgaaacattctttcgctatttgctgaaacattgttttcatgtaaggtgaaagaacgtccgatttaaacgattgaaacattttcgatctacttagtgaaacaatctcgatatacttagtggaacattgtgcaacatttcaaaagaaaatcaataataagcttaaaaaaattcgttggaatatatccacgtgtggtcttgttttaaagatttaattgcgataaatatagtgatataatcggatcatgcatcggataaatattttaggataaaaaatagtttagagttagtagattttcatactgcatgagggaagagagagcaactgtgatagtgtgtatgcatgactgcatgctgcagagagagcagagacctataactagagacagctagaaagcgcatttgcatgcggcatagaccatagagacagaaagactagtgcatgggcgtccgatttttcgctattcctcggacgtccgacgcgtagttatctcctcgagttatgacatcatattttgagttttgtagcatatatccataattatcatcttccccgacgtgacgttgatttcaaacctacctgacggccattgctattataccaagctgcagtcaggggatttggaacatgaaaaacatatcgcgtgatcgattgccccaggcgatcagtttccctccccccacgcagtttcccttgttagcaccgctttactttcctattttagtaagtttatacatctaaaatttgtgcacctaaagtttatacgtctgaagtttatatacctaaagtttatagatccaaagtttataagtcaaaagtttacatacccaattcaaatttgaatttgaattcaaatattttttatatatagtatttctatgcataaagtttatatgtactaagtttacggtataaagtctatacttatctatacataagtatagagtctatgaacataaataagagtattaaaaaaatttttctaacttatgttttcttattttttaaaaaatttatggtgtagtaggaagagaagaagagagggggaaggggagaggatgcgggctttcccgatcgcgcgccctcggcgcggcgcgggcgatcgatcgcgcattaggaagaccggaacaataatattttctcttctcgcatctcttcgatttgttctatatctttggaatgtaataatagcgtttgcaacatagattaaaacaaaaatagtctgcaaaatgtctaaaaatagttacgctaaatgagattatcttaatccatccaaaaaccaaattgaaccctcactattttgcttcaaaacctgatttgaccaaaacccaaccattcgccaacccaaaacccaaccgtctccctctgctcatcatactatgccgctaatccacaccataggtccacgttttctttttttttttttagtatttgttgcaatctgactagccactagcccactatacatcttcaaccagcgacaaacattattgagttcttctacatcatgttgctgacaaaagatccacgctcccatccgccctaacaccttgaaaatttcgattctaaaatatgaaagcgaaaatttgaaataattaaaaactttttccaaaatttcgtcatgctaatatttattaaatttcctttttcttttcctggttgtgccggtgcaaaaaaaaataataaataattccaaaggataatttaaaaaggaataaaattcaaacacattaaaataaccatgagtataaattaacatagattaagaaaatactttgcaataaaatcaaacaataactagttactaaaaccttcttttaactaaatcttttaagaaataagcttttcagcaaaagtataatttcgatccttcattggactggcctagcccaacaagacccaaaccctaatccttttaaactctataagtttaaattagttcccttaacttgttcctttttcctttcaaaaaagtacaccgaaggtcccttaacttgtcattgagctacaaaattgtcccccagtcgtaaaactagattatttgacatccctaacgtacaaaaccattcactttaagttcttcggtggttttaacaccgatttcgtccgacttggcggctgagtcagcataggacccacgtgggccccacatgtcaggatgccacgtcaacaccctttctcttccccctcctctcccttcctcctcctcctcctcctcctctctctctctctctctcacttttctcctctctaggcaagcaggccggtaggtggggaagaggtcgccgggacaagccaggagaggaggaggtggcgggcgatgaggcgatgatggcggtggctgcgacgcgggaggggaggctgccgtgccgaggtcagagtgtccctttctcctctctttctctctctctctctcactcttctcgtttggacagggcagctgacgggtggggaagaggctgattgtcagcgatgcaagataggaggtttggcggccgacgacgtgggggaggcggcagcagcgaggtgggagaaggggagggcgtcggtggcaagagcactggcggggagagtgaggacaatggggatgcaccgctgccatcgtccatgggcgcggatccccttgtgtatgccatcgaggtaggctactgccgctgccaccataggctagttggcgaggaggaggatgggaggggtcctcaggcaatcgtgtggctggccgccgtcggccaccatgctcctctccccaccttccaccaccgcactcaccggtgcaggcgctggctccagatccacgagctccctgtgggacgaagatggtgatgatgtgctcccaccgttctctttgctgtcccccgtgctcccgccgccgtcgctttcccctcctcccacgttgccggccgctggacctctttcccacctgccggctgacttgcccagagaggagaagagagagagagagagggagagagagagagagaaagagagagagagagagaggaggaggaggaggaggaggaagggagaggaggggaagagaaagagtgctaacgtggtatccttgcatgtggggcccacgtgggtcccacactgactcagccaccatgttggagaaaaccagggtgaaaatgtcacaccctgaagttctttccccaagcctaaattgaatttataaatcaccttgagaaaataccggagtcaaagcaagagaaaccctaatatattaatgctaataataatcggaattggcatgtgggatttttcttgagttctacatgtcgaaatatgctaacaagatttttattggaattttcagagctctagaaataattttaaccaattaaaaaggagcacaagcattatttaattccctggaaattcttttcctcctttttctctttttttcttttttcctctttttcttttcggaatgggccgccggcccattctctcctctctctccttcccgctgggccgaccgaaggccgaggcccagctgagccggccacccgagccctcctctctcccggggtcgccgacaggtggggcccacctgtcgggtcctcccccaacctccagccgccgccaccgcgccctgcaaccgccgccgcgtccatgctcccgcctcctccgggccacgtcagccacgcccgcgcatgctcccgcgtctcccgcacccactctccctctctcccgcccgcgcccgcgctcgagacagtcaggattcgattttcgaaacccgcctctctctcctctcccacttcccccacgtcggctggcgattcccgcctctcccggccacgtccgagctccctctcccctatttaagcatccccactctcccctctttctttttccccatttcgccaagctctcccgtgccctctaacgccctagtgccgtcgccctcctctccgccgccgccgccgccgccgctccggtcgccgctagccgccgtgccaagccacgccgttgacgccgtcgcgttcgccgtcgtgcgggccatctcgtccacccctcctccgttggaatccgccgccggaacccactccgcatcgtgcgtcggtgagcatcgccatggccgccgccttcggccagcgtcctcgccctctcccttttgcctctctccctctgttccctaggtggttccggacctcgtcccgccgtcgccatcgccctccgtcgctcaccgtcgtcgatcgtcgtcggtgaggcccctcctccccttctccctctctcccgcgccgcttagccgccgcgccgccgcctagccgcttagccgccgctatcgccgcccgcatcgccgcgacgccgtcgctctctgccgccggccggttgccgccggtcgccgcctcgcgtcgccactgcacgcgcgccgcgccgctgcgtgccatggccgccgggccggcttgagccgtgcccgcgcgcgccggccgcgagccgcatccgccgtccaatctaccggatggtagatcgaggccgtttgttcggccgcccatgtggctgccgcgtggccgccgcgtcggcgccacatcagcgccacgtggtgcgccgttcccattcccggtccgtggacccagtccactgcggaccgccacccgtgtcactgccatgtggggcccgcatgtcggcgccgcccatctctctccccgggatatatttattgcgcaataattcaattaaggatttttctgtttatagtaaaaacacagtgaatattctaaaattcatatttaattcatccgagctccgtttgagcccattcaagtatcagtaaatcaagaagtagaatccattaaaaatggttctgttctctgttttagtagtcttatagcctgtttgtattgtttgctttgtatgtcgcttagattccggctctcccgacgctccggtgtactttgagatagtcgccgaggttcctccagcagcagagcaaggcaagtcatgcttgtcacttgaacatgttgatcctatattgcaaacggtctattgttttccttcaaatactgcattgttttgcaataatactatgggatgtttacctactgttacagccatgctatttttggtaccttgctgctatttttggtaccttgctcctttgatagcttgggttataaacatgactagagattggattagggattgcttagccatgcttagttcaactagcacataatggggaaaatcatattaatgtatagactgtaggctctaatgttaatgttggattagtgccaccgcttcggtgttggttaattaaaataaatcacatggtgggctgtgggtgcatggttttgttggtcgcgcccatggcgtataaggaccggttcgcgggatgccctggaagaacttatcgtacttaccacaagccagcgtgggcaacggctgggcttgtagtgtagctttcctctagttaacgcatctaggcaagggtgggcgtgatggagcggggcgggccctgcgacggcctctgtcgcttctggattcacctaggcacgagaggggactgcccgttgcccgctggggacgggggtgaaacctgaggtgtggtgtgcttggctagagggggttatgcgaagggtcctgtcatggcctctttccggtatgtcgtggtggcatgtcggtgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtagtctgatggaaccgattagttcaggtggttggttgggcctgttgcaacgtggtgtagtgttgaacagtggatggttaatattgattaattattacaattattttaccgctttcaactactctttataaatgctcgtgttatgcaaaagcacctctcttgctatcctttggtaatatcctgcatcatacccccgttccggtatgacttgctgagtacagtgggtagtactcagtcttgctctattttccccaacccaagagttggagtatgcgttagatggtggtttctccgaggagtaggcttcgtccgtgccgtcgaggatgcctgtggagtggtgttcccgctgccgttcaagtcaaggcttagctccagttatcttttgtttttccgctgcatttatgtaagacttttataatgtttgtaagacgtggatctgtatgtcaactttgtcgtttgtgtaccccggccggtcctggacggggattttaatgcacattctgcttggaattctattcgggaatttcttggcgtgacagaaaaccactaaaggacctaaagtgaacggttctaaaagtagtgggatgtcatatatatatggtttttgattaggggacgattttgtaactcgatgacaagttgagcgaacttcggtgtactttttcctagccctgtcccaattattttctccttccgacctagcccactgctcaccagccgaaccctcctgcagccctagccagcttgctcaatgggtcgggcaaactgagccgagccgttggcctcggcttgttccccttcaccttgatggcgacctgccgccgcccaatccaccagagtccaggctggcctgtccgccaacaagctcatcgacagaatccattgtacctgccgctcctcgccacaattagaaatcgcagcgcattaaaaaccggcacctttgaggctacataggtatccattcatcaaaatggcatcccacgagtgtgcgctctggcgggaaaaaacactataggtgttctttctagtattttcggcatctatagtgccatctttttttatgttatgttgtagtgacagctacatgaatgtattttgtcctttcttggcctatttggtctatgtggacagtgattgggccagtacgcctatcaaaacctacttttgctttctccctacgctctagccacccctaaaggcttataatcttaccgtgccatgactctttcacagtttcactgtcctgtaaccttcgacagccctttgtcatcttgcacacttcaccatagcccacaggcatggctttgcatactcccgccactcttcgctagtgctcaattgcttctactattatggccaaggccttgtgaccttcgtgttagagtatatggataagatcgtattgtatccggtttgttatggtaggataggattagtttccatctctatctctttgagtttacttaagatacaatccatgtactcctatatatatcggcccctgaggctcgatacaatgtgcgatctgaggacgtggtcaacctccataaaatccacgtcctgccgtcgccaacctcgtccacgtcggccatcccccgtcggttccccgtagcctgcctccgtgccatgcacctcgccgtcgttgcccgagatcaccgcacaggaccacgacgtggtcaacctccataaaatccacgtcctgccgtcgccaacctcgtccacgtcggccatcccccgtcggttccccacagcctgcctccgtgccatgcacctcgccgtcgctgcccgagatccccgcacaggaccacctccacccgctgtcggcgccatctccatcaagttccaccgtcgtcgccatggtcgttgcggcatcgtcggcgcggcacagggtacggggggacccatccctgccggctcctcctccgcggcggccgccgccgcctagggagctcgtggccgccgccgccacctacgcccgcaggccaccggttcaccatcgacaccccttccgttgacgccccctcacgggatctggaggtcgtcgtcgttgcaattgatgctatctggccaagcaatggcctcgccatcgtcacctctccgcccgaggaccgccatcctctgcatcccaggtcgtctccgcccattcctcgtcgtcctcctccggccaccgacactaccatctcctcctcggactactcctgacgtgagctcgcatcagcctcgaccatccactggttgtcgccgctgtggtgggccacctcccggcgtcccctgttagccaacacacctggagtccctgcgctgtcaccggactgtgaggtcctctcctccatcgacctagagaccggcctgccgaactcctctctctctctgtttctctcgttgagagcagggaaaggtggggatgaggttgtttgactaaaggtctatggacttggtgtatggaccatcgaggtggaccagctgcacaggtgctgctagcctgctaccgtggactactgctgctgctgtaccttttctttttctcccgatcagagatcgggtttgtgttgcctaccgcctcatcaacatctacgtgactccgacatcggcatttactttgtcgtcctaccccacgcatcatcggcttgaggacccgttcaagcgctcggctacgacgataccttgccgccgatcatctttgactacgcgtctgcgctatcaaacttcgggttgccggcttgccgctgcgtcaccccctcgggccacagtgtcgccgcgcctggtccacctccactagttgttggaatgctgagaggcgccctcctcagcgtggcctcaccaccagtggagttctcgccgctgcattgacatcgagccacacctatgtcgccccttcgggtcatagcgttgtcgctcttgtcgtcttcatcgtcgactgcgtatcgacatcctcgttgtctgcactggtcatcttcagccgttgggttcttctttgtctacttcgagaatcactgctgcatctccgggatgccactgttgccattctaggctggtggttcagccgcccctacttcggctaccaacatcgtcgtccaggtcattggtcccactccatcgccttctacttcgtccgtcatgattcattgccagtgtcgctgtatcttcctcgactacacttcgctcttctctggcaactgcgtgttgctccggcaattattcctctacgccgttctcgcgccgcaaccgtcttggaggccttctctactagtcctctccgacattggcgtatgattcatggtggtcccctatctcgcctgtgcggtattggcaacactggtgcgcacgttcgtcccaagttgtcccggggtctggcaaaccctgtgtgatgtctcgtccttcacggttcgattacatcggctcttcagcatcatcatcctcaatgactgccacgatcgtgtcaccttcatcttcttcagcgcgtcctcgctcacgactactctacagcgccccaagcacgccttgccgctcggctacctcgacatcagcttccccacttcggctacattgaccacggctactctacgcacggcttcatcgaccacggctccctcgcatccttcgcttcagctacatcggcaatagaaaaaagggctatccaagtgtccgcattgctcacgcttgggctagggggggaggggttgttagagtacatagataatatcgtattatatccgatttgatatggtaggataggattagtttccatctctatctctctaagtttacttaagatccaattcatgcactcctatatatatcggcccttggggctcaatgcaatgtgtcaatatttgctgcattcctctctccctatactatccaacactgcctccaacatgagatgtttcctatttattttaatttggaaacatttattggatagtatttttctttgtctagattaaatattttcgaagtctatttgtgtgaccgatttctgaggtctattctctctctttcatacaaattttggttcagtccattccctcctaaatgtatctaaagtcgacaaatatatcctgtcatagtgttctttgggttttatatctattttcctttgtactttccatttatttgtttttgtttcattgtatgtatgtttgtgcttcagagcttcaagaagcagattttgttcatggatttgaggaggctagttgggcttacttttatgtagcacatactttttgttcaaattatttcgtacttataaaactagatatccatatgattttagatcacttatttattggttataccctgaatcatggtaaccattggttcatctatcatgatcacgtctgatcaacatgggctaggtgagagtagctcgtcctgttgaatcatatctcatgaacgatgaagtagattctcatgtcaagaagtactagtatatgttaccagcattatatttctgaaaggtttgatcacgatttgcaggagaaacagactgaaacaaatgaacaggaatgggccaagggaattttgtcacgcccagaaattcacgaacgagaatttcaagcagaatgtgtaataaaaacccctgtctaggaccagccagggtacacaattgacaaagttgatacacatatccacgtcttacaaaaatatgaataaatcttacatatgcaatggaatttaaataatcgagctaactagccaattgagctctcaggtaagcgtagcatctcgaaatccacaacatcctcgatgacagcaacatacctacccctccaagtaatcaccatccgtataatactctgcttctgaggattaggggaaataaagcaagactgagtactacctgtttacacccaaatttggcacttagggataaaataggagaaattgccaaagtttggaagtctgccggttttcctctgtggggccggtctgaccgccgtgtgtgggccggtcagaccggctgtatgtggccggtctgaccggcagagtcctagtccaggtctgtttcgccgggtctcgaagtttccttactcgggaaggcatgtttcgggtttcctttggattctatcccgagttggacgtgaagagggcctgtagagggcaagaccaacctctatataagggacatggccggttcaattgtaactaacaaatctacaatcaatcaatcgaatcgtttttcatattgcttttagttttctcttagtttgtccatctttgtcgatttgcgccgtaaatcatccgttgtcgctacgagagtgcgacacctctttgtaggttgtcctgaaaaccttccgttttacccatgagacgggtagttatctagaatcggctccgctagccggtttatttatcaaaaaccatcttggtttagcttttgctagatcgaggtggttggtgactctaggatcatcgcaaggcgttaggtgctgcgatcgtgcttgtcaacttgtcataaaaagttaccaacacgatttttggtgactccactagggaaatctgctcaacgtcatctcaacttcgacttcgccatgacgaagcccccgtcatccaaggcggaggtggaaccgtccaatgtgataccaattacattggaggagctcgatagggaagcgcgcaagtccatggaggagtaccttaaggaggtcacacatgaggcattgatgagggcgtgcactaggactcgtcaaagtgtgatcgtcaagcctggaccgcgcattaagcctaatttcaatgtggtaagttctaaagaggtatcacaatctatctaacaacaaattgcatctacaatagattcatctatagctacattgaatactaagttaaatgcatctattgagaatcatgttgaaggatttttgaggactaaattcagccctctcatggccgattttatgttcaaagataaagcctctaccagtgctagccaagcccctatagatcaaataagtagtaaaaccgatggggcgaagacacaacaaaccggtgaggggtggacggcgcatatagccggtctgatcgggctagatggccggtcagaccgcgacttcgccgccggtcagactggccagatggccggtcagaccgggtattaccccagcggtcagaccggtcctcatattggtctgaccgtgcctctggacgccggtcagaccggcgcaatcatcccaatacagggggtagatccaatgacaaacaatgcgtatttgtatcatcttagaacatttgatccccctgtatctaaaggcactactagttcccaaatccccccccacatgttcccaatgcttacaatgatgtttccagggggtatcctcccgatactaggcaaggccaatataattatattgcgccgcaaccacaacctattaggccaccaaatccaccaccaaaccaacataggcctgataatatggaggaattgattagtgggatcattatggataaattcgggattgaagctaggaatcgtgctaaggtttaccaaaagccgtatcctgaccaccatatcctcgtggttatagagttcccggatttaccaagtttagtggtgaggatagtaggaccacatgggagcatgtaggtcaattcttagtgcaatgtggagaggctagtagttccgatacttttaaattgcgcttgttttctttatctttgtccggtactgcttttacatggtttacttctttaccggcaaattctattcatacttcggctcaattagaacaaagatttcatgattagttctatactggtgaaactgagcttaggttatctgatttaacatcggttaagcaaaagtataatgaatctgtcattgattatgttaagagatttagggatgttagaaactgatgttatagcttgaatataactgatagagatttggctgatcttgcttttaatggtttaattgctcctattaaagaaagattagatggccaacaatttcttgatgttagtcaactcatgcaaaaggctctagctcaggaaagccgggttaaggatagtaaaatatttgttagaccatatgaggagaagcctaatgttaattcaattgattaccctgaggctagtgatagtgatggtgagagtgatcatgatatgtatgttgttgagtgttcatggacaaacaaaaataagccttttgtttgttctaatttaattctgactcctcggaaatatcggcaaagtgaggttaggtgtagttttgatgtggccaaatgtaacaacatttttgactatcttttgcaaggaaaacaaattagattacctaaaggccatgtcataccatctcaagaagaattgaagcgtcgagcttattgtaaatggcatgattctcattctcactctactaatgattgcaatgtgtttcgacgacaggttcaatcggccatagatgaaggacgattgaagtttaccgatggttccaagatgaagcttaatcatgatccttttccggtgaacacaattaattttgatgataagaaggtattgattcggccggctggagcaagccgaatctgctatggggaaaggagtgatcattggagagcctaggccaaagatgatggtgctaaagaatccggaggttggtgtctggaaggagaataggagtgaagcttctagttctaaagttcctaaaaagactaaggtgaccttcgatatgcttttggataaacatgagaagtaaggtggtgagaaggcttgtaataaaggaaaaagaccaagatcatctcctagggaatgatttggtcattcaccaagatggttggaatcatctacatatcatcgtcctcaagacatgtcatggggaccttacccaatgccgccgccgggttatcattatccttactacatgccatggggggcaacactgccaatgttcaatcacatgcctccaatgcaatacagccaaggatggggaggaccaaggaggctagttcatgagcgtttgtcttcaccaaacaatggccagttttatggtaagaaccgggccaatgaagaaaagagggaaggaaagcgcgttaaagtggagactaggacttcggaggtgattaccatcaaagtggggtctcatgatgcgccaataccttctggagatgaagttggagagtcttcaagcaacaaatccgaagccgggaccagctcatcacagtcggccggtctgaccgcagccctacagccggtctgaccgggccatctggccggtctgaccgtcggcctaacatcggtctgaccggtccatctggccggtctgaccgacgacccaatgtcggtttgaccggcgcttctggccggtttgaccaatggtctaagtccggtctgaccgggcttcagcgctggatcgataggagatttgcaaagagttgtgcggggggcttcatcatcttcgagtagactcaacagggggcattatttacctcctagaacagagccgaaacagaggtagattcctaaggatttaacggctactcaaatgaggaggttgcaacatcttcgggcccaagaattaagagaaagagaggtcaaagagcgaagggatagaaggttcaatgagttgcgaccaccgcctacaaagttgtggaggcgtaagtccatagacattgaagaatcggttgttgtagaggagaaggaagaacaatcggttgttaaagatgagtcatctccaaaggaagacatggatatcaacatggtatgtatgttacctatggagttttgcgctatggatgaagccgaagttgctcaattttcactaggtactaaagatgtggtttttgagaagcccgatgagtcaaaccgtcatatgaagcctctatatctcaaaggtcatattgatgggaagccggtctctaggatgctagtggatggaggtgccgccatgaatttgatgccatactcgttgttcgagaagttggggcgtggagatgatgagttgaagaagatcaatatgattctcaatggcttcaatggtgaaccaacggaagcgaagggtatcttttcggtggagcttaccgtgggaaacaaggcgctaccaaccgctttcttcatcgtcgatgtgcaaggtaactacaatgttattttgggtcattgttggatccatgccaattgttgtgtgccttataccttgcatcaatgtttaattcaatgggatggcgatgatgttgaaattgttcaagcggatacatcggctgaagttgcaatggccgatgctacttttgagtggcgtcatgggaatattcaatgcttgtcggggatggatctttctagctatgatttcattagtatctccaatggcaactttgtacctatttctgtaaagccggctagtttagcacggctaggccatataaatttatgtaatgagtaaagaagctaatttagagtggagggtgcaagaatatcgatctacagagaacgatattggtgaagctattgaagattttgatgaagtagagaagcttggtcaagggtttacatcggctgatccgttggaagaggttggcatatgtgatggaactaagccaaggccgacttttgtaaacaaaaatatgagagccgattataaggtgaaaataatcgagctacttaaggagtatgtggattgcttcgcatgggagtatcatgagatgccgggtcttagccgtgagcttgttgagcataggcttccaattaagccgggttttaggccttataaacaaccacctcgtcgtttaactcctttgctatatgaccgagtcaaagaggagattgatcggttattgaaggcggggtttattatgccatgtcgttatgtggagtgggtgtctagtatagtcccggtggagaagaaggggggtgggaagattagagtttgcatagactttagagatttgaataaagctactcccaaagatgaatatcctatgcctatagccaacatgatgatcaatgatgcattaggtcattatttctgatactagaagagccggtgcttgattttaaatctttgtgcgaaattggcaaaattgcagaccaggggcggtctgaccgtgattgcacggccggtctgaccggtgaccaggggcggtccgaccggccacatgccgccggtctgaccggccgtgcacggccggtctgaccggttctggacagagcgctggggggcacgccgcaattgattcaaaggctaaattaattgtaaattcggacatttgtgcccaagaaacagaagaagattggaggattcctttgattagatatttgaaagacactgcacttaaggttgattgaagaattcggcggcaagcgttcaaatatacattgcttgatggagatttatatcactaaaatatagatggagttctattgaagtgtttagatgatgatgaa

SEQ ID NO: 61959 - DNA, 583 bp, Oryza sativa
aattcacacagttgcacccttgaacatcgaacacacagacaaatgcaacaatggaatctggggtcaaatttctgttggtgtcatcagagggccaagaaactgcaggagcaccaaaaagtctcactttcttcttcttcttccattgtctccctacaaaaagggctgcaagaacacaaggagaaaaaaaaaaaactgcaccaagaacaaattgcaaagtaagtttgtactttgtactttctttgcagcaagaagagcaagaagggagatgtccatgaacgcggacctcggcaagccgagggagctcaccgggttgcagcagaggagggctctgtatcagccggagctgcctccatgccttgaggtttgcaagctctccttcatcctcaccacttgcaagctgcatcaagctactttttttcatcactaattatgaaaagttgcaagttttgaacacagtatgttcactttgtatttaggtccttgtatttgtattctctcaaagtttttcaaccaacatgttcagggaaaggccatcagagtggagtttggcgattcgacgacgaccatcgacccgacatgcgca

SEQ ID NO: 61960 - DNA, 20557 bp, Oryza sativa
  unsure (1)..(20557): unsure at all n locations
gtcaactccttgtaacatacttattttattgnnnctcctcnncccttccttttttcttcttntnnttccttntctnngtttttttnttncnnccaaanccccnnnccncnnnaggtgatgattgcgaactcgctcgnnacccancancccgnnctgttgacgctcttcagcgtgccatcgcaacattctagcattccccttgttcctgaacaaacgccttagccgtggtattatagggaaataccacatcaccttagcaggaattctcttctttggtacctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgttttcccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggatgaagacatatatataggggtgggactttagtcccggttggtagcaccaaccggggctaaagatcaccgggatcattagtcccggttggtattaccaacggggactaaagttaagataccaaccggggctaaagatcaccgggatctttagtcccggttggttaagatctttagtcccggttggtgttaccaaccgggactaaagatcccgggggggcctgacaggtcctgacagcattcgaaccgggactaaagatgatctttagtcccggttggtaacacaaaccgggactaaagatcaaatatgcccgttaccctttcgaaccgggactaaagatcatctttagccccggtttttattgcatccgggactattgtggaaatcggccgaccgacgaaagatggtttcttcaccagtgtatagttattgaaagatattacagttgggggttactatttaattgaaactaaagtattggataggataaataaattgcctacaatatgcaagcatgcagtggcgcttctcttttctagaactaataaagagagatgtatgcacgcgccggatattctaggacagatcgatctggtgatctgttctttcctatgcatgcgagcaaccaaatctgagatggacatgggctgatgcgagcgtatatgaggatggcaagtgtatatatacgcggtcgtacgatgactgtagaggttccccgatgacggttgaatctgatacagtcgatgtatttgtactggaatcgaacgacttaccaaacaatcagcaaaaacatcttctatttttataatggtagagattgggcatcctttttatttttatatggaagtctgcagtgtgactataacctagccatattagggttgttacccttgctataagggagcagctaaaacatgtcactttggctgtatgtacatatgattggatgtaaagaccgggtttaccccattttcttaaaaaaaaaaaagctaaaccaggtctctgtcaaataatagactttcttcaaggaacatataaatatgccattcaaaattggagtgtgttggggcttattaccatatgaagaaaatcacgcatttttaaaatgggagtgcgttgttaccgttgcaaggcatgttttggcatggtatgtactccctccgtctcaaaatataaatatttttagctataaatctggacatgcaggcaaaagttgttacattttggaatggaggtagtacataggtagaatggtgacttttttaaggcagtgcagactataaaaattgttgaggtaaaaataaagttgcgtacatcatagtaaaatccctattaggattatttctataaaatcatttttggtgaatttatccataacgtacaaggtagctagacatgatttgtacattgcaatgttgctactcccttcgttttatattggaagatgtttgatgttttctgtcctagtcaaactccaagtttatagaaaaaattgacaatatctaaaatacaaaattaatattattaaatctaacatggcatatattttataatatgttttatacagataaattcatttgatcaagtgtgtggagcattttgtcaaacacatgaccggcattggcaaagttttctattcagaattgtaacaaactccaggacgccgagcacatgtcgccatgaactccaggacgccggctgatacttgaggatacctagtttttttttttcaaaaattggagagcctacctgctagaatcgccaccgccgctgggatgggggagttcggtatgagggatggctggatcttggacagcacgatggatgaggcagcaacggcacagtggaggagccagccgggaccgtgcgacgacgacgacatggagccatcggcgacacggtggaggaggcggcggggatggggggatgcgggaggagctgggaccacgcgatgacgatgacggcatggagttaggaggattcgggaggcgcagcgcgcatctggagcagcgtgaggaggcacggcggtgaagtcatcgcgttgggaaagcacagcggcggtcgtgggggcatagatagcacggttggagggtaagcgacaaccccggcggtagggaggcacggtggaggatttgaggggtaggcgacggtgccggcggtagggaggcacggccactaggggaggggaggcgcggtcactgccggggtggagggcggccgccggtttcgtcgaaagaaaatgattcgcgggtaggagtgcgggcgtaatcatggcgcggtcgagaggatagggtcgccgaggatagaatcagtggaagatttcaccaaacggattaatggattatattatttaacctaccggatggacggtacagattgatccggatgatttggcttatagaattggaaagggcaactcctactttttatattagtatagatgaagaaaatcgatcacgcgcacagcctccactggcagctgtgtcgtgtgtcttttacaaaatataagggtcataggatcgttgttgatccaaatttaattagcaatgatattaatttttgaagtcgatgttttacccacatttttttaatatatatatatatatatatatatatatatatatatttatatatttatatatatttatatggaagtctgcagtgtcagtaacctaccgaaattaggattgttacacaattacagtacttgctaagggaacagctaaatctacctcctccgtttcacaatgtaagtcattctagcatttcacattaatatgaatgtgagaaatgctagaatgacttacattgtgaaacggggggagtaattaacaggcgactatcaaattatagagtttccttagagcagcagctgaaagcaatgccattcaaaagggccttgggcttattcccatatgttgaaaatgattgcataggccgcaaacatgggcaatatcatgttttctgttttggaaaataaataggacacttattgcaaagagggtgatagattttatttagaaaaatggaaattgctaggcatcgccgcatcggtacactattttcttttcagttagaatcttgcccatctgatctatcttgagattttgaggacccattctagatcagacctgttatataatcccaaaccgcattagagacatggcatagttttccgatctaaaggggtgtgggattagataactcacaatctttttttggaagaagtacgaattgccccaccttcccccctccgaagtatcgtggtcaaccgaattaccctccgaaacccgaaaaatagacattctcaaccactaactatacaaaccagacaaataacccccctaagcaccgttttgagctattttcgacttgagcttgcacacgtggcaatccagtcagcaaagaaaattaaaaaaactcatggacccatctagcatcccttgccctccccaatccctctactctgtttctctccctctcgctcactcggcagacctcggtcagctggcggtggaggcggaggcggagagaactcgggtggccggcgctatcggcggggcgacaaggaggctgcagcgtgaggaaggcggccgccgcagcagtggctagggagcgagctcatgacggtggagcaggcagaggcggactgagcggtcggcgacagagaaggaggccgccttattcaccgacgcttccggccggcgccgtgcacagggctcgctacccatcgaattcccctcccacctccatttcctccttttccccatccacctccgctctccctcccacatcccctccacctcccacacactgccgggtgcagcccgcccccacgtgccgctacccaccgcccatctccgcgccgcgccatgcgcgccgtcgcccactgaccacgtatgacatgtgggtcaagtgaaagataggaagagaggaagagggggtatgacatgtgggtcccaccattttttaaaaaaataaaattttgactggactgccacgtgtacgccacgtaggacaaaaccgctctttattagattaagggggtaatttgtccggtattgaaagtttatggtgagcgatgtctggttttcgggtttaggggacaatttgattgaccacaatagttcaagggggataatttgtatttttttcctttttttaatataatacataacttacaattatgacataagtctcaattatttcaccccatttgcactactacggaaatcctaattggtgccggctgggaaacccccttagataccagttttcccaaccagcatagatgacttatgtcatcggtgccaaaccggcatctatatgtgtattagatgccggtttctcgatgcaccagctcgaatcgagctgatgcatcgagcgcatccacctcgtgttgccccaaaatatcaatccacaacaccacagaacaatgaactcccgaatctatcacatatcaacaagcattgaagaacaagactgaagcggaaggacagaaggccgactccaccgctgctcaccatcaccgtctgccagatccgctgcgggagaagccgacgccgctaccaccgctggatccgcccaaggcagactctcttcccgctgcctgccctccctccaaatctggcggagggagggcaccaccggctcctacactcccaccatcgtccgaggatccgtcgctgctgccgtcgccgcgccgccaccaccttctttcctgcgccaggttgccaccatatcccttttctccgcctcctggtggagggagggcgccgccgctgcctcctaagctctggcggaggggagggcgccacaactaggccaccgacgcctccatcggatctggcccacgtgaactgccacctcctttattgctggagagtgagaagaaagggggatgggacgggaaggagagggagtgagagggagagagatagacgggtcagaggaggaaatgggggggtgagatgaggagacagaattagttatgcatgtattcgatccaagttattcgctttcatttaattgggatctttacatttgagcatatatttgagtatatgagacttgtggtgttgattaatactcatcatttattcatatccttttatacttgtcgtgacggctttgtcatgatggaccgcgcgaggccatttgaagctacaagtaaccgcatcaatcatttgaagaatatatggtgaaatggtttcgacattggcgtcccttaagacaatgaaaggaagacggaaataaggcattcctattgttataattctattgctatttacatttgagtataagaatgtcgtactgttaagagggatgcaacgtcgaggtgtttgtgtatgtctcggtactcaaagtgacctatgatagtactaccttgagagaaacccaagctctaacctatcctttgagtggttttagactttgttttttgttgagttgagtagtcctctaagtgagctttccatagagtccaaaatcataaaaacatactcccgagcgaaaagttatagtcgtttttctctgcgcttttccgaaattctgaaaatggctgcgaaactgatattggcttctgtaaattttcggacatatttgaaaatgcttttcagaaattctgaaaattacagtcttggcctacaacggctagtttttgagaggctcggatatataaactcctccaaccctcctttgagtggatgctgttcttggcaacattagacacatccaaagccaaatagccatccccatttctctacctttgtggtgcctctttatgagaaggatttgagaagggattagagttggattgagaagttgagagctagtgagcttcactacatactttgagtactcgagttcatagcaagcaaagcttcgattgtgattgttactcctgggtactaaggtctcctagacgactaggcgttgccggtgagcacccaaggttgtggtgtgccatggaaagttgtgaaggcttcgatttcgcctccgcaagggaagaaatcaagagtaaaaccgaggagtgcatttatacaacctcgtgagggaagggttgaaatagacccggccttgtgacccctcaatggagacgtagaatccgtggatccgaacttcgggaaacaaatcaacgtgtctcctctcttggtttgctcgttcttgccttctcttatattgttcttgagcttgttttttactgatctacttacatgcttaattaatatagttggtgaccttatatcttgcttagataccttatttgtcaccttttgatttatatacattttgtttattcgagctacaagtttatacctagtgttttattccgttatccgccgaacttttcagttgagaccggaacttccaatcccataccagatgttccgatttgaactgaaagttctcatctctctaatatgctatgaagttgtgataattttctaggaaaacctattcagctcccccccttctaggcgacctcaagatcctttcaactacaaacatttctgtggtagttggtgaggtgaaatggcatggccacgacatatattttggttgttaacaaggtaaccattgcttttccaggaccggttagcgagacggtcgcataattttgagcggttgtcaatgcactagccacattgttttcaccttggattttctcctaattcaaacatctgggtattgtatctttttttatccaatattctataaaattgagctctacctactggttcaactgattatttcatttgagtgaaaatatgggtagcaattcatagtagagcaaacaagcttcgtcgtattcacacttaaaaggattatatgtggagccagcccaaactctccaactttggcgccgagaccaacgagtgatcgagatgccttggtgctgaatttattcaatatgcctcaatcatttaaggttggggaattccactagcacctcacttctgtatcaggtcatctgtgacaggcctaaccgagccgttacagatcacgtacctataacagacgatattttagccgttagggatcgacactcatttgtaacagctcaccaataggagccgttatagatgttagtcgccttatctgtaacggctcttattaaggagctgttatagatacgcccctcatctgtagtactcccattatgagccatcatagatgtcaacctcacatctataacggctccatttaaggagccattgtagatgtatctctcatctgcaacggctcctaatgtggaaccgttacagatgattttaactcgaatcaaccgcaagaaaaaaaatcccatccctcattttccccaccagccacatatctcacttatcatttcctctcctccttcctccacatcgctggtgcggtggagatgacaggcgtggcagtggtggatggcggtgggcgtcgggtgcaggtggaggtttttttatgcatgtgtgtgtggggggggggggcaatgcatggtcagcggagggcggtgggttgggcctccacgatgacggatcagcgaagacagcatccgaccaccgccaccactgacaatgcggactatgcctagacggatctagccaaacaccccatgacctcaactcggttggattctgaggaagggattttgaggagggaggaggaggtagaggtgaggagagagaaacggcgatggagataacgagtagggtggtgcgtgttctgctggtgtcagtggcggagtgcgcggcactgctagtgacaacaacggtgaaaaaggacaattagctcggtactcgtctcagcccctctccctttccctttgcttcatgcgccacctcatacccagatctggcagatgattctcatctttgatttctctatgttcgaattaggatgagggtgttctacagcatggcggggcaagtggatgtgatctagacgcggcggggtacacaacaaatgtggcatcaccaacgccatctccaagtacaagaacacaacaccgacgtcgagcagcaagaggccaggagcagggatgaagacctgtatgtttgtttgatgaatctccacatcaataacagctcatgggcttggattttctttttttaagctgaattttcacatctgcgacggctccaaattcttagccattacagatgagtcttcacatctataactgttgggttgtaatggctcgtctaaccattaaagatatgggtattcagccattacagatgtagggtaatgtgctagtgtttccttgactcactaccacataaatactcattggtgccggatccgaaggcctcatagtgccggcttcggacccgaggggcagaggtgctggatctggaaccgacacctatagttttcaacgaataaaaaaaagaaaaataatccgaaccgcccaccaccggccggccaccaccccgcccggcctacgcgtcaaccattttcactgtcgccgccatcaccagatctgaatgagacgggggggagggcggataaagaggatgagggaggggggcggtatgcctcctcctcctccgccactgccaccaggtccggcctctgcgctggccatttccatcgtcgatgccatcaccagaactagagggagatggccggcagagtgagcgagccgatgagcctcctcctcctttgccgcagccacccacctttgcaccggccttctctaccgccgccgccatcactagatctagaggggccaggaaagaaaggggtcggcgagtgaggaaaacggcagcgccacaccgcaccgtgctcctccttgccatccaaggtcgctgggggagagagggggccgacgagcctcctccacaccaccgccgtcgccgccgctaccttgcctggcctccacgcccagatggtccaccaccgcaggatctttgcaccggccagcttccgcgccgctactcggagagaaagaaagagagagagaggtagagagagagaaggggaggatggaggaggacggcacgaggagaagggaaacgttgcatatgcaagagagatgcgatgtgcatataagtatgagtggggcgacttgttggttcttttaaaaaaccggtacctatagtattgataccggttttttctaatgaaccgacacctataaaccttaaaggtgtgggttatttttttttcttcgtgcggaggtggaaaaaaacccaaaggtgctggttttaagtgaattggcacctataaggttcctatgagagtttctgtagtagtgactctttcttgatatcgcggctcatgtccgagaattcatgcatgattccttcatgaagcggcaatgatagatcatcattatcgatgttcatgacttattgatggtatagctcagcgtatcttatgatagtcaaattattaattattcaaaccatttaatgatagctaaagaaagttcactatatcttatgagttgttcgtatcaaataattaagcagataataacaacaggctagaccatcattcttgtctttaatgcgcactgataaagtaccatgcaataatatttacgacgtactttctctagttaaatttaggaaaaattggttatatagtatcggaagttcacgttttttgttttatagcaccgaaagataccggttcactttaatagcacccaaagttcaccctgttcctatttttagcacttccgtcaattctcgatcgtttttcgtccgtctccagccacacacacgatatgacgtttctacccctcacaaatacaagtagaatgcatgtcaatgagaggtagaaacgtcatatcgtgtgcgtaactgggtcaataacgatcaagacggtcggaaaaattgacggaagtgctaaaaatgagaacagggtaaactttaggtgctattaaagtaaaccggtatctttcggtgctataaaacaaaaaacgtgaactttcgatgctatataaccaattttgccttaaatttactccctttgccccaaataataaatctagtataaaagatgttccacattctattacttaacatgtttatggatgctactacaatatcgtgggcgctctatagtcgtaaccgtgacaactaccaaaaaggtacaccgtatctctccagcacgtgccattcaaaaacagcaccgcacgaaactttcgtgtgcgcccatttcctgctcggccaacccacgctgcccatgcaagagccgaagagtgacttaattagcttctcttcccacccatgtgcagccatacaattacacacataattaaggccaccgagaagaaaatattagaggtttgcgtgaccattcaccatcaataaaaagtaatataaaattgaaggttcatcgagcaactttgcaggtaaccatcccacatttccacatgaatatatgtaaaaaaaacacaaacatgcttttaagccgaaaaacatcttgacacttcgatcatttcagttcataaactatatatatatctatcttccgccgatacttccatgtatttattttttaatcctacataaaaggagaatggcagaaaggaccaatatacatatagttatatctgtattatgtatatgttactactaaataggttatattacatccataatcatattgccaaaatttgtgtccggcttgccattaattagttccaaaatttgtataaacaactttaaacatcgttaaatcagaaaataaatagtactgaagttacttttattaggaatacctaagttacttctatcttagaccatgcatgtaaaaacaaagttgcttgtatctaaaaccaaattaagtttcttctatctgtaccgaagttacttatatctggaaacaaagttcttctatataaaatcaaaattatttatatctgaaaacatagttatttctatctaaacaccaaagttacttttatgctaaacaaaagtttcatctatttaaaactaaagttacttctatgtaaaaccaaattaagttacttttatattaaaacaaagttaattctatttagaaacaaagttacatctatttttgaaaccaaaattacttctatttagaactgaagttacttctatctaaaaccaaagttacttttatctaaaataagtgttctttttctttgaaaataaaacatatcaggttttaggtatagacacatgtgattatagagttacatctatctaaaccaaagttacttttatctaaaagttacttctatttaaaactaaaactacttttatctgaaaagaaaagtatctggtcggatatatttatgtaattcgtaaaatatcaaaatgattaagaagacctaaacatatcattttaaatgatatcaacctaaacaaatcccacatatcatattataccctagggcggtttgacaaccatgcccacaccgccgaacgcatcaaattttcgccccaaaaatgggtggtgcactgatgtattccctttgctcactaaatggactcaccaagtgaaatttatgtgtgtaaacacacttaacaaactaaggtactaacaaaaaaaaactcaaatgagaatgtcaatgccttcgccttcgtatatctatccattttcagatattagaaattagaaatcagaaatcaagcataaaaactgcacgtgcattatcaaacttcaacatatcagctgcatatgtcaccaaggccaaatttttaaaaaagagagagagagagagagagagaggcaaaaatcctctaatcagcagtgaagccagtaagacgaaagagaaattgacagagaaatccaacagctagccggaggagctcctctaggtagtcggctcctgtgtcctcaagctcaccacccaacttgttatattgatccgtagtttgctcccaacaatttcatacaaattaacccgtcgcgatagcatctgcagtttgctcccagaatattgcatacaaacatacgtatcacaaaagctgtgttgcatacattcagaatactgaatatgtacaggcgctcgcccccgtcttccacgggcttcttccagcgcctgccgcaaccaacgatgacgccatttcctccactgttttcctcgccgccgttgacaggcacaccggcctgcgcccgctcccccgtcgcttgttcggaatagtatatatgggccagaaagtcagacggagaggggcaggcccagctgtcagtcagacaagcgcaggcccagctgatccgctgtgtgttggactccagtaggacctagggctacgcggctagctgtagccttgtagctatctatctcatcggggggtgcgtgcaacgccgccaccgacacagacaccgcgtgttccggacgccgcccttggagaggagatgcagcccgcagatccgccgattccgccgccgcggccgccgccgccgatgccctccaggaagaggggaagggggcccacgaagggcgacgacccggccccggatgaagcagcacctccacgcaagccgtcgccgcctctgggctcggggagcagaagggctcgcaaccatgttcctccaccgctcggagttggaggagacggccgcgaggagggcgtcgacttcgtcagccacctccctgacgccgttcttggcatcatcatctcgctcctcccgagcaaggacggcggtaagaccagaaccctctccaaacggtggcgccctgtctacgcaccacgccgctcaacctcgacgccagcgatctcgcccccggcgccaacggggcggcgctggccgtcctcctcacccagtactcctcgctcatgcggggcccgtacgccgcttctgcatccccgcgcagcagatccacgagcgccccgccatggtcgaaggctggctgacatcgccaaggttcaacaacctcgaggagctcgagttcacagaagacctctgctatatgagacaactccttccgctgccgccatccattttccgcttctccaacaccctccgcgtcgctgccttcagccaatgccgcgtccctgattgcaccgacctgatgctccagttcccccatctcaagctgctctcattacggcaggtgaaaatctccgaaacttccctccatagcatcatcgccggctgccctgccctcgaaggtttgctgctcagaaatagctacggattccgatgcctccggatcaactcccctaccactagaggcgtcgccttccattctccctactgttggagtcatggcgatggagaggtgtgttaccacttggaagatgttatcgtcgaatttgctccatgtcttgaaaagttgctccatatagaacaatcggtgggattgggagtccgcgtatccgttgttgtggcacccaaattggagacattggacgtccttgacgatgttaaagacggctattccgtactcgattttggcacggtagttttcaaggtatgtgacttcctattatccctataccccctcgcaatctatagggattaattacaagttgcatttgcattaatttctatgtgcatatattgttaatgagatgtggtgttaagagtttacccatgtacgtccagttcggagtccgggttttaatctattctctaaaaaaatatgtcgtcttggagttctctttagatgatattagtttgattcagataacattatttgaacatatcctcattctttcttgaagttactgttctagagactatggcgtacacacttcattattgtctgagttactggatagcaagctctcgcaacactatgatttgtttggttgtgtgcatcctcagtagatgtagcagccagatgtaatttcattgcttgattatatatccattatctactacttccgtcccaaaatacatgtagacgtcacctagtactataaatctgcacagaacctatctagatttgaagtataagtggtgtctaatcgcagaattaggtacctatagttttagactgcgggatagaaaatatggtcgacaaatatatattattcacaaatggcctaatgttatgttccgtgcttaatatagggattcgaggtcgttaacttcacaacgccggtgtcgagtgtcaaggttttatctctcgtcatgaaaaatctcagcttggacagggttatcatgttaatgatttgctttccatgcttggagaaattgtacatcaaaggaaaaattcttttattttcaagtattgtgttacaatacttcttttgtcagtttaaataattagaaggtatttaatttgaagaacttaaattattccccatttcttatttcaggggttcaagtgtggggaaactaattattgacgccgcaagtatctgaaaactatcaaaagccataacatatctctaaagactgttgtgctggatgattatcgtggcacgaaccggcaaagttcagttcgccacattcttcatacggaacgcgagaaatcttgagaacatgatatttacgggtggacctaacaaatacaacgcatattttattgcacaacagcctaagctgctagagtttgagaaaagggcttcaaaaactgctcactttcattttagaccgaagcgatgttataatgattgggtgcatatcaaggatgtccatgatttgtctcttgccgatccttttgaatgtacctgttgagactgatgggtggaattattgtaccttttgaaggttcgagctaggcaagagtactttgtggaggtgctcgtttcgaatttaagagtactgatggatgttgtcactgagctgaagagctatattgatcatgttgaagatttatcttaatatatgtacctttggatgttgttgaagaaaaggattgatctggtgtattgggctgttgtttctcagataccattgtatgtgtttttttttccaatttctgctgtaataatactggttaataaaattgttgttgatgccatttagctgtcatattttttgattattttttgttctatcctcaatctttttttatacattatattgggcatccttttttttatatggaagtctgaagtgtgactataacctagcgaaattagggttgttattgttgctgtaattaagggagaagctaaaacaggtcactatcaaataatagactttcttcaaggagcagctaaaaaatgccattcaaaagtggagtgctttggggtttattaccatactagtacagtgcccgtgcgttgtgtaaaatcaaaggtgcttttgattattattctgtgatgaacaattgggcattggagattattggttttgttatttggaatttattcccgaagtggttttgaagatgattggattcacaggtgatcgcaggattcattatttcatgtgaccggtcagaccgggctctggtagccggtcagaccggcgtgtaatgcgcggtcagaccgacgcagcccgcgatctgaccggccgacactgtatcggttttggtttcgggttgtttgtttggatatctgagtttatttcatgattatggcttctagatggatactatacgtatgtaatactgttgtttgctactaatgagtcaagttggagatagtttggtctcggaatatggtttctttgtttatttcatgtgtaggtgactcgatgtctcgggagagtatttgcggtgatggaccgggagtcggcttggggataagacgacgtccatggtggtcagagatcatgcgggatactaaggctagagttgatgcacgtggttgatatagatttcatatggcatacgatggaggtattgtgtgcatatgggatgcggagtccaatttggaaggagtccaaatttggtatgattggttatgtaaagtttctttcttgtactagtgggtttcctaaggtgtttaggactcctagtatgagtttggttcgtggctttaggctgcctacctcatgtataaatagagggggagcgtgaggcttccctatatcgctttggagagcaattgagttgagttttgagttagggttccgagtttagtcgaaatttttgtaaggagtgctgttggtgcactttgtaaacacagagagaatcaataaagtcgtcatccactttaagagttcttcgatttgtgtttactgggttttggcggtctaaccggcaatctatcggtggtcagaccggcggcacagggcggtcagaccgacggcatacgggcggtcagaccggcggcggcgacaggcgcggcaggcaacttcggtggtcagaccggagattcaacatcggttagaccggcggcatccactcggtcagaccggtagattaatctcggtcagaccgacttccgtcgatttcgagggtaacttttatttccgctaaaagttttcggtttttggtataccaaccattcaccccccacctctggttggcttagttgttgtgattcgatcctacaagtggtatcagagccttgttttcttgtatggatttttatcgatctagagtttttgccatggctactcccgctaggttttcaactaaggctcatgttttcgatggaacggatttttcttatttggtgtagtaggatgcaatcttatattatggctgaagattatgatatttggagaaaagtttctcatccttatgtgattcctgaagctattaatactgctgctgaaaaactgcttttgaacaaaattgcaaagctcgcaatattcttttgagtggtatttctcgttcggattatgatcgtgttgctcatcttcaaactgctcatgagatttggactgctttgagtaattttcatcaaggaacaaataatattaaagaacttcatcgtgatcttttcaaaaaggagtatattaaatttgagatgaaacctggagaagctttggatgactatcttcctcggtttaataaaaattttgagtgatcttagatctgttgattcttcttatgatgctaattatccacaatctgagatttctcgccactttttgaatggtcttgacatgtctatttgggagatgaaagttacatctattcaggagtccattaacatgtctactttgaccttggttatacaaaattgaaaacgcatgagatgaacgttctttctcgtaaagttgattctaagtcaagtgctttggtttcttcttcttcttctttgcatgttgatgcttctccatctaagtcttcttttcttgctatttttaatgccacatccgatgaacaagtcgaatagatcgaggaggaggatttggctttggttgctaacagaattgctcgagctatgaataattccaggaataggaaaagaggtggtccaaaaagttgctttgaatgtggttcaattgatcatcttcgttcacattgtcctaagcttgggagaggcaaaagagaagacaaagatggtgagaagaccaacaacaacaagcccaacaacaacaagtcgaagggttcatcccaagggaggaagctggacaatctcaggaaggcttttcaacaagtttgcgccgccttcgagccactaagtgatgtagatggtgaaagttgagatgatgataagggaaagaacgtctccgatgtttgcttcatggcgcgtggtgaatctgacacagagtatgaagataatgaggtgagtgcttttgaggaagctattaatattttgagtgcaaaaaataagaagtgtgagaagatgtatagaaaacaggaatttatcattgaatctcttaaatctgaatctgataggttaaaacctcttattcctaatgatgatgattgctcaaattatgaggttttaatgagtgagatttcaaaaattagacatgttaatgctgtacatgatttgaaaaatagatcttctcttgtttgtagttttgctttgcacacacgcactttggatgagttgtttttaactaaaaagttgttgcaaaaatatcaaattgcttttcatgctaacttgatgtttaatatgatttctgctaaaaagtcaaaacaatctcatgatgttttggattgctcaacatgtaatttgaataagttgaaattgaaagatgctttaggtcgtgttgagttcatggaagatgttgtgaaaaacaatgaagtgctttcttgccctaaatgtcgtaaaagcaaaggtgtcatggtagattgtgaaaattgtgctaatttggaaaaagaggtttcttatttgaaaattctttgctaagattttctgatggtaaaaagaacctcaacatgatcttggatcaatcaaaggttagcacacataaccgtggtttaggttttaatccttatgctcataattctagacatcatcctgttgtgttaggtgttggtgctagaagtggtgagattttggttaaacctgatactaacaaaactgtgtttaaatctgctggtttcatgtctaccttgaatgcatcttcttcaaaatccaatgttgtgcatgcaaaatctcctgttattgcttgtgttgctaaatcttctaatgctaccaatgtgtctaatcatcgtgaaaaatatacttgttctttttgtggcaaagatggacatattattggtttttgtttcaggttagctcataaacagaaaaatgagagagagattgcttttgcaaaatcaaagtggcaaaaatcgggttttccctcgaggaaaccggtcagaccgcagtgggtcccacggtcagaccgatgactagtcagaccggctactgagcgtcggtcagaccgggcaccggtcagaccggtggtacagaggcggtcagactggccactgtaccttggtcagaccggcctcggaggaatttttctgaaaattctaaaattgattttgcacgtggatatatgcctattggatctgctggtcgtgtgtctcagtactggattcctaaatttttattatcatctaaccccagtactgaggcttcgacttctgcttgtgtgtaggctttgatagcaaggaaggacaacgtgtggatcatggattccggttgttcgcgacacatgaccggtgacatctccaacctctccaagtaccagaat

SEQ ID NO: 61961 - DNA, 968 bp, Oryza sativa
  unsure (1)..(968): unsure at all n locations
gcgtgattaggacatcttcttgcagcacgccngcaagacgactatagaggatccccagactaaaataatcatgtatgctaagtgtttcctgtgcatatgctaaggctaattaagactactgtngccaattgctaggaggggcaccaattccgtagtcaataatgtcatactcagcctaattagcaataaataatcttacattaaaactcaaataatattagaacactacacaatcttatatgatcagggtaattacaggtctaataatcttaattaattggattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatatatatatatatattgcatttcacgttaacgttcgtcctcgttcgttcgctcgttcacgttccctagctcgttcacgttcgttcgctcgttctcattcacgttcgttcgcttgttctcattcacgtttgttccctcattctcgcttgtcttcgttcgatcgttctcgttctcgttctcgctctcgttcgttcgatcgttctcgttctcgttcacgttctcgcggcaacgtacgttgacgtgttcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcagcgtgccgacggcggcggcggcgtggcgttccggggccatggcggtggcggcgtggcgtggcgtgacggcggcggcgtggcgtggcggcggcggcgttgcgcgcgcggcggcgaa

SEQ ID NO: 61962 - DNA, 752 bp, Oryza sativa
ttgagcgtcactaaaatatgaagattttgtctttagaagcaaaggaacgtgatctgataaatctctgtttagagcaacaacagaagataaaggatacttttgctcccattccgttgatactaacactctatccaatttctcataggttgggtttgctagattatttgcccaagtaaagttcctaccagacaactgtatctccctaaggcacaacccatcaataacagcattaaacaaaaagggccatctatcatcataattgttattactcttatcattaggactacgaagaatattaaaatcaccaccaataagaattggtatagtctcatgactgcacatgttaactaattcttcaaggaattgatctttaagctcattctgtgcaggcccatacaccaaaactaaagcccatttaaaattatcagccttatttcgtaaatgaaatttgatataaaaatccccctcatcaatcaaaccaatgtcaaaatttagaagattaattcctaaaagaagaccaccagatctgcctctaggagatttacagtgccacaaaaaatctttactaacacaaagattattcagagcagatgtagaaaattccttcttaaccgtctcagataaaacaataaaatcaagttgatgttctttggttaaatcagaaacaaacttatgtttttttcgggtccttgaacccgtcacaattccaaaaaaactttgccactattagacctaacgagccacatgctcaa

SEQ ID NO: 61963 - DNA, 6593 bp, Oryza sativa
cccaaaaaagggccctttttggcccaattggccccttggcccaggagttcgacctctagaggatccccttttataaaacctttttaactttgtttatttcttcttaattattatttgtgctctgaaaattccactaaaatttatttacgcattttaggcttttaggaagtatacaaaaatcctccaagccttatttgacttttaactttgcacattttaattgtgggaggctttcacatggattttaattattctaggcattatttcgaggatgtattttagagtcattttgggacgcgacaaacctaccccccttaaacggaatctcgaccccgagattcggaagaactgacgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttactctgagtcggccttctcggatggcactcgaagacatttcttgagttgcgacacatggaacacatcatgcacgttgcccaaggaggcgggcagctccaactggtaagcgacttctccgcgccgtgcaatgatacggaaaggacccacaaaccgaggtgcgagcttcccctttgtctgaaacctgtgtacacctcgcaaggacgtgacccgaagatacacaaagtcatccactgcgaattctaggtcacggcgtcggttgtctgcataactcttctgccgagactgggccacctttagattatcccgaatggttctgactttagcttcagcttctctcaggatatcggtcccgaacacttggctttccccaacttggtcccacaatagtggtgtccgacatttgcgcccatacaatgcttcataaggtgccattagtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgtggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcgtatccaccttgggtttttgaaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctctttatgttctctgttatctggaacgcatacccgatttccgttccatagggttccgtgttcatcctctgtgaaaccagcggctttaccctgtttcatattcttgaggagtccacgcatgtccgggtcgttcttctgagcctcgcggatttgatcgagtaaggtgggcttggcttccaacgcagccaagaatccgcgacccactatgcttagattcagggcttccatctgttgattaagttcgggtggaatgccacggacgttaagagtgttgcaatggctttttcgacttagagcgtcggcgaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccgtcctgcatgagcacgcaccccaatccttggcgcgaagcgtcacaatacaccgtgaagtccttgcgagtatccggcatgattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcagtgacggcggtcactgtttcggggtccacagcaactcctttagcggatatcacgtgccctaagaacttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccatgaatggcacagatataaacgagtgggaagctccagagtcgaacaaaatggtagcagggatggaatggatgaggaacgtaccaacgatgacgtctggagttgtcagcacgtcctcggccgtcacgtggttcacacgaccccaaatgacatccttaccaccgttgttggagcggggaggcgcttggccttgctggcgcctcggcttcgggcatttatccgcaaagtgcccgggctcgaagcagttgaagcacagacgctgcggaccttgaacgtccctgcggccttgtccagactgcgcggctggcgtaggaggacggggcgcacgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcgaaaattcgccaagcgacgcttgtgcgactccagttccttgtgcttggcttccaagcggatgctcttgtccaccagacgttggaaatccggatagtccccggagactagacggacggacagctcaggatccattcctgccaagaacttctcctgcttttcctcatcttcccgtacatcctccggggcgtaccgggccaggttgttgaactcatgcaaatactccatcacggagcggttgccttgcttcaactctcgaaattcccttttcttaagggccatgactccggcgggcacatgggtcctccggaaggcggcggtgaagcgggcccaagtaataggctgcccctctggctgtgtagcctggaaatggtcccaccatagagatgcgggcccctgcagttggtgggcggcgaagacgactttctcctcatcgctgcactgcacggtgtctagcttttttgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctggcaatcaaaaatgaacagcagcggactagcgggcctatggctccatcttcacaggcgctcaactggggtataagccaggactccacctaagacatcttctccaaagcttctcttactgaagaggggaaagattgagcaagaatgagtacaaccacagtactcagcaagccacaccggcggatgcatgattaatgcaagggggtacaaggggataataatattggggttaagttttgcagtaaacagcatttaaaagtcacttagttgcccaaagccattttataaggacgatcctagagctacacaatgttattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcagcttgcccataaccgagggcgcggctattcgaatagattatactctgatcagaggtgtacatctttacccacaagacacatctccctcacgtgtaaccacgtgccacataccaccacggtatacggacggaagacgtgacatagttcccaacccatcctagccataaacaagagtaccgacccaaccccacttacggccggaacccccgggacagccagccaggattgagccccctagcagcaggacaccagccctgtgccatgacatctcgactaccgggccgcagctcgtgtagccttcatttgccctggagaatgtccatcgacccccgatttcatccatctccaatccgtgtacttttgtttataaccagactgagccacaaactaagccttacccactagacatgtgaaagtacggtagtgctttgcaacagaggcccgaagactggtccttatatacccgaggtgctactatcaaaacccaaccatgcaccccgagcccagcctaaaaccattttggggattttgaatagagggggcggtgtgaatccaattctacaatactccaacaattccaaagtgtccaggtgatatgaatatcccaaagtctagagttgtaaaaccgcctaatgttacctaattaaaaagcgaagcatctacctaacatcatactagtggtaccatgagtagagtgtccactagttggggttttgtttaatctagggtgaataaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaatgtcggcttcaacctccacgaagagtggatcttccgaagctgcagcgtctacacgaccaacagaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaatattaatttaaaatggatttattgcgtcagccgaggggaggggcgcgcggaccgggtccacgggagtggggcccacgcggcagcctcacggtccatggtggaccgggtgcacccggctcacaccggccggcgccgtgggtcccacgcgtcagccgcacccgagggcgcgggcggctgacggccggcccccacatggcagccgcggggcgcgcccgaaggcggccacgccggcacagccgacgggaggcggcgcacccgcgccccgatggtcgccgccggtgt

SEQ ID NO: 61964 - DNA, 653 bp, Oryza sativa
cactgggtttttaaacatattcctcacctatgcgaggcctacatcgaggtagtgcctttcttagatcttattattgctccttctatgaactccggtggatggaagccaatcgggtttcaagatgttgtatggtttcgccttcgtgatggcatgaaggcaagatacatctctttccaatgccacacatcccggagccaatggaggtcgagatggttctatctagagctcaaagaacttgaaccggttcttgtcatacccgaggttcagccggagcattccgagaactggacttctaaacctccgttgacaccctctctccaagcctttgtcaacgctgtgagcgaccttcgagagcaaggattgaccggctatgaagtcattaaggactttgtcagcggtcggatccaaccgctacaagcccgtgctcaccccgtgttcgactacacgggagcagcaggatataactcgaatctcttcgcggggtatttgaccttatgttgtaatcttcttcctgctttcgacgatgattgcgaggccaagccctaactcatcctctcatatcttcatttatctcagatctccccgccaacatcgtggcgcagcgggtcaaggaagtctcgatcagtccttcctctacggtcgatgaaacaccg

SEQ ID NO: 61965 - DNA, 807 bp, Oryza sativa
gggtgttttctagaccagtggatcccccaaaaggttccggattggctgcggattcggagaggaagaggggctcggtcggccgactcgggctcggcctgaggccggccggaggttgaagaaacctccgacatgtgggccccacatgtcggcggctggaggaggaggggcggcggctgagctgggccggcttgggccgcgcgggagagagagagagagtattgggccgaattcggcccaacggcttagggaggggttttttgaacttttttaaataaaacaatttgtgaaatgttgtttcaattattaaaaatacttcccttgctcaaataattcccagaaaattctagaaaatagaggaacaagcaaagtatttaataaaattttatctagctcatttttatattgagatttagcaaattaaaattagatcttctctttgaagcttttaaaatcatttctaataattccttttaaacaacaatttataatttaaggattataaacaacaattataattagatcattattgatcaaataattactgaactgttctttgtatgattaaaattaataattgagctccgaaaaatccgagaaaattccagagagtataattaaccatggagaatttaataaaaattaaatccatccatgctttatatttaggaaatcctatttcccacatttaacttcacttgtaaatcaaagaacatttaatataaaattctattaataatgtattaaataaccataaatcctaggacaaaatcaggatgtgacaaatgtacccccttacaagaatctggc

SEQ ID NO: 61966 - DNA, 4093 bp, Oryza sativa
  unsure (1)..(4093): unsure at all n locations
cgacgaggacgacggtgctccggcggtcggcgggcgatacggaggagtggactagatgggcaaggacacggcgatgccgaagcaagcgatgccgaagcgggaggaggtccggggcgacggcggcggtgaaccggagctcggcggcgacggcggagagagaggacgacggcgcgggctcgaatccgacggagagagagtgcggcgagggtcggaaacggaggagggaggcacagggagcgtttaaatagcggtgggagtgagagagggcggccggaggagaaggaaaccggcgcggaagatccggccgccattgatggcgccggcgaggtttgcgggaggaaatctgaacgattccgagggagagagagagggaaaaacggggggaaagggagagggaatcacggggagtgatttccccctctttatggcgcgcggggacggcaggatgcggcggaatccgcggcggcggcggcgctagggcacgggcgagcggcgggcgcggcgcgaggtcggggatgacgggtgggccccacccgtcaacgagggtggcgggcgggcccgcccgtcagcggcgcgcgcgcggggaggagccgatgggccgcgggggagaggagagagagggagggagttgggccgagccggcccaagaagggaagggggggaaagaagacttttagggtttttctttttacaaaacctttttaactttgtttatttcttcttaattattatttgcgctttgaaaattccactaaaatttgagggctccttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacatttttccccacggcatgcaaccaatccaacgcatccacagggttattggagctagagaaggttggtggacggatgcggaggaactcggcgagtttagagtgttgtgggggtggtggtggagcattatgatgtggcggattttggatgtggtggaggaaaacagccatcatgttggcctgctgggcgaggatttgggtgagaatggcgttggtgtctggtggtggtggtggaggaggtggaggaggtgaaggtggnctnccatggttgttgtggttgctgccttcaggttggttgccatcactggtggcagcatttctcctggtcgtcaccatctgaaaaccccacacagaaccagcaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgccccacaagaccccaacaagaagacaaacgagaaagaacacacgcgcaagcctactaactgctcgtctaccgctgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctcttgcgggcggtgatcttctggctgcggcagacacggcagcgcttggggcgacagacctctccctgggcgatcttgagctgatgcagctgcgcctccactacgtctaggtccttcttcagctgcagattctcctgacgcagctccaagatcttcatgttgttctcgaccatcccagggcgcaccatctgatggaagtcgatacgagccgcgtcgtacgcctacaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgctgatggcgaggagagcggcgctctggcaagcggcggagaaagaatctccacctgcggtgactgccaacgaagtcctctcgggtgagccagtgaggatcactgcagtaacctcccaagcagcgtggggctctgcatcgtcaccctcctgctccgggagcggcctgccctggtagtccactccatgcggataccccaggacaacgcacatgccccgcagctccaagacgaaaccagtcaggtccagaccacgacggctgacgctgccggccatctacaaacaaaaacaaaaagaaaagccacatttaaaagtcagattttggcgataaatgaagcagcaggacagagagagactagagagttttcacaaatagcaaaggatttttatttttgataatattgctaaggcttgggatctacggctcgtcctagggtcaagggggctatgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcgcttgacggcaggcacgatctagacaccaaagccttcatcatccaggggctcctcttctgggttgggaaaaattgagcaagactgagtacaaccaccgtactcaaaaaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacatgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacgcccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattctacaatactccaacaattccaaagtgtccaggtgatatgaatatcccaaagtctagagttgtaaaaccgcctaatgttacctaattaaaaagcgaagcatctacctaacatcatactagtggtaccatgagtagagtgtccactagttggggttttgtttaatctagggtgaataaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaag

SEQ ID NO: 61967 - DNA, 560 bp, Oryza sativa
tggatcccccgtgattcttttgttctgtaatgcaggttgggccttgcagcatatggtgatctgatctccagtgcacatcaagcaatcaacttttaacgctgtggtttattccatgctgccagttcaccaagctctgcatcaacttgcaaggatatcataaaaaaaataaaaaataaaaacaggtgccacttaaaggcaccattttactgttactagtatgagcaaccgctctagagcttagaggtgttgtaagtccgaaaaccgtgtctgaaatgtgggtattttgatgtgtataatctttgtccttttgcatgatcagatttaaatatcctgtgtttatttctacctcttctgcttagatgccatttctttttaatgcttgaatgttccatgcattgctgatgaaagaggagctaatttgtgtcatggattttgtccttgatattcacatatatcaaaccaaaatgctacataagcaacctagatctaagggatcgcctgaatatgatggtgtgatttagaggtttaagtgtggcctgcagtctcagattttggtatct

SEQ ID NO: 61968 - DNA, 48466 bp, Oryza sativa
atctagtggaggaaaacacaaatttcctctcactttatttcagccacaatgtgagatcaactaggaataagatccctcgatacgatgatggttcctctacatttgagagttcttgtaaccttcaaattttccagtaccctggtcggtgttttaatcgtcgcacatgtcgtgatctaacagtggaggagtacaaggctgctttcttgtatattcttactaatatttctgagatggacactttgtttgagtaagtattcatattaaaaaattgttttaacttaataaattcctattattttccctaatccatccctacatatagacaatttgataaggaacaatggaagagcagaattgcacctagtgataagcaacgtcatgacttaagattaaatggttggaaatattaccgtggaactaaacatgggccaaatttctttgactggttcaagaaacaagtaattctgcctactttttaacttcctctccttccctttatttgaaatattctaaactagtaactttcatttatgcagtgcatggcaaattctagtattgatagcaccttgcggcaaatttcttatggttttcctagaagaataaccacttatggatgctatgatgtgaatggatatagatttcgttcagagaagtatgagagtgcaaaatcaggattaagtactgtcaatactggtgtttgtgtgtcttgcgttgacgatgataacaatgttattgactactttggtgtcatcgaggacatcatcaaaattacttgggagggcagcacgaacctagagttggttttatttgattgccgctggtttgatccaacaaattctggtgttaggcgaactgaaaatttgggattggttgaagttaaccacacatctaggctttcaaactttgaaccatttgtgctggcaagtcaagttactcaagtttattacttgccttacccatgtgattccagaccagatttaaaagattggtgggttgtacataatgttacccctcatggttggcttcctcctagtaccacgaatgagtctgctcctcctaatgatcagccacaaattgacacattctatcaagaagaaggattggaaggtcattttgttattgatttaggggatgacattgaaatagcaaccacttacatatctgatgagataactaatgagaaagatttggactatcttgccaaatgtaactctccaacacaaggagatgaagagctggatgatgaggaagatgatgaagaagatgaagaagaagctgaacctgaagccatcatttatgatcctgaagatttctgattgtgttttatgtcttgtattttttttccttgcttatgttgtgaacttgtggtcagtgtgttcttatatgttgtggacaagacttgactaagataagctggatgttggtatctttgtgttactgaaatatgctatatctgatgtaatattgtcttaatagcatttagtttatgtatttaattatactagtaagttatttaattagctgtatgtgcatgtgcagatcatgaacaaccttcgccatcggtctcttgcttcaaagaagcgcccagctagccaactttccaatacaagtagtgctaatggtgctagctcaaggagtgtgccttctacaaatggcactcaagtgaaccctgctaactctaatgctgaaggtcagagtcaaggaagtcatcgtgcaagtactgagcaagctgaacagcaagctacacaaagaggacgaaaggagaggtcaaggaccagcctggctgtaccttgaccgggttggaaggtgggccttatacctaggggtgaaatgtaagtatacattcataaattttttaagcgatgcaagaaaaattcagaactgctatactaatttagtcatttgctactagttcatttgaaccaattatgtgaattgagactaagtgtgctaaccttgtatacaggcaaattcaagtatgtgaattggcatgctgcagagtacaagtatacctcacagcttggggttattctgaaacgcgaatactcaggcactgtgaaggaccttgacaatgatggtagaattattcgtagccgccctgcactccattgggcagattattgtttgaaagaaaatgaagaatatggagagacatgtgcagagcgagtggtgaatgaattttgggtaaccgtaattctttcctatcctagatttcaaagaagtgtttggttttgtttttttaaatctatttgtatacctgtaacacatcatgcagcgattgttttctacaagagaagaattaaaggcagaggctaaccgtgtcttacaacaatatgcaaacaagcgcgtcaatgatatgatgtatcaacttcgtgttgatgctgtcaagctctacttctttaaagtgcgtggggaaaagattaaagacgaagtagcccgtacaattgaactctcagacgaggaatacctgctggctcgtgtggaatgggttagtgaatcagattggccttctctctgccaccactgggacactgagcaataccttgagaagcggaaaaaagcccaagattcaaggctacaatctgaagacgattctcggaatagaggaggatcaaggccatttactgagacacaacagtggctggtagaaaatctgatcaagtaacatcatttcttgtgtattatttcctatttgagctttggttgtgtaacacattattggctgcatttgtaggcacatgactttggacctgagaaggctactggactaaacacatttggtgttatgaaatcaggtgcaaaaaacgtggacagtactggaactcatggacggatcgacaaccaaaaggcagaaaaaatcatggtataaacacagtgatctttcctaactatgtctatattttctttctctagctactttatctccatcattgctgcacaaacttagaaaaggctattgttcttgtaggctgactatactgcagtgactagctcaggaactcaaggagattcagatggccatgaattagatccaaaggcactttattccatttgcaatggactgccacatggacgccttcccataggcaatggtgctatgtccaagtctactgttatagcggccggtaaagagacagcacctaggccatctaccccatcagccaatcaaactttgcgaaacgaaaatttaaaactcacacgcgaaaatgcagaacttcgccgccgaatggattccaatgaacggctgatcagggtaacccttctaatataactgtacaataatatgtgattctgcattctagccttgtctaatccctgtcccattttagtttctttatgaaaagacaggagtggaaccaccatctgaggaagatgtagtgccacctgctaatgaagatctaatgtctcctgcgcatgtccaggtaagttgtgtaatgaaagaaataacactcatttgtctcagtatattaaaaaaatccaacctaagcaaccatggtacccttttttttcttttattttgttaagagaactaatcgtttttggtagcagaatgtcaacaacacatgcagcagttcacaagcctcatgttgagaactgtaacacctgggcataacctcattcttagttctaaattatggtaaggtagccaggaatgtcacccctattagaggtttggaaatatagatgtctgaagcttgtgacatagagagcttgattctagtaactttttgctattctagctggattcgattttgttttacatgaagtttggatatatggtgtctgcgatgggatattaaggatttaagtgtaattgttttattgctgccacaaccgttagtgttgtagtatactgatttctgctagcattggaaataatggtttgccacaactgtttctggtcatgtcatccaaagtcaggcatgcgatttctggcattatttcatttcaatgtttgctattacttcagtggaaagtctagctagccatagatgttttttttctttataaggtatatgcatgttcattggatagatacttctttcatcagaactttggcatcactgcagtgcatacttccaatcgcatgacttaatgttcggacctatttattgcagcgaactggttcttctcatgcgggctcacagcaggaagctgaaaatgatggaaccactgacaccaacatgggcagtgaggagaacgtggtctgtgaggtgaacatcggctgcgaggcgaacaatggatgcaacagaaatcaagtttgcagcagtggacgggctatcgcagcctagcttcttgcatttgcacaatgcatcggtgacgtggacatggcttttgtttcgcacatcagtacttagcccatatattattttggtagcaacttagtagatagagacttcggtaatacttcatggcctgtttggtggtgactaaactagatgagacttaacatagtttatgctcttttggtagcaacaaagtcagattacacatgctcttctgaacacttaagtagtggctcacaagtgtattggttgtaagtaatggctaagtagttgtgcaatgtcagttagcatgtcaaggtgatatggggacacctattggttgtaaacctgattactcctatagaatcagtactagaacttgatgtactgcatgtatggtgatgcaagtatatgaaatggtggctatttgaatcaattggtggctgagatgatggctatttgagtcagctgtgatttggcattatttgaatgattttgtgatttctgggcatgttatttgtgaagctgttgtgatttcattgtttggatgcattctattatgtaagtgaaatgaaatcagatctttttagcagcttttattagctgtttttttttcaatatgctccaattattctgacggttttattataaccaaccgacagaaataatataattctagccaaaaaaaaacaactgcgacggtattttcctgtcggttcactcacaaagaaaaatattgtgacggtattttcctgtcggttccgcgtcagaatttacaggtgaaaaacctgacgccaatacattttcctgtgttccacccccagggaaatacccacagaaattattttcctgtaggtaacccgacaggaaaattgaatttctccgtggtgatttttctgtcggcaatttctgacggtgaaccgacaggaatataatttctgacggttaaagctatttttctgacggttttgcttctacaggctaggcctggagtctggtagtgaaagaccaaaacaaaagttgtagatattgatgatttatataactttgttgttgatgactttttcagttgaaatcatttagtatttgaaaatgttatttgaacatgtcataatttgaaattcaaattcaaattattgaaacagagtcatatagcaaaatgaccaaaacaaaagttgtaggtattgatgatttatacaattttgttgttgataactttttcagttaaaatcgtttagtatttgaaaatgttgtttgaagttgtcataatttgaaattcaaattttatataggtcagttaaactcacatggagaaaaaaccaaaataaaattgtttgatctcaataagaaaattgaattgaaatttgatgttcgaatcaaataataattgaaaagtagtaattagaggtcacctgtcattgtggtttgagaggctggccatacgtctaccttggcttaacggataaccatatccgatcatcacgatgcgacgtggtttctacgcgccggccgtgcaagcagactggcatagcgaaattggacaaaggatgtatgggtcctcaatgagatcgatcttgcccaaatagtaggacagtgtctgtaccggctgctagcttctcgctggccgccgccgacgcgtgcaatggccgtgccctcctgtatacatgcatgtacatcaaaaccaatagataatctagattagattgtggccaatatcaatttaattaggctttacagagcctatgagtctacggttaaaatattataattaatcaaatcaacggttaaatttttataattaatgtgagagcttctacagtatccgatttattgtagatagatagatatgtaagtagttacaagagcctcagtagtacctgaggtccagggttcgacttcccatgaaagcgaattttcaggatttaatggcgctgtgctttcagtggtagacgacgtacccgtcgacagtgaggcgcctatggtgacttcgtcgatctctccaagatttgccggtccagttttcgaagatgctcatatgggtagggtttgcgtgcgtgtgtttataggggtgagtgcgtgtgtgttgtgggtgtgtgggttgtactgtgtaatttagaaaaaaaagaaatgtaggtagataaaaaaagggtgaaaatatatgtttttttccttgaatttgcaagaaaatactggattgaaacgtttggcaaaagtataccgtcgtcgtattcctggttagcgaaaccgtcaaacggggcgcggtctcgcgcatcacccaccgacaccgctgcaagcgccacgaaaacggcatggacgcttttatcaaactaaaggagcagtctcgcttgactaatcaggcattagttaattaattaatgatcttggctcattagttatttaattgattaatctgaattaattaactactaatgatactacaccaattaacttagcattaattagatgtttgagtggtctcgcttgactgacctgcaacatgaccctttaatcagattataattagttaattatcttattaattcgttaattaatatgaattagttaattactatgatatcaattatgctaaaggggtggatgaaaatgttgatattcgtggcatgtttttcaaactgctgaataatgtgttttgtgtgaaaacttctaatgtgaaagttgctctaaaatatcagattaatctatttttcaagtttgtaataattataactcaattaaccaccgtattttacgtaaaacactcaatcttaatcttcatctttatttacgggagaaaaaaaaaacatttgaagcccacctgagttcatcgccctggtctcacatggaggagtgcaggcgaacagtgtggcggagtggggcatcgatattgcataacggttccgcgcgaccacgcctgtctcttgcgtgccaacactatgacatcttggggccgtgacaacgtcgtccatttcgcgccaacgcacgacaccacccatctcgcgtcgcatcacacaagactgtggtgtgacgtcattttcgtataatgatttagcgataacgatggtatatttgtgctaaaagaattacatcccagaaatttatgagaaaaatataaataaacagtatatttttaaatttaattctagatagatattggtaagcaggagcggagttataacgaaaaggaggaacactactacttcctccgtacttcctccgtttcaggttataagactttctagcattactcacatttatatagatattaatgaatatatatatatatatatatatatatatatatatatatatatatatatatatagattcattaatatatatatatatatatatatatgaatgtggacaatgctagagtaaatgttaatgccaaaataataaggaagtatttcttgacaccgcataaacgctttacacgagcatttttgacccggctctagccaaggacccgcatacatcatgtatttccgtaaatgcatttaagcaccgcctaaaaaatatatttacgcagcagatatcttcagattccacctacaaaaaagttttttcacaggcttctattgaaggcatccacccgtgtaaacattaattttaacatgcggatctagcctatgaaccagctgcgttgttctattattgaaaaaaaaaaccagcagctagctatgcaataatgcatgcccttacaaaacattagcatttttcttatcaacataaatacacatcaatcacattacaaattcaaagccatatcacatagatagagaggtagtattgctaactaagttgatcatacacattgaaccgcatcaacagaatacaaattgacatacatagtttttagtcatacaaattcagagtccaacactggcttgctaatgtaattactatttaagatgtcaactccaaacatgcgctcagcaataactaatgcatatatgtaaggccatgtttggatcattagtcccgggactaaggcggtgtttggatcctttagtcctcggactaaaatactaaacactttagttcatgcctgtttggatacagagactaaaagggacttaaggtactttagttcatgcctgtttggatatagagactaaaaaggacttaaagtcattaattgcactgtacaatgactatgttacctctaaaaccattgaaaaagagacgcaccatgcccatgtgtgggggtagcgggtggaaaggaactactttagtcccaataagctcctcccatatatagggactaatggactagtgcactttaagtcctttttagtccctcctgtttgggactttagggactaaaagggactaaagtgaagggactaaagttttagtccctccaatcagatagggcttaaaattagtccctggactaaaaactttagtcccttactgtttggatccaatgactaaaagagactaaaggcacgtggaccaagggatagagaagagagaggctgccactttagtccttttagtcatccctatttggatttttagggactaaaatggagggactaatgctttagtcccatgaaccaaacagggcataagcactttgcgtgcattaagtcttcgtagaccgtgaagtggtttaactctgaataaaatatatattaatgaacaattcaattggatggttagcacattaggagattcgccctacatactagacaattatatataatttatttttagataatgagacaattatatagaatgtaattggaaattagaatattaatgaacacttcaattggatgggtgttgaaaagactgggagacgtaaatgacacatcattattatcttccagcccttatgtgctagacgcaatggtgtaattcgattatctttaataactttcaaattttcatgttagaaaaaaatatttttctacgatctgtgcgagctttaatccaattaattaatgttgtacataattaagatatattttacgcaaagtacaataatatgatattgtgtatcatattacaataatgtgtatatcaataagagaataaccactttacatatcatcgataaggctcacacgtctaagggtatttccatgcatttaaagagccacctgttcaagtagcaacatgtttgttttagaaccttttctgttcggaacttcagagaccaaatatctgtgtaagaaggatatgatcacatcaacataaatggtagcaaaattcgtttaaaacctaatcaatgtgggtgatgtacttgatgcttacttagaaaacctaaactgaccctggaaactgatgatatatacatgacactgaatattttcactaacatacagtacaatatggtttcagacataaaaacaaaaggagtaatatctcaattcatttcccaaattggatacgtcatgcatgcaatcaaatttggaaattcatttatcagttcatcatctcccaaattgcattatccactctttcagagtacataaataaacaacaaaataagctccaattattacatattttacctctacctccaacagcataaatatcatttcatacgacaatcgtcggacgagcaaatatatatgcatagcttccattcatctaaaaaaagaatattacaccacaattttcattcacacacagtagagtagagagttaagagaaataaaatagcactaccaggcatgaaggaacatgttctgcagtgcaatcggtcccatgacatacatggccttctcttgtagttttgacaaagagaggaaaacctgatagaagctcaattgaaaccatttggaataatagaggtgataaactgataacatataaatggaacatccggcgtcagcctccacatccgctgcgcctcgcgtccgctggcagaaatattttcgatatcttcagatatccttcagaacttggaccacttgcagaaatatatacatgcatgaatgattcaaatatatgttctagctaaatgaaagatccaaatattggttctctagtgcttatacaatatttggatgaagagttggatgaagattaagattttcgtggcacgcattttaaactgctaaaccgcacgtttcgtgcgaaaactttagatatgaaagttgctctaaaatatcatattaatctatttttcaagtttgaaataattaaaactcaatcaatcatacgttaataccacctcgttttgcgttaaagacttaatcttcatcttcatcttcatctttaggagaaaagaacaccaatcacaaatgaacaagtcagtgatgcataaaccaagaagtggttcctaaaatctagcttcatatcacataccaataagagtgatgcataaaccaagaagtggttcctaaaatctagcatcatatcacataccaataagcggtttagggtgagaacagcgagggaaaaagttatggatttttatagatgaccgagtgagaaggtaccgaaaccccacctaagagcagatgtcggtgacggtgaagatggcggccgcggcaacgccgttcgtcagcacgggccacgcctcgatcggtcgatcaatattagccactgcatgtttgtaatttctcacttttagactttaaaaccaaagttcagactttcagagttaccttttgtcaatgaatccaaagttcagactttcagaatcttagccatggtaacttataacttaaactgtcttatcatgtgctttatatctatctatttatattaaaattccattaaactttctacaaacgctctcaagccgccatatggcgctcctacaattgctcctaggccgccacgtggcacaatctaatatctcaccgtcaattttcatttaaattggtggtcccgttattttataccgttagattagacctatgccgttgattttcatttaaattggtgtacccattattttgtaacaataaatcagatctatatataatatacctttcttccatatgtacagtttgccggaaggaagaaaacatagttacgtacgtacgataaagataaaaacttcctcatggttaacatacagcgctactactgtacgtatgagttcatacgtacgatacaaatactaatacttccatacgtacaaacgtgcataatcttttctaattttgctggaaaaaaaaacatacacatgaacataaaaagatagaagaaacatacatctataaaaatcaacgaacggtctttaaatatgattttcgataaaatatattacttcacaaatataaatatatttagttaaataaagatctataataaatatccaatcaatgttctttaaacatcttctaaatctatctattatatatgaaaagtatattaaactttttacaaatacttttacaccgctacgtgactctcaaataaattagagaaatcatagaaatatattatatactaaaagtctattaaacttcctgcacacgcttctatattttcacgtggcgctctaatttagagtaatcctggaaatttagagtgaaaaaagaaaagcatccaaccttcaatgttcacttaaattagtggacccattattttaaacaatggattagagctcttaaaattcccattgctaatctctatcaaaaaaacataatgtgcttatgtcgtactatcgtctccctaccggaaaaaaaaaacaaaatttaaatacctacgccatatacgataaaaaaaaagatcaagccaaaaaataaaaagaaaacatgcacacgtacgtacatagtagaatcgaaaagaaatactaataaggaaaaatcatcaatgctggcacagatttattatcaacaacctttaatttacgattttaagatctttctctccaatctaaaattatagtcccgccggtgtagatagaaattcctttatggtctaattccgagcggtagtaaataccatgacttagtaatatttgattgatcacaatttggtatattgcatttattataaaggttgctaaggaattcattataggaatgcttccaatggaaatggtttgctcttgcacatcgaaaccaaaaattaatcgcgtggatacgtataattcagaagaatagatgagtgattcatacacaacattcctttcttttatcgaaggttctagcaattgatatcaggattttttatttaaatctaagagacattcttatcacataagtagtatattaaaatctatcatctattttacagtaaatatatttcttttttcattgtaggataatctaaattcccttacagtatatacatagtgatgtatgattcctttgagcatttttttaataacaaataagatgcccgtgcatctatgtgaaattcctttccgatttatattccaaaaatattctccaatttatattctgtcgttatagtgtttgaaaaacaaactacaatacatgcccccgcgaatgcgcgggctaccttcctagtttaccaaatactgtgaacattcaattgcaaaacctctgaaaaaagtaggaacaagcagtcaacaaaattcagcaatagatcttgagtatagttagagaaggttgagatgtatactaacaaaataaattgctttgctagcatgttcaggtccatagccagtgaagcctataagattgtaatacatgttaattatctgagaagcatattgcttaacgaatataacttgaaatatcattacatcagtgcagttattaacagtgaaagcttcttaaaataaacggaaaagcagtggtcaatcgacattatttcttacccaaaatccatatcctgctaaaaaaattcagtagacgattagctctatcaattggcacgctcataaacaaataatggtcatatcttccaatggaactagaaccagaaccaaaatcaaacaggaacagagtggaccaaaaatcaattggtgttgacagtgaatcagagagcgtggggcggggtggagctaaaatgatgtacaggaacaggttgaagtgcaactcaatgtactataatatttgtcattgtttttttttattttggaaaataaaaagtgtgcatagatgccctcacttatctttagaaacaaaaagggtggacagtcgcccttaaaaatgaaaacgtaaaatgatcaaatacatgaattatgcatctcgttctattgttttggttgattctttaggatgggaataaagagaacgggggaagagagggagggggttaaggatgatgatatatgtaccttccggttaatcaggtcaaagcgggagatgttgttgaagaggccgagaccagtggacacgcagaggcggttgacgaggtggagactgggggcggccggcgtggtgggatgcgtggagatcgcggggaggatggtgtcaactgtacatcattgagcacatagccaaacaaggttatgaggtttcttctgccagtaactagcaaactgctgcccacaacagcaatggtacacaccagaataaatcaacaacctgcttccatgcataatatttattttgagaagcataaaatcaagggccagtgttgcctacaatatagttcaacataaccatccacttaaatgagaaacatcccaaatttttcatcctaggaaaaaaactgcaaaaaagaaaacaaccccattcccttatctcaccaatccagatgtattagttcaccccattccataacctgatcttcgtggaaacattgtatatactgaactgtatgtactgaacaaacgacacaacaattggaattgtggaaacagtataaatcaagatagtttcgtacagaaagattgttcgtttcccaccagttatccccaaaaaaccaagactggctattgtataatggaaaccacaaccctccagatctcagtcacagtgttagcgttaggcataaacttaccggtgggcgcgcggaggagaccgagatcaggggcgcagagaaaaccgacgaggcgggcgcgacggcgggacgatgttctggtgacgaagttcgaggtggagatcggaggcggcgtggagaagggcgacgacgagagatcatggacatgccaacggcagggttgtgggagcgcgggtcgaggcgtgcaacggcgaactggctgcgtgtagctgggagtgggtcagggtggcaggcagaagggagaaccggcggcgttgcaacagtggttagggtttagagagcgacggagggggcagtgggtgatgcgggactgtggggggtgatacggaggaggagggatggggtgtgtgtgcacagtatctaggccgttggattatacaattgatgaatatgagccgttggatctgtatgatgtaagagtataagagtgtaaggatgagagatgagtaaaatgagttggtgaattatagggttgatgaaataactaaagttaggcaagagtacgttagtttgtgcctcgagcaagttggtttctttcctaacaacatctgccaaggatacatattccgacggacatactccacctatcgcttacacaacaattatggccactgctacagaaaggcctttggtgccggttgcaaccccatgtagttgtcggatttggtaaccggcacctcgcaagtggctcagttgtgaaaccaaataggtgctgacggtatagaaccggcatctataaggataaacgaaccaaaaaaatgccggctcgactcaaataaagccgacccaagcacgaatcaagccgagcacatcaagaacaacatcaggaacttcaagaacatgtcaagaacatcatgaacacagcacagaacacagaacacatctaagaacacactaacaacacaaaacactttgtgtcgcaagccgtcacatcgccctctgacacaggatcactgatatatgctttcttgcatatatgtcttaaccatcctggagggtcagtacactactagatacataatataaaacaattcctaatttgtcaacgtttcaaaatttgtcacttactattttgcatattatgcttgattcgtaaaactatttgtaattagttttgctgcaaaaacaatcccaatacgcatatcatatttttttttgctgcaatttggtctttaccaaagttatactttgtctaggagtatagtcttcacaattttttattgatattcatcaaataaaaagaatattttttaaagaacacagcaggggaagcccccactgtttaagagattttattaattaaataagaaaagaatacagaaaaagtgaaattacaacaacatgatccaactcttgactacatcttgatcactttcctttaacctaaacaacaagagcagaaagactccgttaagaagttgcttccaagagaagaaagaaggttgcttattatcaaaattaggaccatttctttgcgtccaaatattctaggctcctaaaaggaaatttctccataaaacatctgccttgataagaaactttagactgcctcatcatattatccataggagctatcctagatagtgccaaaagcattctagcagttcaccaaaaaaggacattgaaaaaatagatgcaaaagagtttcaatgcattgttaatgacataggattgtttatgatccgacataaactttgtattcaatctatccatgagtaaaagccaaccaaaaactttaaccttcaattggactttgtttttccataaccaaacaaagcgctgcggtggttgcaagcttcaaacctccccaactgaaagtccaactatgatgttcctgcgaaagatgaagatcactaaccatatctgacaaattcacttagtcattatatgcttgttgagataaaggcagatcaaaattatcttccagctgtgctgtcatagagttatggacataaatgtttctatggacaaaaagaaattccatgaaacatggaaaataaatctaatacaaacacttagacaatattgaatcggctagcttagcctgcaatggctctacatcagtgtcggcatttcttacgatcacagataaatccacaatcacacggtagtattcctaagggtatcatatttacattctgtaggtaaggcgatggtataaagatatgatttttcttttatatctcttaatcaatctataattaattcaccaaagcctaaacatgggctaggataataattgataaggtagtggacacacacaggagattcacctctataagaatatctagtagggaattagtatgaggaaactacgattcatatgtacttctatactaatcatgttcagtatacacttaacatatacatgcttacaatataggactcagtgccaggcacccaagtactaccgagagaccactccctgctggtctgtgttgacggtcgttagcgatcagtttcgaccgtcaatattactaaaatagaggagaactagttatgcttgcaatgcatatccatgttagaataataatattccactagtatttggttcaccaaccttttgcagagaataaccataaagtggaggagaatcgacatcgaatcagacgataaatcaatcggacgatgtcgagaactagacttatgtatgaatgggccaagaacttagaattgacataatggattgggccaaaattcacaagtctgcgaaagagagcaacagaggaggccacctgtcgattttgggccagagcggcccgacccatggttcgggcgaaccccctacaacgccattcgatctaggtttttcctggatggctgagatggctccccaatgacgggtggtgagtattaccgaccttttcaactgtcataaccgtcattctcaagctataaaaggagatctcatcctcacttcacctcacacacctcaagcaagagctctctcatattctttcaagttagtttagtgttctccagctagtggaataggaatagagtagaaatcggagtccggaagccttcggaagagttcgggtatggctctagtagctcttctcttctcttttgtaagctttgaacttttattagaatactcttctttatacatttatgatattgaaatactttccgagaatatgaatgccaactttacattatgttcatgttatactgattatactgcttagcctatctagaagatgctttggtacgggtatagtgtttgattatgcaattactctatgtcatgacgatgatattagagtagtatctggtagtttaggcgtggtgtctagattacatgatatcattatttggggttatatgctgcgaatgagaggtgggccgctgatggtgacagctcagtacgggtattcctctgcgcgtgtgttgacgtaaaaacacgaggcctgggagatctgcttaactccagtgcaggtccaaaactcgccttcggatatgctagcgtgccagttgatttgatcctgcaatcaagaagaaacgaagacaaagaaaccgtggttaaatccataaacaatagccaatcggctgggtgctgatgacatatcatttatctttgagccgatgtcatatatgcatcgatcggcaatcataaataagtaagaaagaactaagtctactcgatcggctgtagatattaacaatatataatcctcatgtcgatatatacttaaaccaagtgattgggatagatcggtcgccatgccgagacagtataaatcacttagatcgaaatatatattaacaacaagactatatacgttcatagcatagccgatcagatagatctagcatgtatcggctaatactccgataccactctatattaagatattaaagcaagtagaatatactaaacaaaagcacaatatacttaaatgcgacaagatcttaatataatgggcagatttaacatgtcaatcaagcatatggaataactatagttaaatcaggtaagatcggctgaaaccccgatgctaccctaatcgacaaccagaaggtaggctaaaggttgaaattctaagcacgacttaatagatcaaactcaactgatgcagcattaagtatgaaaagaagaacaatatctagacaatcaagccgctggatgtgtcatagagtggtagatatcctatataatctaagccaacatcgttattttacctaatcggctgccctctattagcagatgttagccgattatagattagatgacgatattgtcgaagattatgtaagatatgtgataactcgacgaattacataaacaagattagagtatcataaagatggaagcactaatctcgagaacgcaagccgccataacaagttttacctcttgttgaagatcgaaaccgatacagctcaacccgaaagcaataactcgtcaaaacaaaacgaaaataaaaagggtggcgatgcgccgagattgtattgaacgtgtgtttatttgattacatggggcttgggatctatttatacccgagaattacaaaacatgtccatatcggacacgactcttatctctaacaaactctaagataccataagtctttgcggcagacttttgctcaaacatatctctaaggaaattacataagatatcgtaattaatagatacaattgccttctcaggactctatccatgcatggaaatcatcttgaagcatatcaactcgacccgctgacgtataccgagtcgtattgtcggaattggccatatcggcttacctagtctgactcgaactcagtcgatcctgatcgtagccgatttggactcagtcgattcttactctgtttctgaaacgatcttcgtctttgattccactttgatctaatcttcatcttcgatactgatattaccaaatttggttgttaacagcgtgtatattatcctaagttaatttcctggggagggtactcctccgtatttagccccggttgtatggtcatgacgggctgtcgtaatgaactcgatagtcaggggtggcttctcaaagtaccaggagggcattagatagagggtattagctagtatatcagataactaggatgtatgtatgctatgtatactagaagtataggaatagattctctttctattttctttccacttagcttagtgttgacgaaaaaattgaacacactggcctaggaaatctgcttaactcctgtgcaggtccaaaggttggtgagatgcgggcgtgccagtcagtttgatcctgcaactgacaagatatgtaagcagcaggtaaaacagccgaccggctgacaagccgatggagtagttccagccaatgccgataccagccgatagccgatgccagccgatagcgatagggttctgagctatcggctttatgtccaatgtagatgatgatataaaggcaatcggctgatgataatcgatataattaaacaatataatccagtagaaaccagtcagctaataatgatatgatagaataagcactgatctgaaggttaaagcatacatcggctgtaggtctgatgtcataaaatccacaagattagattaaacgatgaaacctttgttgcgatcggctaaatccaatatgtatacaatccttttaagccgaagcaacgtccagataactcatcggctgaaaccccgatgaaacccttattagcaatcaagaagcatgctagatattatggttctaagcatgacttagtagatcaaacttaactgatgcagtactaagtatgaaaagaaacataatatctagacaatcaagccgttgactgagttttcggggtggtagatgtctaagctaatctaatctagcaacacgatttagctgataccggcataaaccctaaaacgagaagcagccgatagagctaaattgatatgctaagactagattaacagagacatatgataaataggtaggcaaatatatcatccaaactagagcaatccaacaggtcgaatgtaccgatgcagccttaaacgacaccaacgtagacgatacaattgcctggaccggcggaacattggacttaccccttcgccggagatcgaacaccgatgcagccctgcatcaggtgccaagtcccgccggatgataatataaaatagaaaaggtaaaaggtggcgatacgccgaattgtattgatcgtagccatagattacaatgaccccgggtgtacatatttatacccatgggtagatactagtccttgtaggacaagaaagaaactttcctaaagataaaaggaaaacacaaagtccttatcggacactaaacacactataaaagaaaactaacaaactattcttaattaatagatacacttgccatgccgcattctctttgaactcggtctcttctggataagcttcctttagtatatcaatttccttaaccgaatatagcaagaatccaacaactgacgacttgataactctcatcggctaatctcaggacttcgaagctggtgctgactctaagctgatgaatactccgggcttaccaaatttcactgttaacacttagatattttagtatgagaatgagtagcttcatgcttgtgtgtcactctacccttggattatcttaacccctgcttagactatggttattgcaagtaacatataaattattagtcaggttctctctactatgatctttccacgggattaaataaatacgataaccttggaatactctcgggtgaaatgctacaatggtatatccgtgcgcttgcgaatgaactctgtaaccataatataccaggagtatttctgcgccattgctgggaattatatttctagtaatgtcgttaagaaataccaaaagtctgccagcgtggttatagcatttaggtactcttacgccatacccgaacatggaggaatacaaaggacggacatggctatcatcacctgccacctacctcactttccgtgggcacacccacatccaacggtatttatctagcctaagcaccatgcctatgctactaaggccctgtttctttcagcttgggattattataatccagattattgggagtaagctgaaagaaatagacaacttattaaagtagcttattataatctggagctcagcttattataatctgataagctcattaaggtgagctttttctagattattgggtgaaaaattacccaccatgccaccccactccctctttagacttacaaacccaataatctaagctctaataatctaggaaagaaacaactaaccgcttattctactataatttataacaatcaagcttatagtaatctgactcaataatctagattataataatcccaagctgaaagaaacagggccgaaataatatcactaactcccctaggtctctcaccctatgaatgaacaagttagagctagatcaacctataaaggtcattggactattaccgtagcatgagactagcctaggatgatgcaaatatacgaagtatctactactcagaacatatattcaataaagaaatatataaaccatgagcataaataaataaagaagataattctattaattcaactatagtctttcccgaaccaccgccgcttccactacaggaaaggggagggagttggaagagaaggagaggggaaagggaggaatggtggtggcactgtggcggccctcctcgctgccgtccgcctcctatgctgccagccgccatagacgcggcaaccgacactcgtgtcccgcctccgcaatgccctccagccgccacccgtcctacccgttgtgcccgccgcacccccagcggcagagaaaagaaaagagagagaggggtgaggtaggagatatgacaagtggtcccatagttttttattatttctttttctaattagattgccacgttggtgtcacgtgtatgccacgtaagatcaaaacagctacggattgagccaagggggtaatttgtccggttttaattgtttagagtgtcaaatgtctggttttgtggtttaaggggggtaatttatactgtcgagatagttcatgggggtaattcgtattttttccaattataaacttaatcaaacttaagtttgacttgtaaaaaaacaaaatatcttgtaccccctccgtttctaaatatttgacgctgttgacttttttaaacatgtttgatcattcgtcttattaaaaaattaagtaattattatatttttttcctatcatttgattcattgttaaatatattttcatgtatacatatagttttacatatatcaaaaatttttaaataagacgaaaggtcaaacatgtgcttaaaaagtcaacggtgtcaaatatttagaaacggagggagtatatatgcaacggatatatgtacttgccaggtcgcggctactcatattcccaagttcccaactgggtcaaaacatatacgcgtgcgtcattggccgttaaggttcctacgtcacatcctgatctatcacatgtgtgtgcttaagtagagaaccccacgttgtagcgtgtgctataaattgatgggcgagttgtattcgaacgtgttctgcaacagctgctcagaagaatataagaaatcactacaaaatgccggaggagcgcaacaaggacgacgcaggaaaccccgagatgcatgtcaattttgtcctaaaatagtactcactctatctcaaaatataagcatttttagaccctgacacgatcttcgagatgctactttgaccaacaatattaatgaaactgagatgttttaaataaaaagtgttgcatattatgatagtttgtttaatgatatatttaggaatgtaaatatttacatgtttgatcttttttatttttttttaattaatgattaaagttaaaaatatttgacttatcactatattaaaaatgtttatattttaggacggatagagtattaataaggaaatgtacgtagtatctcagctcgaccgctcaaactaaaaccgattataattactacatatggggttattaatattgtccaattcaacaagcataccaagctagataatactgtcgatcaggaaaggccttgtttgatctgggaacaaattaattaatcagatctttcgagaaaagataattaattaggtacagttaacgacagtgatcggcaatggcggcacgaaggcgatcgtcatcgacgtcgaaccgggtgatgattcatcacccaccagcaatggtagccctgctgccccggaggcggaaggccaaaggtattcgtcgcaagaagaacgcggtgatggaggtggttccagctgcggcttccatgtcgtagatttaaccagcaatatggtggtgcccgacgacacgacgactgaagatcaacctcgccccgacgccggaacgatcaacggcgacgactgtccgtgccagatcagaagggtccatggccgtgtccgcgatatcgaccccggcgcgtacgaccccatggtggtgtccctcggcccctaccacgccgaccgcaaagacctccggccaatgcagaaggagaaatggcgctgcgtagagtacctctgcgacctcacaggcaccccgagctacgtcgattacttgccggtgatggatcgcgtctgtcccgacgcgaagacttactacttggatgaaaccggccatggccggagcagaggaggaaacggcgccggcggcctcgccctcgccgtcgagcatgccaacttcctccatatgctgctgcgagacgccgcgttcctgctcgtgtccatcggagcgctggacaagctgaagaaagccgacgagggcggcgccgaacagcggagccaggaccggtggaaggacgtcgccatcgcccacgacatgcttctgctcgagaaccaagtccccttcgtcgtcgtcgaggacctctaccgtgccgccatcgacaccgcaggccgccgtggctgcgacgttccctccctctcaaccgtcatggggaaattcatccggggcgtgatacaagaggcggaagaacaagatctaccactgcctcatcatctggatggcaagactccgcaccatcttctgcatctgtgccacacgctactcgagccgacccccaaagaacctgcgtccccggtcccggacaacgtcgccgcccgggtgaagcggcggtggcatcgcgcggcgcagtaccatgtcaacggcgttgggttgaagaagaggctcttcagcggcggggtagatcacagccaccacagcctgctcgacgtcaagttcaaaggcggcgcgctggagatccccgtcctccacgtctacgacaacacctgcagcctgctccgcaacctgatcgccatggagcaggcgagctccgactccggcgtcggccactacgtcacggcgtactgcatcttcctctcccggctcatgtgcaccgccgaggacgtcacgctgctcgccaagaagggcatcgtcgtgcaccacctgggcagcgacgaggtggtggccggcctcttcgccgacctgtgcaagaacgtcgtgttcaacgaggacgacgacgagtgcaactaccacagggcggcgtgcaaggcggcggacgagcggtaccagaaacgtgtctggaactggatgacgttgctcaagcacaagcacttcagtaacccgtggctggcgatggcgactgtcgccgccgttcttgtcaccatctgcacggtggtgcaaaccttcttcactgtattcccaaggaagtaagaactacgaacaagtactacgatgggattaagaattatattgtattcactctatcctttttattttcatatattcattctatctttaacaacatcgttgtttagaattttatgaagttagttcggacatcctcgattaggcctgatatctattatatctataaagtaataaaaaaaaggagtctccacgttcgctctcacacgttcgctctcacggcgtagaaattcttacattaataaaaaaaaagaaaaaagaaaaatagaactagattaggattaggatttgttaaaaactgaagaaaggaaaaaaatgcatactaagaaacttcaatcggacaacagtcaaaaactaaaaaaaggaaaaccgaatcatatcatatatactctggaaatggacaatgttttgggaatccgcatgttcacactcactacactggccaaggtcacctgtgacgggcccaaaccctcatctttgacggcttcgcgcatggtcagtgatcagtggtcactggtgagtccagtcacctttgacgggtagccggccgtcacaggtgacacccacctctgacgggcaagttactaaaaggccgttagaggtgttggtctccgcttgtctagggcgagttggcacccgtcacaggtgactcatctctgacggccctttaaataaaggccgtcagatgtgatggtctccgtagttagaagctgtcacaggcgatctacctgtgacggccccaaaagtaaaggcccgtcacaggtaggtcacctctgatgggcctttatttgctagtccgtcaaaggtgatgttacctttgacggatttttgttccgacccgttactgatgagttaattccagaaaaaaataaatgctaaatattggctagcctcaggatttgctagccatgccctctgaaacacagatacatcacagataaattccagtcaaccccccccccccaatataacatcacagatccatctcaaacatcacagatccccaacaacacagatccatatcaaaaattgacatcattcacatatgcagttcaaatggcacaattttgcacagcaaattcacaccccttgaaagccacaattttggtcgttgctcatataaccgcatatatacttaccaaatggattaaagccataatgtcctcgacctccacaacctgtcaataaggaaaaaaaaaggagaaaacagataaatagtacaacgtaaatcgtagttgatcaaatttgatgagaatttagtaaactaccataaatattgcacatatgaaagtaaattacattgcacttcataaaaacatatttttttacatcacaagaaattatgaaaacatcttttttacatcacaataaattatctagccaagttcatgagtctatctgacgtgaaaacgtcctttcttattcattatttctgccagaatgaagacacacacttcgcctctgatagcggggggttgatgggtgagatcttgaggccagctctacctttctgtttaataaataagatgttagcacgttttgaatagcaatgttggtattgaaatgagcttattcgccattagcaacaacctcagggtcgaaatctttcacctctcttagaaatgttgacatgttgtggcacacatggaaaccacattggtctccgatctgttgtgcgcatgcgaacttggtgtcatggtaaagttcgtccttgccctccttgtgcctaccacccttttccacatatgggccccaagccatatttaaggccttggtgatttcagtgaaatcataatctttggacttattggagttaaggtaggtaacgctactccacttaggtacgatgactaggagaatccaatgtcgcttgcgcagtggttatgtagcgttagtactaagaaccttaacttcaaaaataatatacacgaaggtaattgtcctcttactcttggttatgtgcgcacatgatgtactccttgtcttgatgggcccataaacaccggttgacatagtcaaccacctcagtgaagctctgtcgtaaattaacctcgttcaccatggatggatcaaggaacccaacctgattactaaggcgacgactctcgatccaatacaaccttaaaacatttacgtattagaactaatttaattaggagatatagtccaatcatatcacaagcatagaaggtatgcacttacaaggagtagcattttagaagaccagtgtccaacttccggatcctgaaaaggtcgaagaggtcatcaaagcctatagttatataggcaggcgatgataggaacggctggtggtcgtgatgtccaactatggatgactccctcattttccgcttagcattgcttagctccatgaattgcttatgtagctctcggcaagcaatacccatcacggctaatacattgtcctccaccaatggcatgcctagctcaaattgggctggcgccctcccgaccttccccgctttgctcaccggcatcgacatcgtagccttgcccctttttggctccggcaccaacttccccttgccgcgttcacgcttctggcctttgacaagtggtggggagctatcggcctttcttgtggtctttattggagccaagctttgagctatatctgccaagtccatatcagctccaccaagagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgaccaaagtcatgatttcatcattgggggcacgggcagcggatagcctgaccaggtgtcttttactgtatcgatggacaccttggcatacccagctagcaggtctgcgccatggaccttgtctgtaaccgagggcttgaaagccatgccctcagcgacttcgggagcgaaagttgggtggaccctcgccagtaggacacactgtgctacgccctgcatatgtgaaagtctgaatttaatattggaacgtgtaaaggtttttttattagatatggattggataacatcaattacctctatgtggtccactgcagctagtggtgcgaccgggagaccaggggccggcacctctgtggatgcacaactactcctatgctgtgacggactcgcgtcgtgttgtgcacaaggagttggatgcacagcaggtgttgtgtctcggggtatattcatgtcggcgaggaccttgttaaccctttcttccaccctagcgttcatgctagcttctagttcttgaatgacctcaaccttaagttcggccttcaaacgagcgtccctctctttcttggagactttccgtttcctgtattgggagctgtactgcgagagtccatgcttcctgtcatgaccgaaaataacccaacgggcgttccttacgtgcgtgtattattccttgtcccaggaggcaaggtaaaccaaaaattgatacatttcagagtttatcaagcggaagcgtaaataaataatttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggggttataatataaagggttagggtttgcagtaaacaccattaaaagacacttagttgctcaaagctattttgtaaacacgattctagagctatacaagattattaatgaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatatggacggaagatgtgacatagtttccaacccatcctagccatagacaagagtaccgacccaaccccacctacggccgggacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgagttgctactattaaaaccatgcaccccgaacccagcctaaaaccattttgaggattttgaatagagggggaggtgtgaatccaattccacaataatccatccatttcatagtgtccaggtgatgagaatattctcaaagtctagagttgtaaaaccacctaatgttgcctaattaaccagcgaagcatctacctaaattcatactagtggtaccatgagtagagtgtccactagttggggttttgtttaatctagggtgaacaaggtaataatatcaataacaataataataaggtcataacaaaggtaaataggcatggctagataaaacagtgataacgcgggaatttaagtaaagcgataatgcaataatttaaatcaaaataattttataaaatgggatccaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaatggtccaattccgagttcaaatggccaagttatggccatttgaagtttatatgctctttaaatggatatttgcgaatttcttcatttaaatttttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacacgtcagccgcacctgagggcgcgggcggctgacggccgggctccacgtggcagccactcggcgcgcccgagggcggccacgccggcacggtcggcgggaggcggcgcgcccgcgccccgatggtcaccggcggcggccatagacgcggcggagcggcggccgagagaggggagggaagggggaaaggaggcgacggtccacggctcaccccggggtgacggcggcgacggaggaggcggccggagcggagggaggcggtggcgcggctcaggtcgacggggacagcagcgctcaatcggtcggcgaccaaaacggagaggtggacgaggtcggcgaggatgcggcgaagccgaaggaggcggcgccgaggcgggagacggtcccggcgagcgaagaaagccggccggaggtcgtcgccgacggaggagagagagagcgacagcgcgagctcgattccggcgaggaggaagggcggcgagaggcggaaacggacggaggaggtgcggggagggtttaaatagagttggaagggggaaagagcggccggaggggaaggaaaccggcgcgggaggtcggccaccatcaatggcgccggtgagatttgcgggggcaaatccgcccgtttgaacgcaagagagagaggggaaaatagggggaaagggagaggggatcacggggagtgattccccccactttattgcatgcatggacggcggaagcggcggtattctcggcgccgccggcgctaggcgcggggaaggccgggatcggcgggaggaaggggatgacgggtgggccccacccgtcagcgagggtggcgggcgggcctgcccgtcagcggcgcgcgcgcgggtagggaggccgaatgggccgcgggggagaggagagagagaggggggagagatgggccgggccggcccaagggagggaagggggacttttagggtttttctttttataaaactttttcaactttgtttatttcttaataattattatttgtgctctgagaattccattaaaatttatttacacattttaggcttttaggaaatatacaaaaatcctctaagccttgtttgacttttactttgcacattttaatttttggaggctttcacaaagattttaattattctaggcataatttaaaggatatattttagagtcgttttgggacgtgacaaacctacccccttaaacggaatctcgacctcgagattcggaagaactggcgaagagatcgggatgggctgccttcagctcgtcttcacgttcccaagtagcctcttccgcagcgtggttgctccattggaccttgcaaaaacggattacccggttcctggtcctgcgctccatggtgtccaggattttcactggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttctccgcgtcgagcaatgatacggaaaggacccacgaaccgaggggcgatcttccctttcgtctgaaacctatgtacgccccgcaatggcgtgacccgaaggtacacaaaatcgtccactgcgaattccaggttacggcgtcagttatctgcataactcttctgccgggactgtgccacctttagattatcccgaatggttctgaccttcgcttcagcttctctcaggatatcagtcccgaacatttggctttccccaacttggtccatacaacgcttcatagggtgtcatttgtatgctggcttggtagctgttattgtaggagaactcggtataggggagactcttatcccaggtcttcccaaaatctagaacacaagcacggagcatatcttctaggatctgatttagatgctcggtctgtccatctgtctgcgggtgatacgcggtgctgaaatttaatcgggtacccaactcttcttggagcttcttccaaaagtgagaggcgaattggcttcccctatcagatacaattttcttaggaacgccatggagactcacaatcctagcgaagtagagttcggctagtttgttccctccataggtggtcttcacaggaataaaccgagctaccttggttagtcggtccacaactacccatatagaatcatatcagccttgggtttttggaagtccggtgatgaaatccatcccaatttcatcccatttccattctggtacttggagaggttggagaagtccggccggtcgttggtgctctgccttgacacactggcacacatcacaaagggccacgaactctgcaatttcccgcttcatactaacccaccagtatttctctttcaagtctaagtacatcttcgtactgccagggtggatggaataaggactttcgtgagcttcctgaagtatcaactgtttaagttctctgtcgtctggaacgcatacccgatttctgttccatagggttccgtgttcatcctctgtgaaaccaatggctttaccctgtttcatattcttgaggagtccacgcatatccggatcatttttctgagcctcgcggatttgatcgagcaaggtaggcttggcttttagcgtagccaagaatccacgaccaactatgcttaggttcagggcttccatctgttgattaagttcacgcggaatgccacggacgccaagagtgttgcaatggctttttcgactttgatggtggcggagaggtcgaggtcgaggcggtggagaggagggcggtggatctggatcgagagagtgaatgagtgagagtgggtgccggatctggatcgatctagaagatgtccaaccctaggtcaaccctagtcaaactcacctgtgacgggcgccaactatggggccgtcacaggtgtcctcacctgtgatgggcgccaactgtggagccgtcacaggtgaggccacctatgacgggcccaatactctggcccgtcacaggtgatgtcacctgtgacggccccacagttagagcccgtcacaggtgagtttgcctacaacaattttattttattttatttcacttagttcttttattttccttaacgtatttccatatacactatatatttttgttatacttaattattttatttcactaacagtagtaattgcacttcattattttactatttgtattattttatttcaaatggttagactaatttaattattttatttcacttctagtgggtgcttcacttaattattttatttgactatttcatcagcaatatactattgatcattgcgaacatattagagtcatccagataacagagacaatattgcgaacatattagagacataacctacgtacataaattacaaaaataatccttcctcatggtcgacgcgtgcatattgaacgtcatcttcttcttcctcctcttctagaggtatttcttgacctatgccatggacgtgctggttgtaatcatcctcgtctgcaatattgtccaatccaacaattctccttttcccttcacgaataacatgtagtttcttgttacacgggtcaactatgtagaacacttgaacaacttgtttggcgagaacgaacggttcatccttgtacgcgttgttagccaagttgacagtggtgaaaccttcgttgtcaacttttacattgcgaagatagacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgttgtcttgctttaccatgcgaaaggtgtatccatttatgttatatcctttccaggtggtggcactccattcaggaccctgtgacaaccactgaagtgtttcattagacaagttctgcaacctggcaattcggttcttcagccactcgttgaaagaagacatgtgcttatttttgacccaactctctgatcggcctgggttctcctgtcggagaactgcaaggtgttcgtcaacgtacggcaccacatcagtcatatactgcagtaccgtgaaatgagctttatcgtacaccttccgatccaacctaacagtctttcttccaacagtaccaacatcgtcaagcctcccttcatgatgagatcgtggtaatccaattgaagaagtttctgacatgtagtccacacaaaaatcgatgacctcttcggtggtgtaactctcgatgatactcccctcggggtgtgaacggttccgtacataacccttaaggatccccagatacctttcgcaaggatacatctgcgtcatcaatgctggaccacagcactttgtttgcctcacaaggtgcacgggaagatgttccattatgtcaaagaaagttggaggaaagtacatctcaagatgacatagagttctcacaagttctgcctgtagttcatctagtccctcgggatcaatgatcttctggccgattgcatggaagaaggaacacaaccgctggatcgtgtgtcgcaccttaggaggcaaaatattccttagtgcaatgggcaacagctatgtgataagaacgtggcaatcatgcgacttcattcctaccaacttaagatcttgcagtgaaacgagcctactaattcttgatgagtaaccagatggaacctttataccactcaaacatgttagcaaatcaatcttctcttctttcgagagagtgtagcaggctagaggaaggtaaaccctgccggatttcgtggttatgggatgtagttccgagcgaacacccatttcttcaagatctcgtcgggcgttgagaccatcctttgtagtacctgggttaagcagtaatcccattaaactctcacatacattcttctcgacatgcaccaaatctatgcagtggcgaacttcaaaatccttcctgtatggtagtctccaaaatattgacttctttttccacatgctcctctcttttgtcttttgtttttccacatgctcctctgttttttccttcgatgtgctcttctcttttgtctttccaactttcttcttttttccaaactcgttggttattcccatcaccaagttgtgcacctctgtccctgttagctctgccgggggtccggctgtatctctgtgtccattgaaattctttttcatattcctatacgggtgataccttgggagaaatctcctgtgacccatgtagaccgtcttgtgtgaatgcttcaaccatttgcttcttgtttccttcatacactccgaacacgcccatttccctttcatagtttggccagaaaggttgccaagggtcggataatcattgatggtacaaaacagcatcgcatggaggttgaaatactcttgtgcatatgcgtcccatgtccgtgtgccctcattccatagcctttcgaagtcatcgattatcggttcaaggaacacatcgatattgttgccaggttgtctcgatccttgaatgagcatggcaagcataatatactttcttttgaagcacaaccagggaggaaggttatagttaacaagcagaactggccatgcactgtgacgactactcaaatcaccaaatggattaatgccgtccgtacacattgcaaaacgcatgtttcttgggtcatttgagaattcctggtaaatcctatcgattgtcctccactgtactgaatctgctgggtgcctcagcatactatcgactttccgttcttcggcatgccagcgcactagcttagcttgttccttattcacaaacattctcttcatgcgctccacaattaagagataccacaccacctttgctgggcctcccctctttgacttacttccttcaccttcactctttgctcgtttgtatcttgatgccccacagacagggcagacatccaagtcagcatattccttgtaatacaaaatgcagtcgttcggacatgcatgaattcttctgacctccaggcccaacggacataatacttgcttcgcttcatatgtcgtctgcggtaaattgttcccctctggcaacaggtcttttaacagctcaagaagttctgtaaaactcttgtccgaccagccattactagccttaagcttcatgggttccaacacgcatgataacttgctgtgcttcgacttgcatccatcatacaagggcatctgacaatcttccaccaacttactaaactactcaaaatctctgtcgttgtcctctgcatcttcaatgtcatgcaacattgtagatagacattgagtgtccaaatctatggtatctccacctaaaggagaaggtacgaacatgccttctcgagctgcggcgccggcggtgttctctacatcctgatccaacacttcttccgctgcgacatcaggcgcctcttgctctccatgcttggtccaacaggtatatttcttcatgaatccattcattatcaaatgagcatgcatttcatcgctatcttcgatcatctgttcattcttacagtccctacatggacacaacatgtgcatgctcatcctactttttctatcattatccgcaaatgtgacaaattcagtgaccccctctctatactcggtagacgaacgatgcgcatagtacatccatctacgatccatctgaaatcaacaacatacgaagaaaaatatatgatgatcgatatattgagaaggaatggagaataatgtgttttttaccttgaattttagaaaaaaatcgcccccttgccctcccaaccgatttgtgaacagtgaactggtcgggatggaaagcggttggcggtttgggggggtatttatagacccaacacacctcaaacaggttagattaaaaaagcccgtcaaaggtgttggtcatacctttgacgggcttcaattgagttgcccgtcaaaggtattgacctacctgtgacgggctgtaaaaaaaatccgtcacaggtggcggaccaccacctgtgacggctcatagtgccacggcccgtcacaggtgaggggataccagtgacgggttgggaggaaaacccgtcacttcctcacctgtgacggcttttccttctggcccatcacaggtgatggatacctgtgacaggccacggccggatgccccaccgatgacggcaaacctagcaacccgtcaaaggtgacggtcatctgtgaccaattcataggcccgtcactggtatgctgtcacagatgcagggttctggcgtagtgactgcttttagaaacattgaaagacaaaccaatcctaatcaaactctgccgattccgaattgtatcgttcgcactcgcgcgctagaaattctcacaataatcgaaagaaaatataaggaaatatagaaaagatctagaccataaaacatattttgcttcagattatacgttgtagattgctttcgtaggatacaggaaacggacaaggtttctttcgatttagaaaacgtattggacactaattttgaaaaccatgtgagacactaaggtggtgtttagatccaaggacttaactttattccctgtatttagacactaatttagagtattaaatatagactacttaccgaactaattatatataaatgaaagctaattcgcaagacaaattttttaaacctaattaatctataattagagaatgtttactgtagcatcacatagactaatcatggattaattaggctcaatagattcgtttcgcgaattagtccaagattatggatgggttttattaatagtataggtttaatatttataattagtgtccaaacatccgatgtgataggaactttaaagttttagccccatctaaacaggatcttaaaagacagactaaaaaaccatcatcgtcagagtcatgcaatctaaattgtacacaaattacatgccatggtaatatataaatagtacgctagaaatcttctctccacaatccaccgcaacaaaaagaaaggaaaaaaaagattgagtacaaaacagtgacgaaactctctaccagccaaaaagaaatcaaaagggatccgacttttagcgatgaaaaaaattgtgagatatttcaaggaaaatagcaactaactgatgctctaaaataccatagagccgaaacgatatcaaaacaagaaggcaaactcaatctattatcttaataaagaaatagaaataaaaaaaggagccaccactctcatagactaaaaatttccacatgaattagagagaaataaaaattctaatatatgaaaaaagagcctagatggaaagtataatagaaaaagaagccaccacgtttgctcttacggcctataaatttccacattaatcggagaaaaagaaaaggtagagtccatataggaatacaatttaaaaacagctgaaattcggaattaaaaataaggaatattgaaagagtagactagagtccataaaagcataaaatttagaattaattaaaattcggaattaaaaaaaaaggaaaactaaaattagaagttagagtccatatagaaatacaatttagaattaacgaaaattcaaaataaaaaaagtaagattaatgggagaagagtcatagtccatatatgaatacaatttataaataactgaaattcgaaattaacaaataaagaatactgggaaaaaaaagtctagcgtccatataggaataaaatttagaaataactaaaattaaaaaaaagaaatattgaaaaaagaagtctacagaatacagtttaccaacaattgaaattcaaaatcaaaaaaaataagaaatattgaaagaagagtttagagttcatatagaaatacaatttataaataactaaaatttagagttaagaaaaattaatattggaagagtagtctagaatctatataggaatagaatttatgaacaaaggaaattcaaaagtagagtttagataggaatacaacttaaaaatagcttaaattcggaattaaaaataacgaatattgaaagagtagactagagtccatacaagcatacaatttagagttaattaaaatttggaattaaaaaataggaaaactaaaattataagttagagtccatatagaaatacaatttagaattaactaaaattcaataaaaaaagtaagattgggagaagagtcatagtccatatatgaatacaatttataaataactgaaattcgaaattaacaaataaggaacacttgggaaaaaaagtctagcatccatataggaatacaatttagaaataactaaaattaaaaaaaagaaatattgaaaaaagaagtctagagtcaatatagaaatacagtttagcgataattgaaattcaaaaataaaaaaataaaaaatattgaaagaagagtttagagttcatattgaaatacaatttataaataacttaaatttagagttaagaaaaaatgaagattggaagagtagtctagaatccatataggaatagaatttctgaacaaaggaaattcaaaatttaaaaataaggaatattaaaagatgattcttaagtccatatagaaatataatttataaataactatcatgtatatacaatacaataaaaatatcacacatttgttagtccaaccaagaatttaaaattatgttgtcattttaatatattttaataataaaatgtgaaaatatttaaactattgtatgagaaaataaatctaacaatgctagccgcgcaatctgcgtgggccgccatgctagtttgtctaatattgttggtttagattgatcaatgagagaattccttatatgccactcaaaatatagcccattcctttacctgccactccaatttgacactttccttctatgccacaagctcaaatttgtccaccctcctgtgccactaatgtcactccaccagctgttgacttatttcgaacccctccaataggtaaccacgtcaagccattagaagcccatgtagttattgcaaatcgctcccccatatcggttcaagggccgcatgcagcctcttaagagccccacttgtaaaagtaggagatatttttccaagcaggcctcttacgcagccacatgcgaaagtcagattttcacaggcacctccttaagaggcccgcttgcgaaaatcactaggtactaaatattaaaaaaatcttctccgctcctcctccacctcccctctctttctctctcactctcactctcttattcatttctccccctctctgtctctctcactcattctccctcttgtgtggcgctaggctagagcggctgacagtggacaagagcggttggcagtgagctggagcggcaagcgggtcggcgatcggtggcaaggagctcggcgatgaatccgatgtggaggacgacgggagcagtggtggcgggctcgggtagctggagcgacctcgggcagccgcatagatctggtgctggctgcccttccctgcacgggtccggtggtggggacccttggtagcaacgacgccggacaacagcgaggatagcagatctgacgggcggtggatccgacgatgacttattgactgctacgaaggtctaccacaagcaccacgatggtgatgaggaggtcaacaaggcggcggtggctggcgtggggacaaagaggtgcgggtccatgatgaggcagctgtcacaccctgaagttctcctcccaagcctaaaattcaatttataaatgaccctaagaaaatgccggtgcaaatcaagagaaaaccgtaagaaagtaatacaaataataatcgaatatggcatgtggaatttttcttgagttctacatgtcaaaattcactaacaggatttttagtggaattttcaaagccctagaaataattttaaccaattaaaattgagcaagcaatattttaattccagggaaaatccttttcttcctttttctttttccccttttcttttcgagtgggccgccagcccattctccttcctcccctcccctccgctgggccggccgaaggccaaggcccagctaggccggccgcctccctccttccacccgggacgccgacaggtgggccccacctatcaggcccgtcttctacctcgcgcccgcaaccgccgacgggcccacacctacggcttctccgggccacgtcggcacgcccgcgcatgcgccgcaccttccgcgcccacttccctctttctctcgtccgcccccgcgcccgagatggccgggattcgattttcgaatcccgcctctctctcctctcccactccccacgttggccggcggaatctcgcccctaccggccacgtccgggactcccctcccctatttaagcttcctcgtcgccccctctcgctttttccctatctcgccgaactccctcgtgctccccatcgctcccgcgccatgcaaccacccgcccgccccgcttccgttactctggtcgctgctagccgccgctagggtcgccgccgcaccgcgccgtcgccgccgtcgggttcgcgaggccaaactccacctcgtccgccccttccccgtcgggattcgttgccggaattcgcatcccctcacgctccggtgagttctacctctaccgccgccttcggccatggatgccggctgccgtggttcatctccctctctctaatctctctctcctccttccttagggcaccccgaagcccgtccaccggttgccgtcgtcctcccgtggcttgccgtcaccgttcgccatcgtcttcctccgcgccggccaccctcggtgaggcgtcctctcccctctactcccctccctctccctcctagagccgcgccgccacttcaagtcatgcgtcgtcgccttcggccgccgccgccgcctcccgtgctgccgatcgccgtcgccgtcagccgcgtgccatcgccgctagccctgaccggccggccggctttgatgccgagccgagcccggcggcctccactatcgccaccgcccaatcggctcggggccgatctgggccgttggtcccgtggaccggcggtggaccacccgcgtggtcccggtccacggtgcaccggcccccctttgagctgctgaccagtgggacccgcctgtcggcgccgccccccccccccctcccttgatgacgtcagccctgggaattattgcgcaataagttatttaaggactttttgttatcgtaataaacacagtgaatcttctaaaattcataactaattcatccgagctccgtttaagcccattcaagtctcagtaaatcaaaaaaaatgtgtagaatccattaaaaatggttttgttctctgtttcagtagtcttatagtctgtttgcaatgtttgccttgtatgttgctagattccggttcttccgacgctccggtgtacttcgaaatagtcgccgaggttcctccagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccttgctcctttgttagctcgggttataacatgaatagacgttggactaggagttgcttagccatgcttagttcaactagcacacaatggggaaatctcatttaaaatatagactgtaggttcatatgataatgttggtttagtaccaccgctttggtgttggttagttaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgacgcatccaggcaagggtgggcatgatggagtttggatgggccctgcgacggcctatgcggcttccggattcacctaggcatgagaggggattgtccgtcgcccgctggggacgggggtgaaacctgaggtatggtgtgcttggctagagggggttatgcaaagggtcctgtcacggcctctttccggtatgtcgtggtggcatatcggcgcacggaaacgtgtcgtggggctgtgtcttgtgggtacagttgtacacctctgatcagagtaaaactattcgaatagccgtgcccgcggttatgggagatcaaccagattcaccgtgattagtctcaccctagtttagtctaatgaaattggatagtataggtggatggttgggtctgttgcaacgtggtatagcgttggacagtggatgattaatattgattaattattacaactgtttaattctttcaacttctgtttataaatgcccgctttatgcaaatgaaccactctagctctcctttgataattccctgcatcatgcccctattccggtatgacttgctgagtacagtgggtagtactcagtcttgctctattttccccaaccccagagtacgagtatgtgtcagatagtggtttctctgaggagtaggcttcgtccgtgccgtcgaggatgcctgtggagtggtgttcccgctgcagttcaagtcaaggcttagctcctgttatctttcgttttttccgctgcatttatgtaaggcttttatgatgtttgtaagacgtggatctgaatgtcaatattgtcgtttgtgtaccccggccagtcctggacggggattttaatgcacattctgcttggaattctattcgggaatttctgggcatgacagcaacggtggcagcgatgacgactttagggttttggccggtggcgggcatgggtttggccggtggtgagctatggttcggctaatttgttgttttgtgatttttatttttttctccaaaattattttcacattccattgatataggtgaggcatgcgaaaataggattttttttcacatgtgattgcaatggccacatgcaaaaatctcgattttcgtataaacctgggggcaggtagaccacccaccgcatgcgaaaatagattttcgccgcatgaaaaaaatcgaatatgtagtagtctaaggcaacacggcgacgtgtggcggcaggacgaacatgttggttagactccttgctgttggactatattattggttagggttgttgctgttattgggctgggctagatgatgctatccaggtaatatccagataatttattgggtaatatctatattctttataggatattcgtcggatactgccatcccgaacccgatctcacatccaccaaaaagtacccgaattcggttcctatatctgtacaaagatccagataccctgattttttgatccaaaattgtcccaaaataatacgagtggcgggcagacggaaatatttgtcccgttttcatccttattactagagaggagcggcatcttcgctccactcttgcacttctgaaatttacactacacgggaggagtgtcagctccgctccagcctttaagtaggagttgtatcaaacgggccttatatatcatcactactgcagaaaagctggtgtcagttttaaagggtttataggtgctggttttggtgccgacaccaattatccggcacccaagtcatcgctgccggtactataggtgccggttcaaatttagaaccgttttttagttctgcgggtgctaaaaaaacactataggtgccagttcaaatttagaactttatttatttttccaggtgctaaaaatacgaaaaaaaatatttggtattttcattaggcactcacacttcatttcccacatgtcacttgtttttttagcccatattcgtagacatggatcaagtaagattcactacaagataattgtgctattgccaccaaattattacaacaaaaaataattcgtagcaatatattatactattgcaatgataatttttctgtggcaaataattattttttattgcaacgatctgttttatttagtacttttgttgcaatagaaaatgagatatcgccacaaaaaatcatactattgcaaaaaacatgttctatcaccacaattttaatttttgtggcaatttatatagtacaattttaatttatatggtacttttcactattttttgttgccacgatcaacaaattcgttgcaataaaaaaattgttgtttcataatttaacttatttttttcatatggactcggattgagacaaattttatatggaaattatagctctcgacgagatctacaattttataggtgataattttttcatttgaaatcttttagatattcaaatatatgatttaaatctcagttagctaggctcaaatggaactatatgtattttccaacagaattgatgtgtaggtgagttggtaaaggagagcacacctaaaggacaggatttgggttcgaatcctagcaaagacacaaaataaaaaagatatctagataaatagataggatgatagattaatatttgaaattttaatttggtacgtaaaactaatactacatatggagtggtggcaataatttttattacaacaatgtgaagtgttgcaatatgactttttgccacattcattccgtagcaacatctaaatttattaccacaaaataaaaatcgttgcaataacctattaccacgttgtttattaccacagctagcaacgattttacaattgtggcaacatatatctattgccacaattttagtattgatgccacgatttttttcatggcaacaaatgattttttgatttttctagtagtgatttaaactcaagacctctctctccatccaaagcctccataccaactcacgtacaaacatctgttgtgttggaaacaaatgatatcatgagactcctatcatccgaatttataatccatatttaacatcgttgatgagttcaaatgaaaagcttgtgaactacaaaattttagatcttagatttgcaactttcatatatgtttgtctccatccgatatcgttaagagattttaaatatttacttatgcaaatagatctcagaccttgtaactcattttcagatttttaaactaccttaaatcgaaaagtcataaactacagagtggaaaagcttgctaggtaccggttttaagcaaaccggtacttataagatcgatctctatgcgttgttttagtaatgcatcctatcaaaatttcagtgtaaaatgacttgtatagaaacaaataaaataggataatatcgttcgaaagcaaagtgaaccattttgaaaatagtttatgagtaaaatgggccgagaaatattgtagaggtaaagtactctgaatggtttgacggagtaaaacgattttttttctttgaattttacgtgcccatcaacttgcgcacacttttacgtgccgatcgtaatttaccgatcggatcaagacctgctaggtcaattaatgtacgtatctggaaacttactgcgcatataatattattaagaactttctacaaatttaattttatgctcgcagcctagttggcatgccgcagttatcttgtccgcatgcatgggcaattggacaattagcacgttaattggaatttagacccacgtgttagtttcactgactaccatccccaaggtgaaagtgttggtttgtccccttggttaatatatacaaattgatcatctcaaaatagtttttctattaatatataaatacatactgataaaaaagagtgttattgacatccaactattttataaataattgatcaacccttatttggataaaaagtaaacatccactcttgaatgtgatgtgcaaattgtcacatgtgagcatgtggcagcctagctagatagttgctactagtacagtagttagcgtgagagccaagagtagtttcatcgtggtcaataaaagtattagatcccttctggcatgcctgttccttaacaagtacagttcagtgcaattagctttggaaaaaactatttagtatagtcatgcaactaaacatgagaagtaattgcacacttgcgttgttttatcagattattcaaagttattttccttgtattaagcactacgccagatttgctcacttgtgatgggttatctgtgatgggccaaagttctgatgaccgttacctttgatggctcctacgggatgccatcatcggtgagtcctcgactacggctcacctgtgacgggctgacaatagaacccgtcagagaaacacctctgtctgatcccactttcgacccgtcacaggtgacttgatacctatgacgggtggtgtagctccggcccgtcagaggtgtagtttagtcaccagaaacaggttttagccctaacccgtttgaggttagttgcggcctatgtaaaacccccaacaaccacctactttccttacaacctagtgcactgtttacatttcgtgtgggagggtgcgaggagggcaattttttgcccgaaatggaggtaaaaaacactataataattatttttttctaacgtgtattatgtattatgtttttattgatgagaaaacacggcgcccgggaattcttcttagctacagcgcatgtccaaatctcgctttcgggttaaggacgttgttgacgagaaacacgacggcctgggagttctgcttagcttcagtacaggtccaaagcactttcgggttcagggcgtgctagttggtttgatcttgcaaccaacgaaaataaacaagaaaatctagtgagaatacgatagctgatcggccggtgagccaatgacgtatcgtgttagcctagccgatgcgatctaaccgaatcggctgtgagaagtaagataaatgaaattaagtatacctaagatatgtttcatcggctgtagatgtaatcaacatgtaatctatggacagagattatatctttttatatcatagccgatgacacaatacttagggtaaaatagataccgtatcggctaataccccaatacagctttatacaagagtatcaatctaagtaaatatatcaagagcaagcttgaattaaaggaatttaacaaagctaacactactacatatgtgattatcctggacgccggcaccttttggttccaggtgggccataagtggctccgcctggaaccagacgaatgtcagggtcgg

SEQ ID NO: 61969 - DNA, 18176 bp, Oryza sativa
cacaaaaatgggttcttgacttcttaaggaaaaattagagacttgaacggtccaattccgagttcaaatggccaagttatggccatttgaaggttatatgctctttaaatgaatatttgcgaatttcttcatttaaatattaatttaaaatggatttattgcgtcagccgaggggaggggcgcgcggaccgggtccacgggagtggggcccacgcggcagcctcacggtccatggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggtgaccaccggcgcggtagagcggcgcccgagagaggggagggaagggggaaacgaatcggcggtccacagctcaccccgggtcgacggcgacgacgggaacggcgaccggagcggagaaagccggcggcgcggctcgggtagacggggacggcggcgttccggctgtcggcgggcgaaacggaggggtggacgaggtcggcgaggttgcggtgaaaccgaaggaggcggcgccgaagcggaagaaggtccggggcgacgacggcggcagaccggagctcggcggtgacggcggagagagagagcgacggcgcgagctcgattccggcggagagagggagcggcgagtggcggaaacggtggagggaggcacggggagtgtttatatagggttgggagtgagagagggcggccggatgagggggaaacgggcgcggaagatccggccgccattgatgcgccgacgaggtttagggggaaagattccgaacgaatccgagggagagagggagggaaaaatggggggaaagagggagggaatcacggggaatatttcccccctcttgattgcacgtggggcggacgggagcggcgggatttgcggcggcggcggcgctagggcacgggcgaggcggcgggagcggcgggaggaaggggatgatgggtgggccccacccgtcagcgagggtggcgggcgggcccgcccgtcagcggcgcgcgcgcggggaggaggccgaatgggccgcggggagaggagagagagggaaggagatgggccgagccggcccaagagggggagggggggaaaaagactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcattatttcgaggatgtattttagagtcgttttgggacgcgacacgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggcgttgataaataatattgcatagttctagaatcgtgtttacaaaataactttgagcaactaagcatctttaaatgctgtttactgcaaccctaaccctttatattataacccccttgtactcccttgcatttattatgcacttgtgggtgtgtcttgttgagtacggtggttgtactcagtcttgctcaatttttcccaacccagaagaggagcccctggatgatgaaggctttggtgtctagctcgtgcctgccgtcaagcgcctgtggtcgtcgccctagtcttccgctgtttctcgtttgtctttgtgtgtgctgggccaccgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacacggggtgcgggtgcttgcagagttggctggaaccgaggcagcgatcatggtcttcgtctggttcaagatgttgacaacatgatcggcttggttgagtgcgtcttccttgaggagggtgtcgaggagagtgattgctacaaccgcgttctgctgggggggtgcgaaagaccgctgtcccatcgatgtcttgttgcccaatgagctctctcactcgccgcccagattgcaaggcgcgttgtcgtcgatcttcagcctcctttgcaatctgttcacgatcttgttactcatgctgtagtcgttctcgctcctgtcactgtcgctcttcctccagtcggcgacgttcagcttcttgtcgtgcgcgatcttggtccgcttctcgggattggcgcttttcctccgtttcgttgtcagccatgaatacgccgaagaagaggagcgtgtagttatcctcatagctgtcgtcgaagttgtcgaggtcgccgtggtcgtagtggtagccgaagtcgtcatagtcgaggatctcggttggtcgagaactaacgccaggagagctaaggtagccatccaactcttccgtcgagactgtcccaagaggttggagtataacgccaacctccctggatctagatcggatcggggccgaagccggagctcgcctagatcttcgagtgggagatgtcttgactgtgaagacagcggccaaatcattaggaagtttcatcaggattgagggataggacccgtcgtcttgatctggtcgcggaaatgtagattggatctcgtccgagtggtttgaagccgactcgggagagatgatcttggagtaggcctcggccgagttcggaataccgaacggcacagggacctggtctctccccgactggtttgaatccgagtcaaggagagagatcttgcgcgaagtcgttggtgatgaagttgaggctgccgaaccggaacgcctgcccgggagggaaggcgaagtcgtcgatgccagaaacggaacccatcgcacttagtcggcaaaaacttgacgctacccctacctggcgcgccaactgtcgaagcaagatttcgacaataataaaagggggtggctatcaagctaggaaagtggatgggtttggagacaagggattttatacaggttcaggccttcttattcaagaagtaataccctactcctgtccggggataattcctccgagtgtgttattgattgtataaactggaaaaaagaatcgtgccccgagaggcacatggaccttccttatataggggaaggagtccgctttacaaagtaccgtccatatcctaacggaatatggtatcatagataaaatacaatcataaccgactaggatcccgggtattttcttgacatacaagtttagaatctaacccgagtcctcatagagatattctatctatatttggtaccatatatccgactaaattataactgtcatgtagatatggggtatccataatctccacagctaggcatccacggcgtcgggccagtgaaggagctggtaagtggagatgcacaggcggcggtaggggcccgggtgggcggagagtgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttcccccctccccctcttgggccggctcggcccatttctctccctctctctcctctcccccgcagcccattcggcctcctccccgcgcgcgtgccgctgacgggcgggcccgcccgcctccctcgctgacgggtggggcccacccgtcatccccttcctcccgccgctcccgccgccccgcccgcgccctagcgccgccgccgccgtgaatcccgccgcccccgtccgccccgcgtgcaatcaagaggggggaaatattccccgggattccctccctctttccccccatttttccctctctctctccctcggattcgtttggaaactttccccctaaccttgccggcgccatcaatggcggccgggactcccgcgcctgtttgcccctcctccgggcaccccctccctatcttaaccctatataaaccctccgcgtgcctcccttcaacggtttcgccactcatcgctctttctccccgccggaatcgagctcgcgccatcgctctctctctccgccggggccgccgagctccggtccgccgccgttgtcgccccgtaccacctctcccctcggggtcgcctccttcggcttcgccggatcctcgccgacctcgtccacccctccgtttcgcacgccgaccgccggagcaccgtcgaccccgtccacccgagccgcgccgccggctttctccgctccggtcgtcgttcccgtcgtcgccgtcgacctggggtgagccgtggaccgccgattcgtttcccccttccctcccctttctcggccgccgctccgccgtacatatggccgccgccggcgaccataggggcgcgggcgcgccgcctcccgccgctgcgccggcgtggccgccttcgggcgcgccccgcggctgccgtgtggggcccggctgtcagccgcccacgcccttaggtgcggctgacgcgtgggacccacggcgccggccggtgagagcccgggtgcgcccggtccaccgtgggccgtgaggctgcagcgtgggccccaccccccgtggacccggtccgcgcgcccctcccctcggctgacgcaataaatctattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattaccgctttatttaaattcccgcgttagcactgttttatttagccatgcctatttacctttgttaagacattattattgctattgttattattaccttgttcacccttggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttgtcttgggacgagctgggacccagggtcgggttgccagttcggtctgaatcatcgtaggccttgggttaaggcaggttcgtgtgggttcacggccttgataaataatattgcatagttctagaatcgtgtttacaaaatagctttgagcaactaagtatctttaaatgctgtttactgcaaccctaaccctttatattataactcccttgtactcccttacatttattatgcacttgtgggtgtgtcttgttgagtacggtggttgtactcagtcttgctcaattttttcccaaacccagaagaggagtatctggaagatgaaggttttggtgtctagctcgtgcctgccgtcaagcgcctgtggtcgtcgccctagtcttccgctgtttctcgtttgtctttgtgtgtgttgggccttcgctgcccatgtaataaattaactatttacgcttccgcttgttgaactctgaattgtatcaacttttggtgtaccttgcctcctgggacaaggaataatgcacgcacgtaaggaacgcccgttgggttatttccggtcgtgacaaagaggatgcgggagacggcgcgggtgagggcgtccttcctcgcgcggagaggacggtagttgaggttgagcggcgtggagcaccagaggtggtgccaccgggaggcgaggacctgcgtgctgccagcttccttggtggggaggcgggcgatgatctcgccgaggatggcgtctgggaggttgctgatgatgtcgacgccttcttcttcctccgcgtccccaatctcgggtgcctttgacctccgcttcttcggactgtgacccgcgttcccgacgtggtccatggctggcgcaggcgggactctatgagcgatgcgagaggacggcggcggccggcgtgcggcggcgtccgatgcggagttagtgcacgggagaggcaaaatgcggcgcgggggattaggggtttcggggaggggaatcggtggccgatgtcttctttcttttttctgtgtgtaacccaagtaaggccattattgggccagcgaatcgacccagcaaccagcatgattcttctttttcttcttcttcttttttttttgttttgacttttcacccgttgctggcaagtgtgtactggaactggaagagaaaattcacagaaaacttcatgactcattcacaatcaagtgtttaagtggcactaaaataatggataaaaattgaagtgtttttgccttacaagagaaattaggttaaataactaaaatcggcgtgcttgtgggcatgcctaacttatagcccgtgtacattatttggatctttcgagcatagtaattttcaagtatttactttaattatttcataacttgtacaataaaattttacatctagaagtagcattttaattaataattttaatcttactttgccagtagtggactattcgtgtatattttttttcttactttgcaaaattggtgaagatgatattaagtacactttttctttctaaatactgtgactttcataaaggcagaaaattttgcatttacacctctaaaaatatataattatgtcttatttttcttcctaccctggactggacatgacctttttataataggtttaaaattttatgcttggtaaaggttcctcaaatcaaagtatacatttttcttcctaccctggaatggacatgacctttaataggtttaaaattttatgcttgttaaaggttcctcaaatcaaagtacatttgactgggcatgacctttaatatacaggtttcaatttttatgcttgttaaaggttcctcaaatcaaaatacgatgtcaaagtgggacatcgtacaatacttgccttgacgtcaatttcattttcaattctcgagcggaaaactatatatgatattaaaacaggaaaatcgtggttaataaaacatattttccgtttctatacactactagaaaatcaatttttcatgacgtttacctattttttctctggcggctataagcgaaaactgccagcgaaaatttaatgaggatgaggtactaataacgctggcggccggattatgaggaccacttgcaaaaatagatgtctttttacaagcgggcctttaagtgaccgccaccgactgcaaaaagtttttcgctatattaaaacaccaagtgtgcgcagactcttattatccactcactccatcttatcctcttctcacatgcgctcgcgcctccctgctctcggctgccacagcaagaagacgacggtgacggcggacaaggcggcaacggcggacaaggcagcgacggcgacggcgaaagcgacgcgcacgaggtgcgcgcggggtggattagtccgtgggatgggcacgtccgggcctccccttgccctccagcgtcacgctgccaacctcctctccgactccaacttgtcccctgacctcctctacctcaccatcgccactccagctcgctccaccctccctcccccctcccattctgcctcccctgccgcaccgcgatgggaggcctagatctgggcggaggggagacgaccggcgggtggcggcgttcgtccacctctctcccctctccaccggcgagatcgatccgccgccaccgctatcggcgcggatccggcctcgtctttgttctcatcctcggcggtttgtccatggcgagtacgacaaagggcaaggaggatggtggcggtgaccgcgaggaggaggaggccgccgcgagccggtcgtcggtggggcccaagaccatgtgcggcatgcatcgggagcgcagatctggtgccggcgacacccttgatttgcaatgtgaatttgatatgtgaatttgtatttgtgacatgttcttgatttgatttgcaatgtggaatgggaatgcagggttgttgcatctggcaattttcaattttcagagaacagatgcattcacatgtttttatttttttttaataaaagatgagcttcactggcagtcgtcttaacaaatacgccagcaaaaatgcaccattgcgagcggcccgcataacacaaccgccggcaaaaatctgttttcactggcggtacgtgtaatagagccgcgagccgccagtgaaaatatattttttgctagcggttaagttccacttgtgaaaactttttttttctctggccttcgatttcaggtggctagcctaaccgtcagcaaagattgattttggccgccaggaaaaaccattttttaagtagtggtatgcatttgatttcagcatttattattttctatttcttacaaatatagatattagtaaactgtacttgcctcatattttaacctgcagtaatcgtatttttatggaaagatttataagcattctagataaaatggtatgcaaaccaaaattagaaattttattctcttctgtatattattgtttatttagttttctaccttttgtttctcttcctatcctgccaatcttatctcttctttcaccgcagtgaaaacgttagcagtacagtagtagagaggagtaaagacaggatacccaagagataatgatatatataggtcagctcgcacgagcgagcggcaggccgccagcagttgcgctctctctctctcttcctttcagctgtggcgagctagtgcacgctgcacgccgtcttggggaggttctatctactactgttgcgctctctctcttcctttctgcgtctcctcgcggtgatgaggccagtaatggcgcgacgggccaagaccacaccacaccgtatcaccgtctcgttcgccgacgacggcgactgcgaaccgatgagcacctcgggcaaggcgagcttgtccggtgagagggtggagataaacaaagtgaaattaagctcctacaatcctatctcgtcgatcactcggttcttatacgcttctccggtcctcgatacgtatcttcattattgcatatacttcagaatatagctataaagagcataagcaaatatgcaagtgcattagatagagccaacacgtactgtgtgattcagttccctgaatttactaaacatggaacacaagggatgaaaaaatggccaagaacatgatgctaattaattacacaaatttcactgaaataattgtacatgaaagaaaattgtggctacctgaatctctatgatgccaagttttagcatggagatgccaagccagcccatgatctccagctttgatgcaacaccactgaaatggcttaggcacggacaagatatagcaatcatttgcgacaaggggcatccagggtttgcactttcgttagccaccgaatatccactatttcgctgaccgaaattatttgaaatttaatatattttgactgaatttgaccagattcacaaatatttgaaaaaattcgaaaaattcgatggaggtttgtgcttgccagttggtccaaaatttcaaaccatgggggtatcctcgacaatgacttcctccaacgttgaccgccttccgtagccaaccagcacaccgatgctctaagccttggggagctgattcggacacaatggaagccatatatgtgttccagcagcaaggtctctaggagagggcaggcgatgatgatggcatgtagggcgacctcggagagggtgatgtacttggtcgccatcatgaatgcatgattttctacgcaagaatgtaacaggtcatggggatggcaattaagatccttaaacttccatgcatcctagtagctaagtaaagcttgaaagactaggttaacaaattgtagctttcggttccaagaaagagaactccaaaaaatcgacccaagttcttgtgaacttgcacactttgtttctctttctctgttttgctctatcctccttgttggaatacatcacagtgagtgagaaattgagtgtgtgatcaatgcctaaccaacaattggtataagagcaatgtcgatcataataggggacgctcgttgaggggggggggcacggggaatgagttcctctacacacaactgacaactggcaactacacctcctggttgatttcggtgcgggcgatgatagatgaccaaggaatttggaggcgttcgatacaacagtcgggatggctattcgatgcgaagaagaagacatctgctcaatcacctccctgattctttggtcctccattatagcctgtacttgaatcacccacctggtgtaatttccgccattagttgcgggtagagttactcactcttcatgttgcgtccatcatatcatcacgattgacatggctttgataccaatttttggctatgcacaagaaagcacacccaattcctcactcagtattacgtattccaacaaggagaacacatcaaaacagagaaaagcacacaaagtgcgcaaattaacaagaacgtggggaaattttttgcgttttttttcttttcttggaatcaaaagctaaacttgctatgactcacacttacaacctttagttactgctatttatagaactcatggaagtttaaggattgtgccatctcacggccttgtctagcatggttatgaggtgagttcgagtagagcttgttctcaggctagttcaaagcgggaagatggttgtgaaccacatgggggctgagcactgaggttatcgatggcagtaatcgacggccatattggaagaaatgggtcaaatgactactcggaggtgataattttggcccagcaatgttgggtgggtgggcctatgcaacaaaatatgttatggtgtggaatcttaaaactagagtgataattgagatagtttaagttatttttccgtggagaaaatacgagcgtgccatccatcaatgtgccgagtactaacactctttttccatattctagtcttgtctgggctgctaatgggtccattccaacatgcccttttgtgtttctttttctctcggcaccatttttttctacactactaaaataactctaaaaccgacacttatatgtactagttaatctaaagccagcacttatgaccctttcccaccccccgaaagtatataaaagtaaaaaaccggcacctttgaccccttataagtgtcggtttattaacatctttaataaaacaacacttataacatggttattggtgtcagtttttttaaagaaaccgacacctttggggagccgagttgatgaacctcaccgattttttctgggcgacttgagtctccactcattcactctctagcagccttatgcccccttccttacccccaacactcaactacacaccagctcacattcttatcctctctagctctccctccccccctctatctatctatctatctatctaacaacagcgaccggtggcggtggctccatgagacgacagcggtggtggcggcacgcctgtacccggaaacacgacggctccacgacgacgacgacaatgactccactaggacggatctctaggaccggcgacgcctcgacctccgcttctatcctctcccaggcagcggctgtggctatggcggtggtgacaacttggcttaaccgggatagatctctggtgctggagatgcctcggcctccgcttttggctcccgtacaatctcctccaccgcactgaagggagccaccacaaccccttcaccccggtggcttggccggtgctgcagggattcgccgtgctggtgacgaagccgaggaccctgactgctcactcttttccaactggtaccccttttgcttttttgcattgggatttctcaattttttgggaagggaaaatgtgcgggatttcatgttgtagggcctttgagtttgtgttggatccaaacatgaattgttgtgtgcaatgtagctaccttattgttgtggattcagatgtgataaatgtattttatttgttcttccatgagatgtaatgaatattcttgatctttctttcatggcttcttgacactggtagagaaagcgtttgtagtcccggttcgtaatccccctttagtcctggttttcaaaccggcactaccaatccgggactaaagatcgctatctttagtcccgggtgaaatacatgcactacttgtttcaatacatatatatgcacataatatatatatatatatattatatttatatatgtttcaatacatatacacgcataatatatatgtatttatacatatatatgttatgcaaatgcatatgtatatatatatatatatatatgaaagcacttaacattttatgtgcatatatatatatatatgaccaaaatatatatttacattaaagaaaatgtgtacatgcatatagaaaaatagacatgtattaattacaatccattatgatgtcctagctagctacgattttgacgtagtagtagtcgttatctcagaagcgctaaggacctatgaattgtatttccgttgtagtagaattcacccttgggatcaaggatttgttcgttgatgaatcccatgagttgttcttgaaccgccgcgataaattccttgtgtgtgatcaggttatccctcatgcgaataaactataatgaatgtatgaaattaattagtaactaaacaacaaatcaatacgtacgcaatgaaaatttgaatttatttgtacgtacatcgagctctcttgtggtgatgatttggtttgcaaggcagtggcaatactcacacacgtagtagccgcacaagttagttccctgcttttgctttgcgcactacaaataaatgacaaacggcgagagatctaattaatataaatgtagagcatgtgtactcacaggaaaattgaacttccgcctaagtctttctctccatttgccgcggaccaaatgacggaaccgataccaagccctacatggagtttaaagctatgattcgtagtagcaattaattataacaaaattcttaattaacataggaacttatgacagtacctgtctataagttcgaaaaccttgtcaaacgtagactcttttttatccattgagtcatatacgttgacggtgcaggcctccaggtcgaagagtaaaaggacccagtggaatctgcaatgtgcgtgggatacattacatatgaaacacttagaatgttcgtacgggaatgaaatttggtataggaagacagtaaaattaaactaactctgtgttatatggcaatagtatgaacgtcttgtaatgctgcgcctttaggagatggacgagattgtcctctgtggcttgcagatactggtcgagcattgcgacgtttactttccgagggtcgatgaatccaatatcgaaaaccccccgccgtcggaccctttgaatctccattctacaacgataaaaggaagtatatattatatatagtctgcttatatacaaggacctaattaactaaaggaaacgtaataagaaatctaactgaacgatacttacaaaatccagcaactcataatagaggcatcgagggcgtccagctggtatagttcgtagatacccttgaaattgatccagagaatgtcatctccttgcaagaagtccgtgtccctgatcctcgctccgatcatctctctaccggtggcactcatctccatgtacagttgatggaacttgtacatttgtgtgggtaaggactgcagctgctcaagcttgacaagcggtttaccgagttcgtacatgtatttcacttccgccttttcgattggtgcgcctcgtagcaattgatccgtagttagcccggtgtcagtaataaatttttctattccaaaatcttcaccagtcaccaacggctcgatctcctggtttggttgctctccaagctgagggactagtttggactttccagaagatgctttcttgagtgttcgctcatagtccgatagctttatggcctccttggcacgtgcagacatacccctgaagaagttcctgacactcgggtctataggaatcttcttttctggacttcgaggcttcaattgtctcctaacttccgatgccacataagcgtcaagctcctcttgcgtgcaatcgtaccccgggtccttgttcttggcggcgtcaactttcgccttcttcgttgcccttgtgggggcaggcgatggagcttggggggcccttgacttggaaggtgccagacgaggagcttgaggaggagtcggtgcaggagcctgaggaggagtcggtgcaggagcctgaggaggagacggtgctggagcatgaggaggagacggtgcaggagcctgaggaggagatggcggagctggaggagatggtgcatgagatgccgcttgtcgcccagggaggatgatataccgcttgcgccatagtataatggcgtggcttgtgtctcgtagatgcgtctcaccgtctcctccagggtaatccaactcgaggtcctcgtacgcaccttcgaccaactcaacttcgaccttggagtatcctgctggaatcggcctgcagtggtaagtacctgaagggtccattgggatggccatgcccgacgccaccttcacgtggtgagaggttatttattagtaatcaacatatctaagcagcaacttgcggaatggacaaatctaaaatctgtaaactacgagtttacctttattgataagttgttgaagggaatatgcagctcacatggtgtccgctgagtgatgtcatcaacggggcaagtggtttcgtcctgggtttgcatggcgtccatgctctgtgatcctacctgccccgttgaggcgcagctgctacgacttcctgaagggctcaccattgcaggaggaatggttggctggggatcatgggaccgatgtgtggccatgcgttcatcaaccttccttgccacctcctcttgcatgctgagctcgtagctcgataccctgtactcaagatctgcaatcttcgtctcggtatctctcttgctcctcatccgactcctgtacgtgtggatgtcctccttgaatccaatcttccaaggaatcacccctttccctcgtgttcgtcctggatgctctagagtctgcagggcgagtgacagctcgtccttctctctgtcgggtcggaacgtgccttgagaagaggcttccactgcatccgttagtcgacgcgcagcctcgcgtatctgatcgctgaagaccagggagccatcaactgggttaagcgtttcaccgtgagcgtagtaccagaacttcaatcgatccggccatttagcggtggccggttcgatacccctctcaagcaagcttgcctccatctcctcccacttcggcatcgcgacgctatagccgcctgaccccaagtggtgatggtacttcttcttggcagcattttctttgtttctttccatcatcgtctgcccttgttgacctgtcttatatgcaacgaactcgtcctagtgatcccttagctttgggaatgtgtcaaagttcggtgtctgccccttcaggatatatttctagtacagatctcccttgaagctttgaaactgttctgccattttgtctaaaagccaccttttcactttgtcctctgtacccgcaggaagggtgaatgtctcgagcattgtggaccacaccatttttttcttcgaatctgggacaaagctctcatgatctccgcgtgcccttgttcttcgccagtacaccgtactgacaggcacgttatcccgcacaacccaaccgctgtgacgtacatagttcttggcggctttggccggggcactaggacgtccaacttcttccactttcgttatgatgtgccgaccctcaagcttcttcgctccacctcgttggccgcgtgccctttttttgtccaacggagggtttgactaccactagcctcctcctcctggttcccctccacatccctttccacgtgcccctgctggttcacctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgtgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaacttaaataatattacatactaagactaaaatagtcatgtatatgctaagtgtttcgtgcgtatatgctaagtctaattaagactacaatagtcaattgctacttgtcgcaccaatgccgtagtcaataattacataccaagtctaattacaaataaagtaatattatattaaaactcaaataatattacatgctaagactaaaatagtcatgtatgctaagtgtttcgtgtgtatatgctaagtctaattaagactacagtagtcaattgctaggagtcgcaccaattccgtagtcaataatgtcatactaagtctaatttgcaataaaatatt

SEQ ID NO: 61970 - DNA, 1807 bp, Oryza sativa
tatagggcgaattcgagctcggtaccgttgtccaactggacggcgccagcctctctggcgccgtccccttgccgacgtggcggggcgatgctgaggtggctagggggagcgccgccgtccccttgccgacgtggcggggcgatgctgaggtggctagggggagcacgccagagtggctggcgcccccccccccccccgggaaattttttatttttgttttatttgtttgatatttttttcacgcttagagacacacaagaaccaaccatagaaaaaatgaactcaaatggacgtaatatgtgacctgtagaatttttcctctcctctcctctctctctccgaactagtgcagaggagagagatgtgcaacttttttatttttattttattttttgatatttttttcacacttaggaactcacaagaactaaccatataaaaaataaactcaaacggacgaaatatgtggcctgtgaaattttccaaagctctaccgaaaaacttctctcctcgaaaacacaatcttgcaagcggaatttggaggttctaatatcgccgaacccggcaaagcagggagaattggatgtaactttttctgtagatgtccgtggatatattatttgcctgattccgagtctgtatgagaaagttacgcctattttaataaatgacatattttgtccatttcggtagagctttggaaaattttacaagtcacatattttgtccgttttaagtttattttttctatggttggttcctgtattctcctaagtgtgaaaaaaatatcaaaaaataaaataaaaataaaaaaactgcatctctctgtactatttaacttatggctatcatttcatgtggttatattttgaattagagattaagtaatttcatatagtggtagagtgtattatatttaacatgctgatcaaaggttttactaaagaagttatggtctaattctgatgaaggtgtaaaataggctaagtggtatgctattttcggatatctagctaagtggtatattccgttcaagtttaatttttttttgtggctggttgtatcgtatcctaagtgcgaaaaaacatccaaaaaaataaaacaaaaataaaaaggttgcaatatagagaaacaggaatggaggcgaggggtggtgggggaggggggcggcgccagccatgctggcgctctcctccctagggcggtgcaaccattttggcgccctcctcctgccacgtcggttcgcgtgtaccacggtggcaagaggacggcgcaagagaggctggccccgtcccgttggacgacggcaccagccactctggcggcccaaaaaggaccatttctgggataagtttttttaggggtctatttgcgaaataagttttttaaaaggaccaaaatgtgaaaaatccagtgcggagggcagccaacggccggcgatgaccctgctggcggcggcacgaggcgtgatgggggaggtcgagacggcgttgggagcgtcggaggctcgatgcgagatgggggggagcgagagtgcaacactgggatcgagataacggggggatagggatctaaggttaatttgtttgcatttatacctggtgcctagttgggctgagcctctaaatatttttgttggactgccttttgacttgacctcgtttagctagtgagctggctcgttatgacaagggataagttcacattgggtccctctatttgtcgcccagtccgattttcgtcccttggtcgcaaaaccgggtacaactggtcccccaacttacgaaaccgtttaaatgaggtggcg

SEQ ID NO: 61971 - DNA, 942 bp, Oryza sativa
gtctaattttttaaaagaaacattgtagcttccattttttagaaggagcaaagaaatctttaaataaaggaatggttgggcccaacagatgtaaatataaacaccataaataaaaatttatttggggaacaaaataaacattaatagaaatttaaatttgataatcctaaacaaaactctccgtattaattagattaaacaagggaaaagaatatagatttttagaataaaatgaagtaataaaaaattaaaagattcgaaatctaaagtatatattaacaaattaaaaatagtaaccttagacgatttaaataaaaaaactaacagaaatataaatgctcaatataaagaggagcgaaaatataaacataaataaaactatatttttgaaaaaaaataaaaagaaaggatacttttaaataaaacaccagaaggaataaagggagatatttagaaagaagattaaagttaagtaaatgaaagagtattttaaaaatgataatttaataaaaaagataccaacattaaattgatataatatatattaaaaggaaaattaaaagatatagtacccttttatattaacaagtttattacagcagaaattggaaaaaaaaacccatccaatggtttttgacccccacccgggactaaagatctaggggtatatatattcccgatgcgcgccctcgtcttatccaccaacacttagaagttttttctccgatcgatctctttctcggcttctctttcaccgccactgcttacggcatccccgcaccgacgccgccgtcgtatctcgccgtcgtctcgcgtacgtcgtcgtcgccacctctgccgccgccgcatctctggggtgagagccgccgccgcctccctctctctctcagacctcaatctctctctctctccccaaaccgccgtcggccgcctcgttgccga

SEQ ID NO: 61972 - DNA, 5267 bp, Oryza sativa
aaaatattgttgcatgtttatagattttgaaattttaattttaaaattacattttgggacaaaaaatgacttaaaataaaaaaattcaactacaaagttgtagatcgcgtcgaggactacaagtttgatataaagtttgtctttattagagttcacatgaaaaagttatgaattatttttaaatataaagtctttaaaccgtcctattggatctagatgatattcaaatccaaatttagagaccggggtgacacaactgaacaagttggaggacctaaacgagtgatctgcaagtttagggaccgggatgacacagttgaacaagtttgaggacctgaacggtcgatttgtgagtttagggaccgggatgacactgcggtacaagtttagggaccggcgatggactttactcttgttaaaagcaactctaatgataaaataaatcataataaatgaaatgatgaatatataactttttaaataaaataaatggtcaaacatgatttaaaaattaactgcattaaaccgtcacgttgcttctcccgttaatccaccgcccactagcgaccaagcttattagttatcgggatactaggtagtatcgttttgcttaaaatagtatcgtatcgcagtatcaggatactatgagattttattttttttaagtttaattaatatttatattaattatgtatagctattctatataaaaatatagtaataatatatgttatgtaaatagagacatttataagaaaatacattatgtttgatatatttaactgatttttatataaactagtgcatatttatttaatttattttcaaaccatcttattttaaataacattttatatgatcgtagaatcgggatattacctaagatttcgtaaaatcatatggtaatcaatagtaggatcgggatattataaaaattaggatactaagtgggattgatattgtttcatcttggtaggaagatactacgatatatatggatcgcaatacttacaatcttgctagcgaccagtgttttagatcggagttgataggcatgaacagtgcgtcgtcgtcaaaggcgagcgccgtgacgaataatgcggcgacagtggcgacagagaagagacagtctgctccgatcatcacaagtcgagcatcgtttccccggccaaggcggcggcgacggtggaggtagaggagtgcaccggtcaagagggccagtgtacatggaggaggaggttatcagggagatcctgacacgggagaggaagccgctgccatggtcactcacggcagcggaggatgccaggcctggctgattggcgatcagcagcgcgcggcgcgcggtcagttctagcctcttttagtctccctcctctacagttcatacatatgtaaatagagaaaaactaaaggacggtattccgttctcccgacagtatagattacgatttctttctacagccagcgcccactccgtggtgttgtgtgggccctcctcgagtcacgcgcttgtcgcccatcttccaagcgtatcacatttctgctcctaacctgcctagcagagtgcatgtgcatgttcattcggccacgtatggccttgttcatttgaccagaccaaatatactttaagatagctttgtagtactaatgtgaaatcacagtaacaaactgaaaaattcagtatttctatacaattttaaaaaaggataccggatgtatgtgatacacatgatactttcacagtaccatcctaatacaccatatgtatcatcatatctcaagagtataggtaccagataataccctcgagacatcacccggtaccatcgaggtatcacctaggcactcggtgttgttaaggtatcatcgtatatccggtattcttaaggtatcactcggtactcttgaggtacttttaaggtatcatcgtatatctggtactctcgaggtatcatccggtaccatcgaggtatcatctaggccctcgatactgttacggtatcattatatatctgatacttttaaggtatcactctaaggtaccggatatatgatgataccttaacggtaccaggcccgatgatacttcgagggtacctgatatatgatgataacttgattgtatcgggtccgggtgatacctcattggtaccggtgataccttgagagtaccagataatatctattgaatgataccttgagagtgtcgaatgatagctagctcaagggtatcggataatatctcaacattactagatgtgtaccgtaaaaatatcacagagattttattgtcatcttatatattagcacaaccatctagcacataatcgtctaactaaagtacgtagctttagacggaaagaaatagttagcactttattagttaaacatgtgcactgcaaaattttaaaacaatagaaacaagtctacaatcgatgccaacagagacaggagcacgtgatatgtccaagggttggctgcgtgctgcactgagagcctgacagcgaggtgcttgtgagcatcgtgccaggatcagacacgcggggcttcgagtcatggggaatcgtacttgtgctcgtgggtgtatagagaggtataccgtcaaaacggtataccgtcctctagttgctctctttttgtgtatatgtataaaaaatatatacacaaataaaaaatttgtatacgatgtatacaaatacaaagtttgtatacatcatatataaagtttgtatatatatgtatacaaaatataccaactttatatacgtatatatacaaagtttatatatgtacatattagaaaacacatatacaaagtttgtatatgtgtatacaaactttgcatatgtatatattaaaaaacccaaaaaactgaaaaaatatatacggatagaaaaaaaccgtgcgaaaaaaaaccgcagaaaaaacagaacaaaccaaaaaaacgaacgtgcgagaaaaaaggaaaccgaaaaaaaaagaaaaccgcaccgccgcctgcgccccttctccgcgcgcgacacgtgtccagtcacgtgggagaggaggcgcgcgaccgatcgcctattagcgttctcagaggatgctgcccagttcaagagggagtaggactgatccatgcagtaccagaccagggtgccactagggagggtattgtgtaacccatatctatacccaattttaaccattcacatctaaaaaaatatctatacccaaattaagtggatattattcaatgggtaggggtaacctaatgggtaagagaagagacatgtgagtcccatatgtagaaatggaccaaaatttgtagaaaattgctcttttatataataaatcatctctgtaaatttcaagcaaaattgataagattttataatgtgaatgtgagtttaaaaattttatgtcagatttttacccattataaacgggtatgaacaaagttcttcaaatatgtaataacctccccatatccaaacttggaatgataacttttctacccataccaatttaaatgatagcttttttatctacgtagtatatcttacccaaataatatggacatgaatataaggatttttaatgaatactaggtgacagacctacgaagaacgaagcgcatagttgtgtccgcctcccaaatgactacggctgtgtttagtttctgaaattggagagaagtatatggaaagttggtagtttgaaaaaaaagttaggagtttacgtgtagaaaaattttggatgtgatgtgatgaaaaattgggagttggggaaagtttggtgtgaactaaacacaccccacaataaccccaagaggttgtcttgcatcacaactgtcttcagcgtggagtacgaggtccatggagtaccgcgctaacaagacacggggcattgagactgtgagaggtataggggattgtttagggcatgttcactttaatgctaaaaaaaaccttaccaaattttagaaatactaaatttttagtaacttgccaaaattttggcaggatttcttatatagttaccaaaatttggcagcaaactaaggacatgttcactttgatgccaaaaaaaccttaccaaattttgtcattgctaaaattttggcaaagttgccaaaattttagtaacttgccaaaattttggcaggatttcttatataattaccaaaatttggtagtaaactaaatgtagccactttttggtaactttaccaaaatttggtaaggttgaaaatggcattaaagtgaacaggccttaaatgtaaccatttttctttggcaactttaccaaaatttggtaaggttgaaaatgatatcaaagtgaacaagcccttaatcttttttttttgtttcgccgggtcagtgagaatgtgagagattgtgtcagttattttggccccgcttagttccccaaaatttttttccaaaaacttcacatcgaatctttaaacacatgcatggaacattaaatatagataaatgaaaaaactaattgcacagttagggaggaaatcgcgagacgaatcttttgagcataattagtccatgattagccataagtgctacagtaacccacatttactaatgacggattaattaggctcataagattcgtctcgcggtttccatgcaagttataaattatttttttcattcgtgtccgaaaaacattttcgatatccggtcaaacatctgatgtgatatctaaaaattttcttttcgcgaactaaatgggtctttgttcgctgggtcagttatttcatttgaattggctggacgaaaaactctagctcgttagctcgctcagctcgtctctagcttgactagactgggcttggcttgtaatgaattcctaacgagctgaggcaatgctttagttcatttgtcataaggaataagttcactttgggtccctctatttctcgcccagtccgattttcgtcccttggtcgcaaaactgggtaagataggtcccccaacttgcgaaaccatgcaagtgaggtcgctcggcggtattgtgcccggtttttgctgacgtggcgcctacgtggctcctttgattaggtctttgtctcacgtgtcattgaagtggcgcttacgtggcaattagatccgaaaaaaaaacatcaaaattcaaaataaaaaaattatacaaaatttgtgggacccacatgccagtaaaaaaaataaaaaagggacccacatgtcagcgggtcccactttttcaacctcatctacctctgtggctctgtatgcttcaacgac

SEQ ID NO: 61973 - DNA, 1605 bp, Oryza sativa
  unsure (1)..(1605): unsure at all n locations
ggaagctcaagagtcgacaaatgggtagcangnatgaaatgaatgaggacggtaccacgatgancgtctgaagttgtcagcacgtcttcgnccgtcacgtggttcacacgacncngaatgacatccttaccacgttgttgagcgggaaggcgcttgcccttgctggcgcctcgactttgggcatttgtccgcaaagtgcccgggctcgaagcagttgaagcacaaacgctgcggaccttgaacgtccctgcggccttgaccagactgcgcggctggcgtaggaggacggggcgcatgggtcccttgctggctctgctgttgctgcggctgtgggacgcgcaccacgaattgaggtcggggcgcggagcgaggttgctgctactgttgttgctgctgcgaggaggatccccctggatagggattggtgtagcggatcctttggttagctccctgttgattgcgaaaattcgccaagcgacgcttgtgcgactccagttccttgtgcttggcttccaagcggatgctcttgtccaccagacgttggaaatccggatagtccccggagactagacggacggacagctcaggatccattcctgccaagaacttctcctgcttttcctcatcttcccgtacatcctccggggcgtaccgggccaggttgttgaactcatgcaaatactccatcacggagcggttgccttgcttcaactctcggaactcccttttcttaagggccatgactccggcgggcacatgggtcctccggaaggcggcggtgaagcgggcccaagtaataggttgccccactggctgcgtagcctggaaatggtcccaccatagagatgcgggcccctgcagttggtgggcggcgaagatgactttctcctcatcgctgcactgcacggtgtctaactttttccccacggcatgcaaccaatccaacgcatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctgggcgaggatttgggtgagaatggcgttggtgtctggtggtggtggtggaggcggtggaggaggtggaggtgggctgccatggttgttgtggttgctgccttcaggttggttgccatcactggtggcagcatttctcctggtcgtcaccatctgaaaaccccacacagaaccaccaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgccccacaagaccccaacaagaagacaaacgagaaagaacacacgcgcaagcctactaactgctcgtctaccgctgcgacgggccaggacggaaggtgagcaacagcgcatcctccgtgctactgacgccggaggcttccccctcctgaggaaccacgggcgcgggctcggcacg

SEQ ID NO: 61974 - DNA, 12123 bp, Oryza sativa
  unsure (1)..(12123): unsure at all n locations
gtaggcgaccgcttgcgatggtcagggggcatataagcccccagcccaaccgttgccatgaatttccggcgtttctctctcctaaacatccacaaattagggaggaaggttttcgacctcaaatctttgattgtgttccatataaaagatgtagagcttgttctcctccttcatttgcttccatttttgtcagttttcattggtggatacgaagaaacttgcacttttataaatggaatagtgtaggcacatttttgttttttatttttttagcaaataaataatgcaatcttttacttgtttaaaaaagtatttagtacctacattgaaaagttgggtttgcctgtattaaatttattttcatttggatgaaaggacgattatttttattttttagaaatggacaatattatattaatgcttaaaattgttgtgcggttgtttaaaaagtccgtaaaattttaaattactaggtgattagttccctccaatttaaatacattcgtgtttgaatcggtcatggatgtattaatgacaagctttattgtaggtcatggatcggacatggatgcacaacacgaaaagagctcatccaacattcttgaaggaagcagccaaatttgttgagctcgtaaaggcacatgctgtgagggagaatttgaggagcattttttgcccatgcaaagtttgtaagaacgaaattttgctgtaagatcccaatgaagtattgtcgcacatcgtagaacgaggatttaagaagggctacgagatatggacttttcatgcggaagtcggtggtcgtaacgaagagttagatgatttctgttatgatgatgcagaaaattttataatcgaagacatgtcacagggaaacatcccggaatacggtggctcaggtatagagaatgaaggtattgattttgatctggaagatatgttacggcacgttgaaccagaggtcctaactggtacaagacgagggttggacagttgggaagcgttgaaaaaaacagcgaaggagcttctgtacgacgaagccaaaggatgcgacaaggactattcggtcctacgctcagtgctcgaacttctcagattgaaggccagacatggatggtcggacatgagcttcaatgatttgatggatcttttgagagttatgcttccaaagccgaacctgctaccgacgaacacatatcaagcgaagaaattgatatgtccattgtctctaggtgttcagaagatccatgcatgtgaaaatcattgcatactataccgcaaggaattcgcggatttagactcttgcccaacatgtggacacacacaactctattggaacaaatcacccacatattttggaacccctctattaagggaattcgttccattatttgttccgccaaaaatgtttcatctagtgtactaagaatgtttcattatgtatagacctaatgttgtagtgaacgaaacattcttttgcaacaaatcacctacatattttggaaaccctctattaagggaattcgtttcattttttttccacaaaaaatgtttcaccaagtgtactaagaatgtttcaatatgtatagatctaatgtttcactgaattgaaacattctttcgctatttgttgaaatattgtttttatataaggtgaaataacgcccgatttaaacgattgtttgatctacctagtgaaataattccgatatacttggtggaacatcatgcaacatttaaaaataattcaataataagctaaaaaaattgttggaatatatccatgtgtggtcttgttttgaagatttaattggaacgaatttaatggtgcaatcggatcatgatttggataaataatttaagagaaaaattagtttaaagtagttttgcacgtatatctggttttttacggttgaggaataggaaagaaactcgggaaaagctagttagcgcgcgccggcggcgcgcgttttaggcccagaaggcccagcgcgcggcgccggcgcacgcgtgcctcctcaacgcaacccattacgagtaagacgagaatccaagacgaagtaaacgtgattagcagcatgattacttccaacctttttaattaagccgtattagaaaatttaattagcgacatgattagtcctgaattattttttcatgtaattgcaccgtttagaaaacgtaattagcatcttgattagttcctatttttctgtaattagaacgtattagggtctagttggtttttctttgaaatataatttaatttaagactttgaattcaaaattaaaaaccttcaacactaatttaaaaactttcaactctaaatttaaacttttcactcaattgaaacttttcaaattaaaatttgaaaaaatcaaatcaaaattttaaaactttcaacacaaatttaaaaactttcaactctaaatttaaacttttcactcaattgaaacttttcaaattaaaatttgaaaaaatcaaatcaaaattttaaaactttcaacacaaatttaaaaactttcaactcaaaatttaaaaactttcaacttaaatttaaaaactttcaactcaaaatttgaaaagtttcatctcaaatttgaaaactttcaactcaaatttgaaaactttcaattcaaaattcaaaaactttcaactcaaatttaaaattttcaattattcttttaaaacttttaactaaatatttatgttttttaaatatttaatgctaattaccatagttagccctaatttactgtaattagtgttggctatgtaattagcgcttcgtgctcttcgcgcttagtgttggcctagaaggggtgccttcgtgctcgctgcttctgtaaccggcgcgcacgtgccgagtaggaacacccaagaaactcgagctggatatgaagtaaactttttccttcttgtattccaaccccaattcgaccgactgctaccattgagcccagcctccatccaggccggcccatttcgccctagttggcctcataaagcccaacccacccactcgacctccgcatttcacccctcttggcctcctctcctctcctcttccaccaccacccgccgccgccgcctccgccgcgtggttcgcctccgccgcccgatcccctcctccgggctcgcgcctcgagccggagcgccgcaggtgagccagagagtccccccgtcccccgcccttccttcacctaactctagggcccgagcgatctggtgttctggtgcgctagggttctcgcgtggggggttgggttggtcgaccgtgctctccgcgatctagggtttgtggctagggcggctctgagctgcgcggaattttattctgttagggggtcctgctagtcgacagctgatatgatgtgtgtggttgaagttattacactttgacttgttcatgatgaaatataagactcttcgatgcttcgttttaagttatactccttattactgattgttcatatgtatggcctttcattgttggattagtttgtagtacttgccctttttagtttactgttgattattagtaatattgcatcaaggatcagtggctcgatttaaataataatggtactaattttctgtaattgggctatcagttgggagatggctgggtatatgtcaagaggccccccaaatggctctgtttatgtgtgcaatctgcctcctggaaccgatgagaccatgctggccgattattttggcaccatagggttgctgaaggtatggatgggggtcttcccaggcaacatttttgtagctgattaaaagattcttcaagcctttgtcgcttcattttcatggtaattagtcattttctgttgttgatctcaacagaaggataaaaggaccggtcgtccaaaaatctggatttacagggacaaggttaccaatgaaccaaagggtgacgcgacagtcacctatgaagacccacatgctgcttcagctgcagtagaatggttcaataacaaggatttccatggaagcaccattcaggtccatatagctgagtcaaaaaacaaagacacatatgacaactcggcgagtttgaacaactctgctggccttggtggacaagatgaattggacaacggggcaggcagagggagagggcacggtgatggtccaggaaaagcctggcagcaagatggggattggctgtgcccaaatacaaggtctgttttgattggtaagaggcttccctgtcacttaatttcttttgctgactactatagtagtatggtcatcaccgtgtattcaaaatcctgtctgatattgcttcctctcccagttgtggcaatgtaaactttgcctttcgtggtgtctgtaatcgctgtggagctgctcgccctgccggtgttagtggatcaggtgccggtggtggtggtaggggtagaggccgtggaagtgacgatgcaaaaggaggcagccgtgctgctgctgttggtggtcctcctggactgtttggtccaaatgattggtcatgcccaatgtaagaatacccacataagtttgctgtttcatgacttcttctgtccttaccttatttgtatttgttattagctgttgcatgcctgcttgatgaacccaattgtgctgtgctctctatgactatttatgcctgttcaaatcttcaatattatttctaccctgtgtttatgcaggaattttggagaagcactaaatgttggtaatcaagctgttagaaatttaaatttcataggtgttataactcaatcatcttaaactttagtgactgaaaatcaattttgcaatatactccctccgtcccacaaagactttatttctagcattcaaaatttgtcccacaaagacttcatttctatatgttgcagccaatcaagctaatgcacgcacatttaattggagcctaggaaatacaaccaagagtattaatgaggggtaccatagacattttttctccctactactaatttgtctgaaaatcgctagaaatgatgtctttgtgggatggagggagtagttattagtgaatggtgaccttgtaatctttcattcttgttactaacctactatggggtctaagcttttcaataatgtttcgtcaaaccgttatttccattaacacaaatattttgtaacttcattaggatgatgacctgttggtgtctcctcagtcctatgggattgtagtactaatattatgtattgactaaattgatcaacagtaataaaagcatcatggttgtaccatgtactatattataaaaccgcatatgtgatgataaataatttaatgttttccaggtgtggcaacataaattgggcaaagcggatgaaatgtaatatctgtaacaccactaagccaggtcacaatgaaggtggtgtgaggtaagacatgcacaacctgcatgtggcatgttcattgctttgccagttaaatagtcgaaatgtattatttgcctttgctttggcatgaactatggtgagcaatttatgtaaagcaaagcactacatttacctgtcctgctcatgtctaaattagagtacactcatcacaccctggtttgtggtgactgatttttggctataatttggcagactttggaatgtagttgcctcaaaaactggttacacagttactcattggcattcttttttttttcatttttggcacatacgaatagcatggtaactacagtgctactctgttttcttgtaaacagttttgggcttttggtctcatttgagcaacactagacacaaattagagcgatatgctgttgcattttatcctatttgtttggcatgactgtctgtgaacctgtggtgatgacaattagtgcacctagctgacagtcacacggtgcaccttttgccagttgtaatatagagttatgacaacacaattgggtgcagtactgcagtatgttgttatgacaacatagttggggcaccatcagtggaaacgttccccatttattgatgatttagcacctttgaaattcaacttcaaactcaagtatcgaaataaacatgaaaaggaagattattatgatgcaaagtttttcctttacttttgattgacttcctttctgttaatctttacactcaacatagaatttttaacacaaaattgtacaaaaaggcatggtaaaatgagaagtgcatgtggttgcattacccataaaatcaactcatgtaattgttaattattatacatgaaattgtaagtctttcaatcatgagacttttctcaccaattacatttatttgcagaggaggccggggtggtgggtataaagaacttgatgaagaagaactagaggaagttaaaaggcgccgcaaagaggctgaagaagtgggacatgttatttgatgtcccatgtgtcaagtcatgagttttcatctaaatgttttttttcctgtataggatgacggggagatgtatgatgaatttggcaacctcaaaaagaaattccgtgctaaaacacagcaaactgaaaatgcaccaacccttcctgggtctggacgggctggatgggaggttgagcaacgtggtattacatgctcatttcagtttcttttgttaattaattccgtttgaatttgtgtgtagtcctatcacatgttcttggtaaattatttttgtagaggactaaacatttgctatgcttattaacataggataagttcaaactacacctactttatgatttgtacttgtgcacttaacaaatcacaaaatagatacacatagttctggacaaacaaattactttctggcacagaaatctgatttaccccctttttgtattggacatgataatatttttccatcatcattataggttcaactagaagagaaagcagggaaaggagcagagatcgaggcagagaccatgactacatgaacgggatagcaggaacagagatagaggcagtcatgggagagagcggcgccgaagccgaagtagaagtagagaccgtgagaaggaaagagggagggacaggggcagagaccacagctatgagaggagctgggagcgaggagccgagcgtgaccgtgatcgctataggtgaatactttatgccaggacatcacacgctgcatgccgattnttggttttccgatacttctgttttgtggctgatagctatgctgcttcagctatttcttgtggatgcggttgcacattgtctgtcttagcctgatgacangttatatcttcggacttctcgatgaactagaccactaagctctgattaaatgtgctatgtaccttgggagtattttcatgtaagatttaccgtgaatgctgtccacttgnanctgggaattatttttaaggatattggtttggaatccacntcgtctcaccggttgttgggtatatcatgcaagacttaattttactggtaatttggattttcgtctagtggattaacatactgtcacagttagccaattcaacctcgagttggtaacttttccctcttgttttattgctgatggagtcacaatcttggagatgaaaccaggaaatgaataatatgacactagtctctagagccatcatcatgcattgacatttccaatggtttgtgtccttgtcagcagcagtagaatttgaattgattgggtggttcttatctatcatgttaaaaattttcaggtgttatatcggatgtttgactggatgttggaaggggttttcggacacgaatgaaaaaactaatttcataactcgcatggaaaccgcgagataaatctttttagcctaattaatccatcagcacatgtgggttactatagcacttatggctaatcatggattaattaggctcaaaaaattgtctcacgattttcctcttaactgtgtaattagtttttcttataatctatatttaatgctccatacatgcatttaaagatttgaagtgatgtttttggaaaaaacttttgaggaactaaaccgggccttaatacggctcctatcatatccaaattacacttggcaaatgtcaaaaaaaaattacactcggcaaaccaaactgctcggagaacggataattacacctcctattgccaaatgagggttaaatacaaacaagggttttttaggctatgttatgtcagtttcctgatgccacgatcgtgatttgtgatttgtgcttgaacagttcaaaagtactcgtagagaactactgcatgatgacctctatgttcctacattccgaaatcgccaacttgcatacgcataagaaaatctagcatgattcacggaaaataatcctgtatataaagattatatatctagatggtcttaaaaagcattgttgacctttgtttttttatgtacatattttagtaaaaaataattatataaaacaatttgaaaaataccacaattccaaatactatttctggtattgttttgttcaaagttaataaagtttgattataacattatttgttgaatctgtgtatatgtcccatatacgccctattcttttcatattatttcatcggattattgaaatttaaattatttgctctaaagcttcaaaagaaatatgtttttttaaagaagttctattcaattttgaccacttgttttaagctacttatgaagtttataatttgaaatatttaatctatccctataatcaaatagataatccctacaatggctaacaatctttccatccagggagctgcacaataaatcataattaacaagacatttccaagcatcctttcctagagaaaaaaaaatagaacccctgtattgtatttctttaataatgaaagtggtttatatctcaagccctctacgaatctaccatgagacacaactaatattacctcaaaatatacttaacaatttaaaggtctcatttcatcatacagaagacagagaaacccacaccttcgctggacgttccaagacaataggcaacagttccccatccactcacatgccaacacttttttgtgtctttgtccagcttgctcaagtgcacaagcaaaaacagccatcatgcacacatgccatcgccatcaccggcatcatcagcaaattcttaaatcataataacgccgagagtttctgcttaatgataggaattagattctctaatgcatccttaaactgttggatgacagcatgagtagtcatgtgctgtgatgcacacaaccacacggtttatttttttctgtcttccatgcttggaaccttcattggatcaggagctttcgttttgtgttgggttggaaacttggaatcttgacatcaacaacagtagccagattgttggacagccaattccacagtactgtgaaaagttgattggtcacgaatcacaaatgtcactgattttatatatcaaaattttggtgtaagattgtagatacagtaggtaaagtggtgacatgagcaaagagttatattgctgattagtttataacaaacgaaaaggagtcgatcgtgtgactatagaatccctatttaagaccaagagttcaatttaaacgattggagattcatgcaaacatgatatatgattgaagaaaaaaagaataaaactttaatacttctcttagaagagcaaaagttaagtagttatgaaagtaaaacatctttcaggggggggaatggttttaatcaattccgttttaagcgggatagctatgttcatgttgtctttctttgaggttcctaaaggtattctcaagaaattggactattatagattcctttttttttctggcaatgtgatgaacacgggaaaagatataggttggctaggtggagcatttatgccaacttaaggaatgtggaggtttagggatacaagatttagaattgcaaaacaaatgtctacttagtaaatggttgtacaggcttttgttgaatgaggatgtgatttgacagaatttattgaaaaggaaatatttgatgaaaaaaaactttcactcaagtgaaaaaacaacccggggactctcccttttgatcatgacttatggcgtctaagaacgcttttctttcatgtggatccttaaaggttcacaatgggacccaagtgagatttttggaggacagttggtgtaggaacatctctttggccaatgaataccctaggtcgtataaccaagtgagaaataaaaacgcttatgtggcagtactcatgggaaaaagaccgcttaatgtgtcttttagaagggctactgtggtggttaaccttaaggattggttggaggtagtggcaaaagttttgatggttacatagacataacaaaatgactcttttgtttgggaggtacataaaaaaggtatgttatctgttaatttgatgtacaaggccatcatatatcgtgatgttgtaccaagaaaagaggtgatatagaagttaatgttgccattgaaaatcaaaaaaaaatttatagtacctaaggaaagaggtcattccaacaaaggacaatttggctaggagaggatgggaggatagcactaagtgttacttttgtaattcaaatgaaacaattcaacatcttttctttgattgccctttggctagatttgtttggaatgctatttttatagcttttggaatccacctgcctactaatgttgctaatcttttgggtaattggttttatggagttcttcctaggcttagagctcaaatacttgttggtgttgcggctttatgttgggcggtttggttatgtagaaatgatgtggtctttaatagcttcaaagctaacttatttttgcaggtaattttcaggtagacattctgggcgcaggaatggtccttgcttcttaaagagggagatgtaggatcataaagggcattttccaccccaaaagctagccattgaggtgagagctcccccacttatatcttaggtccttttcccttccacaactaatgtgggactattcaacaatctctcccttcacacattagtgtccctcagcccttcatcgccccttcactgtatacgggccccgcccacggtccatcaggtatacgggccccgcaggcacccacgatccatcaggccttgacacactgtgtccatcgggccagagatgttaaattagccatactctaataccaattgtaggatcgtaaagggtctttcctaccccaaaagctaaccattgaggtaagggattcccccacttatattttaggtcctttgctctttcataaccaatgtgtgactattcaacaggagatggtcaacttgtgaaagacgcgtgtaggaagctggaattgacaatgttagatttctttgctaaatatgggtggaatcaaagaggaagattggaagtttaagacttttctttgtttggatgttgctttttatgctttttgttgcattgtgcaagatgttatgtggtattgttgttagttgagtctaagtacttgtgtgaaaattttggttgtctttctccttatgtaaggggatgagtctaagaactattgtaagtttggttggttgtatacatccgtctctagatgtagaggccggttattccattatctttaaaaaaaagtagtgatgaaagatttgtttgttcagttcagataaaaacactaaagtaattctaaattatgttatgaattcaaaatcagtcatatcacaaataggcatgcccaaggtcaccagattcaaggcctcaccagttcggttggagaatttagattatctaccacctaattcgcgtgcctcaacttttttaccacccaattcgcatgccctctataatatgtcattagaactgctaattgctctatttgataccactttctcagtttttcattatttctcatttcttaatcccatttgattttttctcaaactttatggactgttttgtccctgggcccactgtcaaatgaaaggaagagaaatcctcttctctggatcgatcgatctctcgctgtagcgctagcccgagcgcgacgagctcctccgccggcgagcacctccgtcgccgggcgccaccaccccgccgccgagcgtcgcccccacgccgacgagcgccgccaccccacctccgagcacctctgtcgccgggcgcccccaccccgccgccgagcgtcgcccc

SEQ ID NO: 61975 - DNA, 3127 bp, Oryza sativa
caccccagggacttacgaacaagctcggggctggaaggtactctttccggccggtgatctttttggctccggcaaacacgcaagcgctttgggcgacaaaccctctccctgggcgatcttgagctgatgcagttgcgcctccactacgtctaggtcgttcttcagctcaagattctcctgacgcagctccaagatcttcatgttgttctcgaccatcccagggcgcaccatctgatggaagtcgatacgagccgcgtcgtacgcctacaccatgcgcgccaggtgcatgatggtagcgtcatcctccgagctagcatcccggaaggtggcgtagtcgcgggctcctccgcggcgagggtggtagcggtagggcgagtgctgcaactcgtccaggtagcgctggtgaagagtgccgatggcgaggagagcggcgttctggcaagcggcggagaaagaatctccacccgcggtgactgccaacgaagtcctctcgggtgagccagtgaggatcactgcagtaacctcccaagcagcgtggggctctgcatcatcaccctcctgctccgggagcggcctgccctggtagtccactccatgcggataccccagggcaacgcacatgccccgcagctccaagacgaagctagtcaggtccagaccacgacggctgacgctgccggccatctacaaacaaaagcaaaaagaaaagcaacattttaaaggtcagattttgacgataaatgaagcagcaggacggagagagactagaggattttcacaaataagaaatgatttttattttgaaaatattgctaaggcttgggatctacagctcatcctagggtcaagggggctctgataccaacttgtcacgaccggaaataacccaacgggcgttccttacgtgcgtgcattattccttgtcccaggaggcaaggtacaccaaaagttgatacaattcagagttcaacaagcggaagcgtaaatagttaatttattacatgggcagcgaaggcccagcacatacaaagacaaacgagaaacagcggaagactagggcgacgaccacaggcgcttgacggcaggcacgagctagacaccaaaaccttcatcttccagagactcctcttctgggtttgggaaaaaattgagcaagactgagtacaaccaccgtactcaacaagacacacccgcaagtgcataataaatgtaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagacaacccaggccaaccatttcacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacgggcggaacccccgggacaggcaggcaggattgagccccctagcagcaggacaccagccctgtgccatgacatctcgactaccgggccgcagctcgtgtagcctttatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccacgaatagagtacccactagttggggttttatttattctagggtgaacaaggtaataataacaatagcaataataacgtcttaacaaaggtaaataggcatggctaaataaaacagtgataacgcgggaatttaaataaagcggtaatgcattaatttaaatcaaaataattttataaactgggattcaatatgctcaaggatgatgtgacttgcccaaacgccggcttcaacttccacgaagagcggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattacgagttcaaatggccaagttatggccatttgaagtttatatgctctttaaatggatatttacgaatttcttcatttaaattttaatttaaaattggatttattgcgtcagtcgaggggagggggcgcgcggaccggggcccacgcggcagcctcacggtccacggtggaccgggcgcacgcggctgacgccggccggcgccgtgggtcccacgtgtcagccgcaccgagggctcgggcggctgacggccgggccccacctagcagccgcggggcgcgcccgaaggcggcctcgccggcacggccgacgggaggcggcgcgcccgcgccccgatggtcgccggcggcgacctccggcgcgacggagcggcggccgagagaggggagggaagggggaagtgaaacaacggtcctcggctcaccccgggtcgacggcgacgacggaaacggcgacccaagtccagagaggcggcggcgcggctcgggtcgacgaggacgacggtgctccggcggtcggcgggcgatacggaggagtggacgag

SEQ ID NO: 61976 - DNA, 11075 bp, Oryza sativa
gagaagaaaacggaatacaaaataatagcaggatgattcatggttttttttgtctatccatctaatcaaatttgatcgaaatcacgctaatgatccatcaatgtgcctgatgtttatacattttttgcctgctgctactgcaatctgatatgtgttcagagtcatctactcctagcaatgggaaatttaactatttgccactcttgtgacatggcaattaacgatttgccacaccgtgtctatgacatgtgggcccttatgtgtctatgacatatgggcctagtggcaaatcgttaagcaccactcgtaagagtggcaaatagttaaaagcccccctagcaattgaatgcgcatctatagatgcaaatgttatgtattcgattctttcttcagtgtcaaatttatgccttcgtgcccccaactttcgttcttgattaatgaaaacatccttggcaaatgctttcgtagttgttcgtctttcataaatccaagaatttcacctctgactatgaaatacgaatgcccccgactgtccctattaatcattactccgatcccgaataccaacacaatagaaagaaaaattgaataagacgaatggtaaaaagttaacactgtcgtaaatacggaaggagtacgtcgaactagcttatgtaatttacatttgaaaattgaaaataaaaattacaaacaaatctactcaaagttacattataactataatgcaactacactgtaactataacataataactatgctgtaattttttaggtaggcgggccgatgctataatgtaattttctctttcggtgttgctcaagtattggtttgttgggtagcgaaaaaccttcactgcgattgtggtatagtagagaatacaatgctcctgttgtagtatgtattactcagatggaggtagagcttaatgattgccgtgtgaaaaagactccgtttgtgttttgggctttctccaaaagccgggtcaatatatttgatctgatttcaaaaaaaaaaaaatgccgtgtgaaacgtgatcgaggagttaaacttctgtacatatagagagagagcaaacaaatgcacggcacgtacaacgtcgtatactcgtatctaagtaatctaaggaacgtgaaaaacaacagattcgtcaaatttctagcagatccgaaaaaaagaaccacgaaacaatcgagccgtgtcccttccgactccaactcttccccggctatacgtacggctccgcgttcgcctccgccttcataaaccaccgtctctttccccccatcgaaagctacgatcgattccaggtcaatttccaacttccaactcgcgtcatcgcggcgaaatctaccggcgatcgatatatggccggcaacgagtactccaccaaggcggcggcggtggaggcgatcgacggcggcgaggaggtcgtggtcctggcggggaagctgctgctgccgagggaggtggtcgacaagatcctggccatcaagaggaggcccttctccttcggcgacgacgacatcggctcggacgacgacgagctcagggagctggccgtgcagcacgaggccttgcaggacaagttcgccgcgtgccaggccatgatccgggagcatcgccacgagaacaagggctacgccattgtcgacgacgagttgcaggtcaggatggccgtgaccagggccctgcaccccttcgttgagcgctaccactgggtcggggaggaagacgaggaggaggagcaggtggctgacgtcgttggtggtgaggaaaagctgatctgagacgcaactgagaattgcagagctttgcctatcttaatagcattacaattaatacgtactgtctcatcggatggcctaatcagtcaaagaaaaaaccaaattttgaattttcaaatctaattttgagtttgattttgagatattttcaacgtagtttcttttacaacattggcttttaagtcacaagaacacatttataaaaatttcacctataaattcatttttatttcctaataagccgttttggcttattaggaaataagccaaacgatggggacctcactttcctatgctgagcttattcagtactccgtatctatcgatctacatactccacatgtctatgtgatggctatttatgtatgcaactaccccatctgtttcatgttatattcagaccgtgtttagttccacgctaaaattagaagtttaaagaaattgaaacgatgtgatggaaaaattagaagtttgtgtgtgtagaaaagttcgatgtgacggaaaaattgaaagtttgaagaaaaaagttggaatctaaacagggcctcaatagtagtatctaactatctacatcattcaaataaaatattgttgcaaggtaaataaatgaacaaccatgtgccataatacaactattatattgacagattctttgacatgcttttcaaacttattatcaaaatatattcaatgtttcatttaatgaaactaatttggtgtataatgttaccaaatttttttataaacttgatcaaaaaaaaatcctaattagggcatcttcagggaaggctgaaacaaaataattatcatctatattgcctctatgttacaatgcttctccaagtgaccagcataaatgtcataaacaaacattacagtacatgacataaggaaaaggataaaaaaaattcaataaatatcacagcaagattaaaacatcacaaatcaactatatgcatcagcatcagaccatcagcatgcatggttaaatcttgatgataatttaacaaatgaacatcacatgcatcgtcgatcgttgcgctaactgaagataaatcattatactatttgacaaaaagttttttataatactagatattgatccaatttcttcaacacaagcttcatcttcaccttgtcgaacacagcgatcgtcctggttccttcctccaattccttgggtctcacctcgaacgccctcgtctcttgattatagacgctgacatactcggcgaactcgccttcctccggtggatcatcggcgaagattttctcccagacatgtgcccgccacagcctccgctcctcctgcagccgctgcgtctcctcgaactcgtcgacgtcgtactccacctcgacgaagccgttgctgccgtactcgacgcggaacttggcccaggatttgcccaggtggccttgaggatgccgttgacgtgcaccagcagcgcctccggctcgtcgtcgtagtagatctccgggaggtggtcctcgtcggcgtcggcgtcggggacgaatgggaatatgggatgtatctctcgatgtccggggcgtcgtcggtgcagagctctgtacggtcgaggacccactcgatcggcgttctcctgcgatagccgcatcgtcgccaccctcctcctcaccgccgccgccgccgtaccgtcggagttagggcacgcctcctgctggccatgctgctcgaccgccgccgccgccgcggccgccatgatttccccggctcgccgcggcgatacatttctgaacgaactcttagagccgtggcttatgtaaaataaaatgggccggtccgtacggttttcgggttaccggaaaccgaactagagttatcgctgcggccccctatccgtgtcactgcacgagcacgacgggggaactattctaatccctcgaggggatattccctcgtttactcaaaaaccatctaaacagttatgaaaaattctagaaaaatttgacaacatttatacaacacatatatataactccacaaaatcttaagtccaaactcaactcacacgtcgagatataaaaaaaagacaaattcagcgtatgaatagtaacgtactgtttatatataaatttgtcttttttgtttctcgatgtgtagatcgaatttgaacatgaattttggtggactagtaggtataattatactctacattgtcaattttttttagaatttttgacaactatttgcatcgaatttagaagaaaaaggtatatgaggggatatcccctcgagggattagaatccactcccgcacgacggcctcacgttggcatcttaaccgtcctcggccgatcggacggctccgcacacagggtcgctggataagaaaatagccgaaattttgacaaatgaccctttcaagaaacttaattaaagataaatcgtaccaaaaactaatttagaaaatgataaaccgtgacctcgacgtgctttaacgtctcgacgctgctataacgttcatgctgagatcttgttcgacgaggcacaaattcgtcggaggagctcgcattcaccttctgtacaatctgaaatcacgcccagtagcgttcccggtcgtaggcaagcgagggcgcaaaactgatcgccctgagagagcgagggcgatcgctcgcccagtagcattcccggtcgtaggcaagtcactcagtatcattccatcgtatcctctttttttttcttttttttttactttaatgcatataaaaccaaatgagaccaataaatacatgcagcttggtgattgcagcacacagcaatatggaatggacgcagcagtggtatgcgccactatacgccattggcaacactgtgcctccaccgtatctattcatccttaccaatgatccccactagattgagccatctcacctaggtctgagctttagcataaggcaaagttcaaaggcaatatatagcacttgagagttgggagattggtattatagggggctgctataggcaaatgaacacaagaaagtttgcaatttttcatggtacgaattgaacagcattgaaacctaacaagtgcatgcactgttaacaagagatgaaaaaatatgcaaaactttgtaatttcacagcgttcaggcactacataatttcacctatctttccttcaattaaatagctaaacttgtgatttttaaagagaaaaaaaaaacagaaaggactaaagaaagttcacttataattagctaattaaaacatctcatattgcatagatgggccagcagtactcaagattgatcgccgattaagatccaaaaagataatcccacaataacaagaaaacaatgacatacgcttgcataaggaaagagatttgcagaatgcattgaattatcattaatcttctaaaccatcattatctaacttataacaagtgacaagtaccaacatcgcaatacataagtctgcttcagcaaatgggaaacctattaggcactcgttgattcagttcttcttcacgaagacaaaacgcttcttctccttatcgaacacaggaaccccaatattaccttccacttccttcatgacaaacttcctcctcttctcatcgtacacttcgatgtaatcgccgaactcgccgtcctcgatcgtgggaagaatatcagccatctcctccgcgagcatctccgcccacaacgccctccgctcctccctcctatgctgcctctgctcgaagtggttgtggtcgtactccacctcgacgaaccccttctcctcgtgcttggcgcgcacccacttctcgaagtccctgaacttgtcgaactcgtccatgaggagactgtcgatgtaccgcatcagggccttggggttatcgtagtaggactccggcaggggatcctccgcgccggggacgccggaggggctctggaggaggaaggggatgtacctcgagatgtcgggcgcgtcgtcgccgcacagctccttccgggcgaggatccagtcgacgttttcctgcgacagccgcagcttcgccgtcgccgtcgccggaacctcctcgtgggaaccagttgccgccgcagccatatatacttgttctgactcgccggcggcacgcagagggaagtttcgatgcttggattgccacaaaagggaatctcgtcgtctcgttaacctaagcaagccctctcgattttggagattgtgggggggaggaggcggtgcggcgtgcaggtttatactggtggaccgctccgcccgcgtccgactcgaagttcatcgttgaaaccgaaccggatactgaaaaccgatcgataggtgaagtccgcgtccgtcaggtcatgggcctcacgggtttaacagaccaaacggagcgcataccattttccggacaacgaaacaaatacgatcggacacaaataggaaaatattttttttttcggaacgtaaaaaccaactcaacttttaaaaacaaatatcatcatatataattagctcattttatataaaatataatataatatataactttttaaaagtttaaatattattaatagtgtggactagcgttaacagatggactactattaaaatctaaaaaggtatattgaaggtcatatagttataaagaaatacggtatgtcttatggcttttttgatatccgaattattattcatatctaaggaaaccccgatatcttattcgtattgtatatgggagaaaatatatgtttttttatcagtatccgaactatccgagaattatccgtttcgaaagatatatgtattcgtttttattcggaacggacaaaactatccactccactttcatccctagctattgacaatgtacagtggcatgcctaaaactaacggtgatattgacaatgtacagtggcttgctatatttctacatctctatctctaactctactttttatcttccatcttctatcttctactattataaaaattaaaaatgtttttgctagtattttgatacgtcatcattgtttgagtcaactttttaagttctacaaatccatgtttgagttcgtttttaagttcgttcgcttttaaaaatacaaaagtagtcgtacaagaaatttctttaaaaaaaactcgcatgctaacttgagacgaaagttggactcctaactgcagctaatgattttctaaaaaaattatccaagtgaattctcatagtgaatttcaccctaactaaaccgtataacaataataaaattaaaatagccttcaccgttgcaacgcacatgtatttttttctatttaaaaaaatgacaacatttcatggcaactcgcatatatccttttggtccctaaagtttggccttaaggtcaatatggtcctcgatattttattttgtccgatcagatccttaaactttgtcatatggtccaatatgaaccttaggctcaccagaaatgccatgtagacatgctatgtcatcattttattaaaagtggattgtgaaatttttaatctgtatatttgtatttgtatgtgataataaatactataactaattaatcttatataattagataatttaatctaatcccaggaattgatatatacactaggtcttgttcgtttctccaacaagatggagatgaaattttggatactcgtgatatgcttttcaaactactaaacgttacgtttcgtgcgaaaacttcctatatgaaagttgctctaaaatgtcagattaatccattttccaagtttttaataattaaaactcaattaatcacacgttattatcacatcgttttacgtgaaacacttaatctttatctccatcttcatcttcaggagattcaaacaccaaatagattatgttacaagatggcatggcaacgtgattttttttttccaaggaccatagtagactgaaagataaactctgaggactagttcgaacaaaatgaaatatcaaggatcatattgacctcaaagcgaaagtttaacgactaaattggcgccccccccccaaaaaaaaaaataataataaaggggagggggatgagcgggtgtttgtacgtacctacatatgtacgtttgatggtgtatgtacataagtaaatgtggcccatgaccttatttattagaatgccagatggtaatttaggagtgtttataggaattacacaaggcagcacagggatgatttggctctgcccgtttcatccttctcaccgcattatccgattattggttatttagggaatatatgtcacgccccgaaatagtcccgaccggaactagcccgtgacgtttcaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactgggggggattatttatacagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtcttgtccggtcggagtatgtgcaatgtatcagtctttagatttgaaacaagattggcacccggccaacagcttttcaaacggccacccgggccaacaacttttcaaacggccacccgggcctagctgatcccgtcagctgctgatttttcaaacatcgaacccattttctcaacagcaaattcacaagcggtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatggcaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaatccatttagttcacaagcaccgacccaggtgtcgggttttccaagtcttttgtaaaactccagttttacctaggttgttactcagattttaagtttgaaggcgaccgtcgatactcgcacagagtgcacgaatatcgaggcgcaactgggtggttacaaggggacatggtatggcaattaacaatggaaggatcaaatgcaacaagtcaggtaggtccaccaatctgccttgcagatgggacaaaagattaagtgcggtcctatcaatgcataatatttttcaagcaatataattaaatttcaatgataggctcaagatgttcaaaggtggcttgccttgctcgagatctggagcttgatcctcgaaatcctcgcactgcgggtcttcgggctctgaatctacacgcgaaacggaacgactcaacaaacggcgaaaataaagccctattaatgacctctaagcgtgccattagatagatctcgagatttgatgaattttggaagttgaacggagtcaaacggagtcacggttgggaagatattgaatttctaagattattggatttttggtctaaaggaaaaaggatttaattaaatcctttttggaaaagaaaaagaaaagaagggagggagggaatatagacttttctcgggcggctagggtgcggcccaagagatttggggcggctcggccgagcttaacgggccggccggcccaagacggcccaagcgcgcgcgcgcgcgggagggaggagagagagtccggtggaccgggctcaccacgcgtggccccgggtgggacccgcttgtcagcggctcggctcaccgtgcggagggagcacgcggcgcacgtgcgcgggcggggaggaacgcggtgcacgcgcgcggtccgcggcggacgcaggtgcggcgggcccatgcgcagcctcacggcttgcggtggaacgcgcgcacgcggagggaccgaccggggtcggcccgacccggtctgggctgagctggcgccgacgtggcgcctacatggccgccacgcgggccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcggtggcaaccggcggcgggagaagagggaaacggcgacgaggccacgagaggtcgattcccggcggtgagagcatctacgcggcttcgggaactcgatgctagcgtcggattgggcggaactacgccgagcgaggccggcgacaagcgggtgatacggagctcgggcggcgacggcggcgagcacgcggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggctcctcccacacgcgcaacgacgatcggcgacggcgaaacagagggcggcaatggcgcggaggcgaaaaatgagggagtttggagggggggcttgggcttaaatggacggcaatgtcggtttgggagaggggaaccggcattgaacggtcaaggcgcgagctggcgctcggcgcttgcagccaaagcggcggcaggaggatgacgccggtgagg

SEQ ID NO: 61977 - DNA, 12625 bp, Oryza sativa
  unsure (1)..(12625): unsure at all n locations
taggttgaactacccatatagaaatcatagatacgccactcagcaccacgtcagcgaaaacacctacaatattgtcttggagttgggactatatttggactggttttaaaatatcagatatatgttatattcagcattacaagtaatgaatgtaattcaaactcaatgttttgaacgtgttccttgaaaagaaccgcacgagttagctcgtctatggctgtgtttagatccaaagtttggatccaaacttcagtctttttccatcacatcaacctgtcatacacacacaacttttcagtcacatcatcttcaatttcaacccaaatctaaactttgcgctgatctaaacacagcctatgttgtgggctagcaaacaactatagctacctgcagcctagccgtgcccgtaaccggtcggccactggtccatttttatctgtctatcacgtgggctggcctgttttagataaatttgtgctgcaaatagtgttcaaacagttcacactagatttgtttttttcctcaatttgtacattaaatcttgagttgattttccgtgtgttactacatgtctgttacacatgtaggatatttctttgcattttcttgtacttttcggatacagttttaaggctgagttttttctttcactttcccaactcacatattttattttccgagcacacaatttttaaactactaaacaatgcattttttttcaaaaatttctatgcgaaagttatttttaaaaaatatattgatatctattttaaagtttttgctaatactttaattaatcgtgtgctaataaacaaccttgttttccgtctttcggaatgcagcctaagcgtaacacgatagcatagcactggtcggtagtaaacaatgtttacaaaaccacgtggttattacgtgcggtaaatcttcttagtttttaaaaccacggtatacctcgcgataaccgtacggttttcacggtaaccacgcggttaccgcgataaccgccaaacggtgggggtgacgataaccccacgcaaaacggtttgctaaggcctacgaccgatattctgacatgctgctgcctaccgtgccgcccccggagggcgccggggccgcggtcccgcgctcgctcgcggacgctcgcacgcgggcaacgtgcggccatcccgcggatcggaactcggatgcgtgtggttgattggcggatgtgctgtgctgtgctgtgctgtgcggctgtgccacaccgctgcacgccacgagtgagctgcatgtatgataaaatataaacacactagtacggtacgtgtggatgagagagaaccaaaacgtgcgtggaaacggagctgctccctccgtttcaggatataagtcattttagtacttcccacgttcatagtaatgttaatgaatttaaataaatctagacatatatatctatttagattcattaacataactatgaatatgagaaatgctagaatgacttacattgtgaaacggaggaagaagctctgttgggtggccaccgctaacaccgacgaggcaccaatattggcatccatgatcattgttgaccaaaatccaactcggcgatttgttggttgcttgccgtactctgctcgccatctcaatctcctcttcataaactagtacagtacacaagaaattaaaggggcaccaaaccggccggccggagcttagctgttctcatgtacagggagaatctaagccgacggctcgcacttctattccccttcttctgaacgcggcgtcttcgggcagtagctgattcggttttgcaatattgcaaactatgcaagatcgccggcaaatgtgttaaaaatattaattaaaaacactataagcatggagtgttcattcatatctcgtagtagtattctctcgacgattgctttgattggttgcttcccgtactctgctcgccatctctctctctccctcaagtataaaagaaaaggggcaccaaaccggccggccggagccgttcgcttgtacagtgtcaacgcctcgaatttcacaaaaccagacttctaggcatagtgtgtataattctctatgtaaggaccaatcaaagtacacaaagaaaaagttgacaaataaatccatgtcctacatctctatctctatctctatctctatctctgtctctactacttaaaaaataagaggtgttttcatcgtccgtcaaaaaaaccgggcgaaaaaaatctgtccgatccaaaacaaaacggacgaaaaaaccggacaaaaaaccgggcgaaaaaaagaaaagagaaaccaaatcgcgaaaaaaaggaaaagaaaaatgaatccgattccgcggtaaaaaaaagggcgaaaagaaataaaaagggaatatgtctgattcctaaaaaacgggcgcaaaaaaaaccaggtgaaaaaaagaccggaaaaaagcgataaaaacaaaagatcagaaaaaaaaaagtccgactcctctagtggaaaaaagagagagaaaaaacaaaaaacgaagagaaaaaaaaacttccattgcaaaaataaaggctctaaaaaaatccgactcctcggtggagaaaaataaaggcgagaaaaaacaaaaaaagagaaaaaaaaacttctactataaaaaagaaaaaaaacgtccttcgctcgctccgtcgttccgctcgcttgtcgccggagagaaatgggatcaagagagagggatttgggagctagggttttgccctctccccggtcggcgcttcatccggcgcggggacgattggagccgtccattagatcggacgactcagattcgcccagcgtcaggccgttgccgccgttgattacgctgcgcccaatgggccgtggaagtgcatcggaccgtccccgcatatgtcggccgcgctcagctgctcagcttgcgggccatcgaattgactcaactcgccggagatgggccagcccaagtttaggccggcttgggaagacctaggccgaaagcaaatttgatcaaacaatgtggctcacatttttcaaattaaagtccgttggataaactcttaagtaggctcgaaaaataaatctaaaactaaatcctaaatcctatgttaattgatcaaattagactcggttctacctatttattaatatatcaaattagacttgatttttacagatttgaggttttcaaggtgtcacactatcaaacggtgtttttgccgttgcaacgcacaggcactattgctagtaactataaagaggtatgcagaggcataaaccacagtctaatagtgaaaaggtaaaggctaaaacaagataacgaggtggcttcaatttcacgggaatcatgacggtagcgaggaagcctatgccacctagatgtcctactctgagaaaaagaaaaatattgcaaggttgagtatcactcaccatgcttagcaaagtcataccaatgatgcatcgtgcaaagggaacaaatgaaggtttgtgttagacatttacatttcaaaacagtaaaatggctcattattattcaagccaagattaatcaatacttaacaatgttacaccatgttgctcaacccaaagcaccatctaaactattaccatttccaacaagtcaagttatttaatactgatatcaatcgtggtgaaattcgatcagccatccataaccgtagatatggttgtttgaatatatttactttgatcaaaggggtaacaccgcggcaacatgataagagagattgtgacataatccttcgcataacccaccctaaaccattcacgtcatgctgtgatgcatccggcctaggtggcccaggtggccaaggcccaacaaattaaggttgcctggaccccaacatttagcacacccactcggggaaagaccgacctcaacagttcttagacatacccactcagggaaagacccaatccccctaaaagatccaataggggaagggtggcttcctcctcccaagctaacaagggcccagctctgatcccaattaatccatccggcctaggtggggttgcctagatcccaacagttcttaggcacacccactcggggaaaggcccaatctccctaaaagactagttcaataggggaagggtggctctctcttttaaggtggtttctacctcccaagctaagcaaggtgggattattcagaggctcacacggtcaccgcctgactacaactgcaccacttggccacttattgtgtctttgccagcgggtaatagtggaggatgtcctcatcatgctgagattgcacctcccgcacatgtcgcacccaacctaccaggaaggctatacccccttgcgacacggtagatctgacatctgctcagctagataccaagctgacatgacttcataacacctacccttgttaattgttcctaggagagagacaagctacactacaagcctagtcgttgcgtatgctagcttgtggtaagtacagaatgtctcacaatatgttccagtagcactcattgaggaaaaagtagtgactgagcatctctgggacctaggaaaggtagaggagtgttagggaggagtagcgcaatctggaacgatagcaaaatacgacatgaggaaggttgcccaacggccttacctcgcacggggtggtgatgctctagggtgaacgggcttcgagaagactccgatcgcactcctcgttgtcacaaagctagtggtggcgagggcacagctcgatagcagctagagcagcgtcgagcaacgggtggaggtggctaacaacagaagtgctatgatggtcgttgtggggaggcgatggagtgcacggagggctcaggcgaatgcggaaaaaggagaagatgagcatgggaaggggtcatataggctaggaagggaagaatgtggctaacaaggcaacattgtcaatgagagagggatcacgatgatgagaccgaagtgcatgtatccatgttagttctgcacatgagttggggagggtaagaggaggagtgggtaacaactgatccgacattttgaatgaagggagaaggtgcaaaattggacagaaggggtggtttcgaccggtggtggtttcctaggttggggtttatagttattattcaaggcttttagggtttttaagcaatttcttgaaattaaccaggaaagtagcacgcgcagatacatgggcacctaaaatatcataaattctattaccactaaaatttttataattaagtttcattaacttttacttggaatattatttgataattttattatatcaaactatgaactataatgggtgtgaaatctataagggttgagcatgtagtttatataatttatagtgtagatttcaatattagctttgagtgattaggagattataggagaggaagtgactcgagcaatgtccgcccgaaaaaagccatgacaaatggaagcggcggcttcttcggaggtaaggtgtccttgtgttcacaattgcacagatggcgtgaaattgtaaggtgggcggccatacggaacccatgtggtatatatgtgatctctgagttaggtttttttttcttttcttttttagggggggtggggggggataggataaggattgaagctgtcgtctatttggtaagaaatgaggagcatatttttgaaatcttcataaatcttatttaaatttcacaatttttttaccgtgaaaatttaaaatagactaaggaatattatattttatatatccaactgtgtactataatggctatgaaattgaagggttaaagtctagctataaactatgattatatatggtagaggtcccatatgttatagaacttttttatactgaaataggagaacaccgatgtgatcgctcatatatattgttgatgcaatacttgattctttgttttttatgcatctgtacggtcagatataatcctttgtaagttcagcgaaatctatgtttctcctaattatttgttcggcaccgcttatttagttttgatgcacatgttagttacacatccttagtggctacacgtccatcaacaaattatttgcattaattacattcacagcaatagtatttttagagctgatcaatttagcaaagtaaacattcacagatacccctccctccgtaaaaaaaaaaaaaaaaaaccaatcctaactacgaacctgacacgtagctaagattgatctttttttttttttacggagtagtaacatggatagcccttcctagcagtgaacctctacttcgcaaattgcaacgctatctccctctaacaggcgtgcaacatctatctcaatattcaagatttcaccgtgcaacatctatctcaatattcaagatttcaccgagtgcggtggggttaattgtccggtttattttaatcaatataatctaatccaacagtttacaatgttggacccatagatttaaataaaaatcaaggatagaatttttttttcttttttcctcggaattttttggattttctctaactagaaaaatacccgtgcgttgtaatgcgagaaggttattttaatattattattattatacggtttagttaagatgaaattcactgtgggaattcgcttggagatatatttttctagaaaatcatgagctgcaattaggagtctgaccttcttaagttagtatgcgagtttttttaagagatatcttatacgactccttctgtattttcaaaaatgaacgaacttaaaacccgactcaaatacggatatgtattttcaaaataatatgaacttaaagaaaacaactcatacacaaatagcgtaccaaagtaccggcaaaaacatcttcaatttttataatagtagagatttattagagtgtcacgtgatggcttagaaacgtttgtaggaatctgacggagctggtggctcctcaccgggggaccgcgcaggcccccctttgccagttcggccgggggcttagggtgaaatctcaagctctcgctctctctctgtatgtggaaatatcgtccgccagccagaaacacgagacaccggcgatctatacaggttcgggccgctgagaagcgtaataccctactcctgtgttttggtggatctgtgtatgaatgggctacaagtgtgagctgacttctcccccgttctaagctcataatctgggaaagaatcaacaaaccccccactctatgggcaaggtcctccttttatacttcaaggggataccacacgcacccttctctttccaaactggactgttctttttctcttgaatgggcggagatcagcacggttgctgtccgaatgacgctccgatgggacagcccacacctacctccacttccgccgggagtgagcgcgtcgtgggaacatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcttaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatacgtggcgcagacttcctaaagggggcgggggtgcccccggccctccgggccagggcaagcgcaacccgacccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgataggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgccatggcatggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcatcagactacccggggcggtccatcttcttcctccccttcgcaatggctgggctggtcccgccattttctcatttcttcatggatgtcctggagttctacgatctccagatggcgcacctcacccctaatgcggcgatgacattggccatcttcgcacacctgtgcgagatgttcattggggtgcgcccctctcttcagctgttccggtggttcttcaccgtgcagtcggtgtcaccgccatcggtggttggcggctgctacttccagccacgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacaccgtcctcgaccgcctggcgggcctgcgatcccaggggctcaccggggccatggtgtacggcgattacctccgtcgccggattgcgccgctccaacggcgcgcccggagcgcttgggagtacactgggcctgaagattacatgcggacccatcagggaaccagatgggattgggctcctgaggacttcaagatcgtagtccaaagggtgcttaatcttagctccgcggaggcgtctcgccttcctcaggagatcctccccctctgcatcgatcccgaccgcgtctccattctatccattatgctgggggttggggcctcagaggagagagcccctaagagccacgatggcgcgggcgagagccgccgggggaaacgatctgccccaggagggggtcgtgcttctgggccccgcgtcgggggctcggggaccagccgtcctgccgacgccccggggaagaggaagctgggaggaacacctcccccatctcctccccgagggggcggggcggtgcgtaccagcggtcggcgcccggagggggccgcgccgacgtcacagcccgagggggagcgcaagaagaagcgcctccgcaagatgggggagacggaaccagcccggggaaacttaatttcccctccaaggtggtcattcaaccgaccccctcgcaggttcgtctcactcttattgcaaccatctttctccaaaaagaagttttttcttgctcattttgttcgccttctggttttttcttctgcttcagcgatgtcccgtcgcattcctcccgccaccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaagctgctcgggaggaggccgcccgggcccgccaagccgcagaagctgcccgggaggaggccgcccgggctcgccaggctgaggcgacagcgtcacttgggcccactccctcgggcggccctcgggcgacatcctccgaggcggctcgcgacgaggccgcgggcgcatcgcctgggcctacctcaccgggcgacgcccaggaccgaacgggcccgggggacatccccgagctcagcgtatcctccggggggccaaaccgcgtcgccttttctccaaggcggcttttttcctcatcttccgtcgccccggtgagcgccgagcccattatgcaggccttggccgccgcaaacaccgcggtgctggatgggttcaacacccaggtggaggccctgcgtgcagaacgagcggagctcgaggccgcatgggcgcgcgtcgaggaggggcggcgctcggtggacgccatggtgaaggtgggccgtaaggcccatcgccgccacatctcggagctcgaagcccgcaaggcggcgctggcggagatcgcccgagaggtgaaggaggagcgagaggccgccctcgtcgccaccaccgcgatggtcgaggcgcaagacgccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggcccttgaggcccgtgccatggcgctggaagaacatgccggcgccgtggagaggggcttgatggaccgcgaggccaccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagagccgcgctggagcagcgggctgctaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccaccggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgcaccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggctcgcgttcgcccccagctccgacgaggaaggcgacaccagcagcgaggacggcggtggcgacgaggccggcgacccgggcgcatatgaatgagcccccaggcccccgccactataatcttttttcttgttctttcttctaaggccttcatgcctcttttttgtacaattttaacttaatctgcaatgagaaatgatgaaaaatttttgtgttagttttattttgctatatatatgagctgaggatgatctgtgccatggtccttttgcgacttagcttggaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagtacgagtgacattatttcaagtcaagattcttcaaaaggaaaaaaacggcacagacacaacctttaggaaattgaaactgcttttattgaaatgctgaaaggaatatatgtgcatgtgtggtagcccccggctaaccctgcacacccgagggggggtgcggggttagcccgagccgaaacctgacacccgaccccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagtttgctcaatccgggtgcgagactcgaatgtcattcatnggggcgcag

SEQ ID NO: 61978 - DNA, 800 bp, Oryza sativa
ttaactctcaaaactctcaaaaccattgtcattaatttcatcctttgactcaaacaaacaaatatcggttttgatgatgtggcatcacatcaagtctatatagacacacaaagaaattatcgtaccaatcaacaataaataacaacagcatatctttactaattaaaatattcacaattttccttttgtcacacaaaaattttgcccgtaaatccgaccgagcggcgccctccatccacacacgagcgacacgcaagccggctaaagcaaaaaggaaaaaaaagacagatcagagatcgaatcaaactcttgatagtgtatggtggggaaatcacaaatcaaagatagattgaaaagccagtcgcggcaaatatcatccagaattctagagtctgaatcaaatctatccctacttaaaactttggatttttcccatcatcacaatgtgttttcatccgtcgttgagcaccttctctgcctcgcgcggttagcgccttctcaagattccaaatttcccaactcaaacacaaaaacaaaactaaaaggaatcagactctaatccacccaaataaaattagaagagggatccacgtttgaattctaatccatcgcaacatgaaacaataaaaaaatattccaccttgacttcccttaggcctgacggctgcatgcatcgatgcaatcgctttttccccccccctttctcccccggggggccccctaaggacagatcgtcgaatcgctcgcaccgaactgacatgaatccgtgatgatctcgtcggtggaaaggatgcaaaaat

SEQ ID NO: 61979 - DNA, 10246 bp, Oryza sativa
tgatagggtttttgacaaatcaccatctatttcctatatgcaagtaattttcagggcaacatattggcttcggttgtgggctcaactacaaaagtgtgaggaagatggagttttcctgaatgttgcatgtcgtactcttgagtcaacggttatgcaactttttgccaaccatggatggagattttctaataggctggaataatgttttccttgtcatgttaggtctttcttttaattttggttggtttgatagtttcatctcgaattaagattttataagtgtgttactttttgtaataattggctgtagctctttggagtaaaggccgggatgtttcattccattatctaaaaaaacaaattttcagcttattattttttataatcatatattgtagcgcccgttccgtcgtggcgcctagcgggaaaattatctcttaaaaaccctaattgcgaaatttgtttctttgtttgttgtctagtgtccgtgccatctcaagatctcaatccccgatcaatcgtcgagttcaattccgaatccaaatccctccaaatcaatttcctccgcaaaagtctagtttgcctcccccgggttcgatgggccgaatccagctcggcccatctctctcccgggcgctctctctctctctctctctctctctccccccggcgcgctctttcctttcccccgctcagcctcgcccgcacgctgctcgcgcatgcgcgggagtcgcccgcgctgagcgccccctcccctcgcgcgagctccccgctcgcaaagccgcttcccgcgcgccgtgttcgcgtgcgcgcgcccgcgcggacgccgcctgttgcaagccgcgcgcgcgagccgagtggccgaccgcccggtcgccgccgccgtcagcctctgcgcgcgccagtcgccggtgtcgccgccccgctccaagccgcccccccgtcatcaccgtcgtcatcgcccggcccccgccactccgcgcgcaagccgccaagggacggagccgcgcccctcctccctctgccggcacgagcaaggacgcggaagaggactccggccgcaccctctccttcctcttccccggcccgaggccggagagattactcccgcgccgtcggcctctcatcacagcgcccctcctcttctcggtgatgtctctctccgttcttcctcctcgctccatctccttcccctagctttcggtagtagcttgagtagcttcccgtagttagccggcgccgccccgaccgttgccgtcgctcgccgcgtgctcgccgccgtcgccgcccgagctccgtagcacccgcttgtcgccggcctcgcttggcgtagttccgcccaatccgacgctagcatcgagttcccgaagccgcgtagatgctctcaccgccgggaatcgacctctcgtggcctcgtcgccgtttccctcttctcccgccgccggttgccgccgccgcaatccgccgccgtcgagcaacccccggcaaatccgagccgttggttcgtctcccctcgtctcgtgtaaccgcccggtgtgctcgcttttgcccgtatcaccgtggttcgctccgccgctcgccgccgccgcccgccgtccattcgcggccggatcgtcgtctaccacccgccggcccgcgtggcggccatgtaggcgccacgtcggcgccagctcagcccagaccgggtcgggccgaccccggtcggtccctccgcgtgcgcgcgttccaccgcaagccgtgaggctgcgcatgggcccgccgcacctgcgtccgccgcggaccgcgcgcgtgcaccgcgttcctccccgcccgcgcacgtgcgccgcgtgctccctccgcacggtgagccgagccgctgacaagcgggtcccacccggggccacgcgtggtgagcccggtccaccggactctctctcctccctcccgcgcgcgcgcgcgcttgggccgtcttgggccggccggcccgttaagctcggccgagccgccccaaatctcttgggccgcaccctagccgcccgagaaaagtctatattccctccctcccttcttttctttttcttttccaaaaaggatttaattaaatcctttttcctttagaccaaaaatccaataatcttagaaattcaatatcttcccaaccgtgactccgtttgactccgttcaacttccaaaattcatcaaatctcgagatctatctaatggcacgcttagaggtcattaatagggctttattttcgccgtttgttgagtcgttccgtttcgcgtgtagattcagagcccgaagacccgcagtgcgaggatttcgaggatcaagctccagatctcgagcaaggcaagccacctttgaacatcttgagcctatcattgaaatttaattatattgcttgaaaaatattatgcattgataggaccgcacttaatcttttgtcccatctacaaggcagattggtggacctacctgacttgttgcatttgatccttccattgttaattgccataccatgtccccttgtaaccacccagttgcgcctcgatattcgtgcactctgtgcgagtatcgacggtcgccttcaaacttaaaatctgagtaacaacctaggtaaaactggagttttacaaaagacttggaaaacccgacacctgggtcggtgcttgtgaactaaatggatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgccatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactaccgcttgtgaatttgctgttgagaaaatgggttcgatgtttgaaaaatcagcagctgacgggatcagctaggcccgggtggccgtttgaaaagttgttggcccgggtggccgtttgaaaagctgttggccgggtgccaatcttgtttcaaatctaaagactgatacattgcacatactccgaccggacaagacgcactgtctcatccgtgtcgtttgagaagcactcacttagtcgtttttagaaaaaaggagttcaaataaaatcaattgcaaaaacaacagcctctccttgaagcctgcattaaacacttatttcccctggcttgctgagtacccccatactcacccttgctctgtataaataatcccccccagttgctgaagaagatgaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctaggactggtatcgattaacaggttaatttgaaacgtcacgggctagttccggtcgggactatttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggaagtgaacgccagcttcagttcccacggttttggtgagggtcaccacgtcgcccagcttcgtgacctcgcccgtttccttggcttctcgtgtcccgagtacacggggtactccgtggaccgtgttccccctcactgtgagctctctgtgtacctttaccctcgtggaggtatacacggagctggccttcgcccccaccacttcactgtggccaggcccactctccagatcgcgtaccaggacctctcctggaatgcgcttcgtcgcctggcccacgactacagccaccgtctcggaggttccgccttccggcagcttccacgccttccttctggccactcagacgccaggtacccttgtccgtacagcgagtctcagccagtgctgactcgcatggtcgagctttcggaggctcaggccactcagcacgacctactccttgaggcttaccgctcccttgcccgccgctacgccactttggaggcccgtctggccgaggagggtgtcacctcagttgacactatctcttgggactcaggccgcctctgccacgccagccacctgtcctcccatagctcccgcggctctgctcgcactcccagtggcccgcgctcccccagctcgcgtgcgccgtactcaccagtgtactccccctacccacacccagttagcccttcctacacccccggacacactccagttgcttcctcccgccgtggcccacgctttatccgcactgcacggaagcgtgttgttggttcttccaccgtgttccgtttccgccacccagctcccccaccgccagcggcccgtgctgctgccggccctcgacaggttccgccggtcccttcgcgccagccgatcgacgtttcttcgactgaggagccgactacagggggcagccaggccgacgaggagtagaggaggcagtcttcagcagccgtccgtgtgttaggcccttttgttccgccgccaactcttttggagtcgtggcgaggtagcgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagttgtgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccgcagcaaccgttcgcaccgtactgtttcccgcaacgcagaggttgagcaaccccgccgcagcagccgctcgcatcgcacagtttcccgtgatgcagagatggagcagtctcacctctctcactgcactgtcagtcacaattctggagaagaacgcctcccttccccacctcatgtggaaaacaacatgcaacacataatggcagttcagacacaaatcttgcaaggactaaccacagccatagccagttttcagcataatgtgcatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactcctgttgagaagacgctctacgcctctcaccagctaagaggacctgccgcagattggtgggaaaattactgcaatgcacatcctgaacccaataacattgcttgggatgagtttgctacggctttccgtgcagctcatgtgcctgaaagcactattgacatgaagaaagaagaattcaacagacttaagcaaggcaacaacagtgtcaatgagtacctaagtcagttcaacaagttggctcggtacgcccctgaggaagtagacaccgataagaagaagatcaggaaattcttgaagggaatcgcagttggaatgagactccagttgcttgctcatgacttccccacttttcaacatatgatcaacaaggcacttctgcttgaggatgccagaaaagaggctaccgaagaatacaagaaacgcaagtctaaccatcagggaaattcttcccgaggcgcacctcgccctcgctacggtcaacccatgcaataccaccagtcgatcactcaaactaaccgccagccaggctacgcccctcgtcctcagataaaccgtccggcacctccgccacagcagcgtgcccctagtggcaatactgcgccaaacagtgttacctctttcaagtcaccacagggaccgtcagcagttcagtgtttccggtgcaaccagatgggtcactatgctagacagtgtcctcagaatcctgccaacaccaactcagggcatgctaatggcagcaccgccagaactcctactccagcggcagctcagtctcgtcctagctctcaggcaagtggacaaggttctcgtgcttccaaccactttggtcgaggacgtgtgaatcacattcaagctgaaaccgctcaggatgctccagacgttgtgatgggtatgttctctgtcaactccgtacccgcaatagttctatttgattcaggagcttcccattctttcatatcacaagcttttgtgaaaagaaacggttggaaaacccaaaatttgcgtgtaccaatgatagtacattcccctgggaggaatataagggcaattcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtcagtgaatatcctgacgtatttccagaagaattaacgagtatgccaccagaccgagagattgagttcgccatagaactggtaccaggcacaactccaattgcataaataccctaccgaatggcagctaatgagttagcagaagtcaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagtcttctcaaaaattgacttgaggtcaggttaccaccaattgaaaatcagatctgaagatattccgaagaccgctttctcaacgcgttatggtctatacgagttcacagtaatgtccttcggactcaccaatgctccagcgttcttcatgaacttaatgaacaaaatcttcatggaatacctggaccagtttgtcgtggtgttcatcgatgacatcctgatatactccaagaacgaggaagaacatgctgaacacctgaggctgataatggaaaagctcagagatcatcaactattcgctaaattctagaaatgcgaattctggttggaccgagtagcatttcttggacacgtgatttcctccaacggtgtcgaagtagatcccagcaaggttgaagctgtacttgcttggaacccgcccaagaacgtgtcagagatccgcagcttccttggcttagcgggatattatcgaagattcattgaaggattctctaagctagccagacctatgaccgagctgttaaagaaagaaaagaaatttcaatggtctgcagcctgtgaagacagctttcaagaaatgaagaaaaggttgaccactgcaccagttctcaccttgccagatatccgaaaagatttcgagatcttctgtgacgcatcaagacaaggcttaggatgtgtcctaatgcaagaacgaaaggttgtggcctacgcatccaggcagctcaggcctcatgaagtcaattatcccacccatgatctcgagttggcagccatggttcatgctcttaagatctggaggcattatttaatcgggaacagatgtgaagtatacaccgatcacaaaagtcttaagtatatcttcacacagaccgagttaaatatgagacagagaagatggttggaactaatcaaggattacgatctgggaattcattatcatcccggtaaagctaacgtggtcgctgatgcgctaagtcgcaaggcctattgcaatgtagcccaaacacggcctaaccaagatcacctgtgcagagaattggagaagttaaggctgaccgtggtacagtcaggtgtccctgccagcttgacagtacagcctaccctagaatcacaaatccgggaggcccagaaagatgacgaagggataaaagagttaataaaaagaatacgggagaagaaagacaccaatttctccatagacgaacaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagacgtcgcagaatacgtagccttgtgtgacatttgccaaagagtcaaggcagagcaccagaggccagctggtctgctacaacccctaccaattcccgagtggaaatgggaagagatcggaatggatttcatcaccggtttgccaagaaccccctgcgggtatgactccatttgggtaatcgtggaccgactcacgaaatcagctcatttcgtgccagtgaaaaccacctatgatggaaagaaactggcagaactctacatgactcatgtcgtatgtagatttggctgtcccaagaaaattgtgtcggaccgaggcactcagttcacctcaaggttctggaagcagttgcatgaaactctcggaactgatctaaattttagtacggcctaccatccacagaccgatggtcagacagaaagggtaaaccaaatcctagaagacatgctgcgtgcgtgtgccttggatttcgaaggcacttgggatcgttgtttgccgtatgctgagttctcatacaacaacagttaccaggctagtattcagatgtcgccaaatgaggcaatgttcggaagaaagtgccgcacccccttgtgctggaatgaggtgggcgaagccctggtattcggtcctgacatactcaagtcagcagaagaacaagttaagctgatccgagaacgcttgaagacagcgcagaaccgtcagaaaaattacgctgacaatcggagacgtgaccttgagttcaaaaaaggagatcatgtgtacctgcgggtgtcacccctccgaggtatgagaaggtttgggatgtccggcaagttagcaccccgctacatcggcccctacctcatagccgccagacgtggcgaagtggcttatcagcttgagctacctgaaggtctcgcagatgtgcacaacgtgttccacgtatcccagttaaagaaatgtcttcgagttccagaagagcaagttcccctgggtagtatcgagctggaaaagaatctgacctacaaggaaagaccgatcaaggttcttgaagaggcagaacgtcagactcgaaggaagaccatcaagttctacaaagtccaatggagcaatcattctgaagatgaggcaaccagggaacgagaagatcttctccgcgccgagtttccggagctgctcccttaggtgctgaatctcggggtcgagattcttgttaggggggttggtctgtagcgcccgttccgtcgtggcgcctagcgggaaaattatctcttaaaaaccctattagcgaaatttgtttctttgtttgttgtctagtgtccgtgccatctcaagatctcaatccccgatcaatcgtcgagttcaattccgaatccaaatcccttcaaatcaatttgctacgcgaaagtctagtttgcctcccccgggt

SEQ ID NO: 61980 - DNA, 659 bp, Oryza sativa
  unsure (1)..(659): unsure at all n locations
tccgaccggccgccgccgctcgtcgtcagctcccgccgcctcccgctcagctccgccgcggcgccgccacggccgcccgtccctcctccgcctgctccctctcccggcgccgctccgtcctcctccgcctgttctctccgccgcgtccgccgcctcatccgcgaccagcccccgccgctcgaccgctcctcgcctcgtctccgcgcccacctccacctcgtccgcgaccggccgccgccgctcgtcgttagctcccgccgcctcccactcggctccgccacggccactcatccctcccccgcctgctctctccgccacgtccgccgcctcatccgcgaccggccgccgccgctcgaccggntcctggcctatntnccggccccggctcggcttgtncgcgaccggcttcgggaccggccgcggcggtcgtggtaagttccggcggcttccggtcgggttcggtggggggtggcctttctttcgttggggcgacctggttcttcggccccaattttaccggccgtgaaacaatggccattccatnccaacctcatccctttttcccaaccaaaaactataaccattctttaccacaaaccaaaccccacaactgggaccattccattcaaaaaaaggggaataggcctaccccatcccac

SEQ ID NO: 61981 - DNA, 15734 bp, Oryza sativa
atggcccgtcccatcagaaggtcattcggacgggcaaccatacaaatctccgtccatttatgaagagaaggcaagtcaagttggagaaaagagaggataagtccccacacaaaagagagagatggtgcatgtggtatccccttgagatataaaaggaggaccttgcccacttagagagagaggaaaaagggatggagaacgatccgagactgggattcggaaccagaaagggagagagttagagttctctggctctccagctctttgtagcttcttcatacacagatccaccaaaacacaggagtagggtattacgcttctcagcggcccgaacttgtatacatcgcccgtgtcttgtgtgtttccattctcgcgaactttccacagaccgagagcttagaacctcacccagggcccccggccgaaccggcaaaggggggcctgcgcggtctcccggtgaggagccacacgttccgtcatctggcgcgccaggtagggggctctgcgtgtgtttttccaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctagacgggaggaggcgctcgagagggtcgaaggatccgcgactgcgacatccacgggtgatggagaagggcgccgagatggggagcgtcgcctcctcgtctacggcgatggcagcacgccccagggcgcgctccaagctgcgggcgcgctcctacgtcacccgcccgtcgtccctgacccggagtctccagcccaacgttggctggacgacatggccaacttggtcatgacggcacggcaacgcctaggtgctggtgggcgctcctccgccaccaagacctctggcgctgctaccaccggctccgtgtcgtcaaggcggagggcgcggcgagcggcggctgttgctcgccattcggctgccactccctcgtcagcacctccgacccgggaagatcagtgtggggggccagatgcccgcatcggtatcgagcaccggcgtaatggtcgacgtgctgcccacgcaacggagggcgcctcctcgtccggagtgtcacctcaactcggacgcggggatcagccctccgtgcccccggttggtggtgtcggctgtagagcctttgtggcgagcgtttggaacgtccgttggccctcaaggttccggcccaccatgtcgcgaccgagaaaattgcattttcccgaacgctagtgtattaatgcccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcggatgcacgattaatgtaagggggtacaaggggtaatgatataggggttaagttttgcagttaacagcatttaaaagtcacttagttgcccaaagccattttataaagacgatcctagagctacacagtattattaatcaaggccgtgaacccacacgaacctgccttaacctaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtatatctttacccacaagacacatcttcctcacgtgtaaccacgtgccacataccaccatggcatatggatggaagacatgacatagtttccaacccatcctggccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatacaccccgagcccagcctaaaaccattttggggattttgaatagagggggcggtgtgaatccaattccacaataaaccaacaattccaaagtgtccaggtgatatgaatatcccaaagtctagagttgtaaaaccacctaatgttacctaattaatcagcgaagcatctacctaaaatttatactagtggtactaagaatagagtgtccactagttggggttttgtttaatctagggtgaacaaggtattaatatcaataacaataataataaggtcataacaaaggtagataggcatggctaaataaaacagtgataacgcgggaatttaaataaagcgataatgcaatagtttaaatcaaaataattttataaactgggattcaatatgttcaaggatgatgtgacttgccttgctcgctttcccaaacgtcggcttcaacttccacgaagagcggatcttccgaagcggcagcgtctacacgaccaccggaaaagaaaaggcttttactctaataaactccatacaacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaattggatttattgcgtcagccgaggggaggggcgcgtggaccgggtccacgggagtggggcccacgcggcagcctcacggtccacggtggaccgggtgcacgcggctgacgccggccggtgccgtgggtcccacgcgtcagccgcacccgcgggcgcgggcggctgacggccgggccccacatggcagccgcggggcgcgcccggaagcggcctcgccggcacggccgacgggaggcggcgcgcccgcgccccgatggtcgccgccggcgaccaccgacgcggcggagcggcgcccgagagaagggagggaagggggaagcgaaaggagcggtccacggctcaccccgggtcgacgaggacggcggaggaggcggccggagcggagggaggcggcggcgcagctcgggtcgacgaggacggcggcgttccggcggtcggcgggcgaaacggaggagtggacgaggtcggcgaggacgcggcgaagccgaaggaggcggcgccgaggtgggaggcggtccggggtgacgacggcggcgggccggagctcggcggcgacgacggagagagagagcgacgtcgcgagctcaaatccggcgaggaggaagggcggcgagaggcggaaccggacggaggaggtgcggggagggtttaaatagagccggggcgagagagggtggccggggaagggaggaaaccggcgcgggaggtcggccgccatcaatggcgccggcgagatttgcgggggcaaatccgcccgtttgaacgcgggagagagagggagaaatggggggaaagagagaggggatcacggggaataattccccccactttaatgcgcgcggggactgcgggaggcggcgggattcgcggcggcggccgcgctagggcgcgggcggggcggcgggagcggcgggaggatagggatgacaggtgggccccacccgtcagcgagggtggcgggcgggcccgcccgtcagcggcgcgcgtgcggggagaggccgagtgggccgcggggaggaggagagagagggaaggagatgggccgagccggcccaagagggggagggggggaaaaagactttttagggtttttctttttataaaatcattttaactttgtttttttcttaataattattatttgtgctctgaaaattccactaaaatttgagggctccttttagaccaaggaaaatttaacaaaaattctccgggccacatttgaatttttcttgtacgtattttagtgtttgccaatttcttttcgaattttaattaattctattattccttttagcaaatgatttttaattcgggatgaatttatcaggacgtgacacaccatcgccgaaaaatatgacgggagcgtcaaccccgccgagtttctcctggtctacacgaccgggatcgaggccgccgggggtgatgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacttacacgcagtacagcgaagggatgatgagtcacttcgctcgtacattcagcggttctgtcaagtccgcaacaccataccatgcatccctgcacacgcggtgatctacgcgttcaggggggtgtgcggcacaaccgcatgctcgaaaagatcgcctccaaggagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaactggcaagtggtgtaccgtccataacacctcccttcacgacctcgcggactgccgcgcagtcaaaagtttggctgagcggacgaggaagtgggaggaggagatgaggcaggagcgccgagagggcaagtccccggcggttccttccggcaatcggcgaagtgaggccaagcagaaggcccccgccaaggacatcgatgacggcgatgatgacctaggtttccaagagcatggggccaccattgccactgtcgatgggggagcgtgtgctcacgtttctcgccggagcctcaagaccatgaagcgagagcttctggccgcggcccctactcatgaggcgacacgccgggcgcggtggtcggaggttgccctcacctttgaccagaccgaccacccaccgtacgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgcttcggccgtcccagccgattatcggtgtgacgccggggcacacttggccgcaaggtcatatcgacctcccggtcaccttcggtggatccgccaatttccgcacggagcgggtgaactttgatgtggcggacctcagtctgccctacaacgcggtcctagggaggcccgcgttggtgaagttcatggcggcggtccactacgcctacctccagatgaagatgccgggccccagtggccccatctctgtccatggtgacctcaaagtcgcgctcgcttgtatggagcagcgcgcggaccacctcgccgccgcgtccaagcccgagggtggcgacgagaggcttggcacctccgtccccgccgccccgaggcagcggatagtcacatgcgacgaggtcccggtcaaggaggttgccctgggcgacggcccgtccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcaccgtgcggccgggcgcaaggccggtccggcagaaagtgcggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatgctctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgtgcaaccaagagaccttactctcggatctagcagaaacttttgagagtctccgctccgcccgcataaagctgaaccccgataagtgcgtgttcggcgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccggaccgtttacctggacggaggaagctgaacatgccctcgctcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcatccccaccctgcgctggcttggcccgggagagagcagggaggagaggcccccgagccgaacggtggcccaaggcccccgacgaccggagctggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcctgcttgtccgacgacgccaggagcccccaacccccaggacggccccgaggccactgtgggaaggccgcccctgtcgttctccgaccccgaggtcgtcggcacagaagatgagtgcgccccgcgaggccgcttggacgaagagcgccctagggatgcggcccctagcgaagaggatcggccccaccgaaaggtgcagcggcccgtctactttgttagcgaggccctccgggacgtcaagacccgataccctcaggcccagaagatgctttacgctattctgatgacttcgaggaaactgcaccattatttccaggcgcatcgggtcacggtggttacgtcttaccccctcggccaaatcttgcataatcgagagggtactggacgggtggtgaaatgggcaatcgaactttctgagttcgatttgcactttgagccacgccacgctatcaagagccaggccctcgccgattttgtggcagagtggaccccggctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatacctggttcgccttgactttcgggcgaccaataatatggcagagtacgagggactccttgcgggactcagggtggcagctggactggggatccgccgcctcctggtgttaggcgactcccagctagtcgttaaccaggtctgtaaggagtaccggtgctctgacccgcagatggacgcttacgtgcgccaggtaaggcgtatggagcgccattttgatgggatagagcttcggcacgtgcccagacgggataacacggttgccgacgaactttcacggctcgcttcctcgcgagcccagaccccaccgggcgcctttgaagaaaggcttgcccagccgtcggcgcgacccgaccccttaggggagacggacgcgcctgatcggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaatggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaattcatcagccggcccaggccctgcagatcataccactttcatggccatttgctgtctgggggctcgatatcctgggaccgtttaggcgggccccgggcgggtttgagtatctgtatgtcacgatcgacaagttcactaagtggcccgaggcttatccggtcgtcaagatcgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacccgcccaccccagaagcaatggccaagtggagcgcgccaatgcggaaatcctaagaggccttaaaaccaagaccttcaatatcctcaagaagcacggcgattcatggatcgaggagttgccagcggtgctctgggcgaaccgaaccacaccaagccgagcaaccggggaaacgcctttcttcctcgtctacggcgcagaagcggttctgtcacgaccggaaataacccaacgggcgttcctgacgtgcgtgcattaatccttgtcccaggaggcaaggtacaccaaaagttgatacaattcagagtttaacaagcggaagcgtaaatagataacttattacatgggcagcgaaggcccagcacacacaaagacaaacgggaaaccgtggaagactagggcgacgaccacaggcgcttgacggcaggcacgagctaggcaccaaagccttcatcttcaaggaactcctcttctgggcttgggaaaaattgagcaagactgagtacaaccaccgtactcaacaaggcacacccacaagtgcagaataaatgcaagggagtacaaaggaattatactataaaggggttagggtttgcattaaacaacatttaaagatatttagttgctcaaagccattttgtaaacacgattctagaactatacaatattaattatcaaggccatgaacccacacgaacctgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacaactttacccacaagacacattttcctcacgtgcaaccacgtgccacataccaccacggtatacagacggaagacgtgacatagtttccaacccatcctagccatagacaagagtaccgacccaatcccgcctacggccggaacctccgggacaggcaggcaggactgagcccctacagcagggcaccaaccctgtgccatgacatctcgactaccgggccgcagctcgtgtagccttcatttgccctggagaatgtccatcgacccccgacttcatccatctccttccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgaacccagcctaaaaccattttggggattttgaatagaaggagcggtgtgaatccaattccacaataaccagaccattccaaagcatccaggtgatatgaatatttcccaaagtctatagttggaaaaccacctagtgttacctaattaaattgcgaagcatctacctaaaagtaaactagtggtgccatgagtagagtgtccactagttgaggtttgtttatcctagggtgaacaaggtaataataacaataacaataataataaggtcataacaagggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatacaacagcagaaacaaagcagaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcagaccgggtccacgggagtggggcccacgcggcagcctcacggtccacggtggaccgggtgcacgcggctgacgccggccggtgccatgggtcccacgcgtcagccgcacccgcgggcgcgggcggctgacggccgggcccacctggcagccgcggggcgcgcccggaagcggcctcgccggcacggccgacgggaggcggcgcgcccgcgccccgatggtcgccgccggcgaccaccgacgcggcggagcggcgcccgagagagaaggggaagggggaagcgaaaggagcggtccacggctcaccccgggtcgacgaggacggcggaaacgacgaccggagcggaggaaggcggcggcgcggctcgggtcgacgaggacggcggcgttccgtcggtcggcgggcgaaacggaggggtggacgaggtcgacgagaacgcggcgaagccgaaggaggcgatgccgaagcgggaggaggtccggggcgacgacggcggcgaaccggagctcggcggcgacggcggagagaaggtgcgacgacgcgggctcgaatccaacggggagagagagtggcgagtggcggaaacggaggagggaggcacggggaacgtttatatagcgtcgggagtgagagagagcggccggaggggaaggaatcggccgcggaaatctcggccgccattgatgcgccggcgaagatcgcgggagtgaatccggacgaatccgagggagagagagaggggaaagagggggaaaagagggagggaatcacggggagtgatttccccctctttatggcgcgcgggaacggcgggatgcggcggattcggcggcggcggcggcgctagggcacgggcgggcggcgggagcggcgcgaggttggggataacgggtgggccccacccgtcagcgagggtggcgggcgggccggccgtcagcggcgcgcgcgcggggaagggccgatgggccgcgggggagaggagagagagggaggggactgggccgagccggcctaagaagggaagggggggaaagaagactttttagggtttttctttttataaaacctttttaactttgtttatttcttctcagttattatttgtgctctgaaaattccactaaaatttatttacgcattttaggcttttaggaaatatacaaaaatcctccaagccttatttgacttttaaatttgcacattttaattgttggaggctttcacatggattttaattattctatgcacaatttcgaggatgtattttagagtcgttttgggacgcgacaaacctaccccccttaaacggaatctcgaccccgagattcggaagaactggcgaagagatcgggatgggctgccttcaggttggttgccttcaccggtggcagcatttctcctggtcgtcaccatctgaaaaccccacacagaaccagcaaacagagagagctaacaattaaaactaaccacccacgactactataattcttgaatttattactgctattaaatgggttcattaaagttcaagttgcttaggcaaataaagtaaagacaggctccgacatagttataccacacaccggcataaccatgccccacacgacccaacaggaagacaaacgaggaagaacacacgcgcaagcctactaactgctcgtctaccgctgcgacgggccaggacggaaggtgagcaacaacgcatcctccgtgctaccaacgccggaggcttccccctcctggggaaccacgggcgcgggctcagcacgaggggtctcgacgaagcaagtccatgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcatctaggtccttcttgagctgcaggttctcctgacgcagctccaggatcttcaagttgttctcgaccatcccgcggcgcaccatctgatggaagtcgatacgagccgcgtcgtacgcctccaccatgcgcgccaggtgcacgatggtagcgtcatcctccgagctagcatcccggaaggtggtgtagtcgcgggctcctccgcgacgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcttggtagtccactccatgtggataccccaggacaacgcacatgccccgcagctccaagacgaagccagtcatgtccaaaccacgacgggtgacgctgccggccatctacaaacaaaaacaaaaagaaaaacaacattttaaaggtcagtttttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagataacttattacatgggcagcgaaggcccagcacacacaaagacaaacgggaaaccgcggaagactagggcgacgaccacaggcgcttgacggcaggcacgagctaggcaccaaagccttcatcttcaaggaactcctcttctgggcttgggaaaaattgagcaagactgagtacaaccaccgtactcaacaaggcacacccacaagtgcagaataaatgcaagggagtacaaaggaattatactataaaggggttagggtttgcattaaacaacatttaaagatatttagttgctcaaagccattttgtaaacacgattctagaactatacaatattaattatcaaggccgtgaacccacacgaacatgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccgcctacggccggaacctccgggacaggcaggcaggactgagcccctacagcagggcaccaaccctgtgccatgacatctcgactaccgggccgcagctcgtgtagccttcatttgccctggagaatgtccatcgacccccgacttcatccatctccttccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgaacccagcctaaaaccattttggggattttgaatagaaggagcggtgtgaatccaattccacaataaccagaccattccaaagcatccaggtgatatgaatatttcccaaagtctatagttggaaaaccacctagtgttacctaattaaattgcgaagcatctacctaaaagtaaactagtggtgccatgagtagagtgtccactagttgaggttttgtttatcctagggtgaacaaggtaataataacaataacaataataataaggtcataacaagggtaaataggcatgactaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatacaacagcagaaacaaagcagaaaaatgagttcttgacttcttaaggaaaaatt

SEQ ID NO: 61982 - DNA, 2360 bp, Oryza sativa
tatttcaagtcaagattcttcaaaaggaaaaaaacggcacagacacaacctttaggaaattgaaactgcttttattgaaatgctgaaaggaatatatgtgcatgtgtggtagcccccggctaaccctgcacacccgagggggggtgcggggttagcccgagccgaaacctgacacccgaccccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggtactccaaaacgggccgtgatacccttaatgaatttaagagcagagtgcttatcgatcttgacaaccggataagcctcgggccacttagtgaacttgtcgatcgcaacatacagatactcaaacccgcctggggcccgtttgaacggtcccaggatatcaagcccccagacagcaaatggccacgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcggagatccaagcaatcaatctaagggagcttggagcgctcccttcgggtcccgaggcctggactccgacgggcctcgggtgccggtcaggcgcatccgtctcccctaaggggtcgggtcgcgccgacggctgggtaagcctttcttcaaaggcgcctggtggggtctgggctcgcgaggacgcgagccttgagagttcatcggcaatcatattatcccgtctgggcacatgccgaagctctatcccgtcaaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcggaagtcgagacggaccaaatatctgaggacgtctccgttcggagaggtcaacgtgacccctgcaccggcgccctgaagagacagagaaccgtcaaactgcatcacccagtgggcggtttgaggcagctgtgaggggttcgtgctggcctcgggtattgagacggtctctggagccggggtccactctgccacaaaatcggcgagggcctggctcttgatagcgtggcgtggttcaaagtgcagatcgaactcggaaagctcgattgctgtcgcgaccgggaaaattgcctttttccgaacgcttgtgtattaatccccgtcccaggaaaagccggggtacaccatacaaacatgatataaaagacacatctttattatatcgataatatttacattattacaaaggcacttaaggcctgacaaacaaagataaacagcagcggactagcgggcctacggctccatcttcacaggcgctcaactggagtataagccagga

SEQ ID NO: 61983 - DNA, 21648 bp, Oryza sativa
aatgatgcaagaagaagcaatatgtggcatctttaaggacaccttattcccagagggattgtcggtctcagcaagtttgtggctttgccgtttagtgttgttgtgaattaaagctgttgctgcttcaacaattgcccgtgtagagcgatagttcttgctcaatctgacctaaactcatcagcacgaaaacacaattaacagacatcaagctgagaatcaagattgtgcatcaaagacaaagtgcatgttaggaaactcctacagagatgccgtaattacctctttgtgatttggaaaatctctacgaaatgaatcaaagccagagacatcagcaccattgaaactgaagatggactgaaaatgagaagaatagaatgaaaataaattcatattgcatctgaaaacactagtaaataaacagatatcacaagttcaaattataggatgatggatgaaccataatttgtgcacctgatcttcgtcaccaacaatagttatgcggttgtgggatgctagtgtctttaaaagataatattgcatagcacttgtatcctgaaactcatcaactactattgcctgccatgtatttcggcactcgtcgtatactgcatgagagatatcatatcacaatcatattatttaaaaatttatcacaatagataatattgtgagatcaggactgaaattaccttcaggaaactttgtgagaagggttatcgatgaattaataaaatcatggtaatcaagagcattacaagaccttaatatttcattgtagtgccgaagaattgaagcctattcaaaaaagtgagaggtaacgaaggtcaatagttagacatataagaatacagggggttatactaaaaggacagcttactcctgtcaaatcccccttcttttcatactcctcgggagtcctaccagaagcttttgcctgtaaaggaggatgctaaatttagggaaaagataaaatcaaactacccataaggtcaacttgatacagcaacagcttgtaatagtttttcagggacattaccagtttggcacaatttccacatatacaaagttttgatctaacacattatattgctctagacattttaatattttttttttgaatacgcaagagaagtgcatatcatttcattaagagaaggagagaataggaagggagcaatgcccaaaaacccgattggaaacaggctgaaaccttcacaacacacgcaaaaacctcacctccccagtgttatcgacctataaaggaactccttaagcctagatgccctggctagcaagcacatgcctcaaaccatgaagagtgtgtttgtaatatgaagttcatgcaccatatacagtgtaagacaggactaccattctaaacatgcattgagtatcctactggcctacattcagaattaacatgatccagaatttagcataacatactagctataattctgaggtagatgcaactaggactaatgcttctttctcatatgaaccgagagcttcacacaatttcctggttctaccgttagttgtattcattgatatcatatttattattgtctacaagttctggtatctttgttcagacctagcctggagatagctttagtccagtctattgcaaagaatcttggcaatgttcttttctataattagcacaacttttaacattatactgagaatttgaattaaatcatgtgttatgtatttatgaggtacgtggagttgtcgattactgtctgtagctttaaatcccctaagcccagcatctaggaagaaccttaaatcatttcctttatgcgttctacattctgctgtgatatgtaacagtaaggtggaactagcatatccaatctagagagaatctagcattccacacacactttaggtagatgcaacagtgcacctcactttacaggatgcatacaatataacatgtacccagttcctttcagaagctccctatgcaccaaaatagagaagggaataaaaacaaaaatgcttaaatgatgaattcttcaaaagtagaaggcacctgtgtaacaaacttctgccatttcttagctttgtccttgaaagaatttttaatatctccatcgcaattcttatttgcatctcctagaccattatttttgtcactttccaatagacgctctgcctcaataacagccctcctctgctgcccatttccatagattatgaattcagatgtgcggcctagcctttaaaggatttattagaacatcagaatcatacaataaaacaataaataagataagattccaatcatctaaaatgattcctacacttgctaagatgtaggaaataagagcgcactgaaagcagggaaaatgtgctcatcatactagcaaatatgatacaccataacaaattgtcagtcggtgaatttagagacattaaactacaattgaagatgatgactgctttgatgtactaaatcagattaagcagggaaaatgtgctcatcctactagcaaatatgatacaccataacaaattgtcagtcagtgaatttagaaacattaaactacaattgaagatgatgactgatttgatgtactaaatcagattgtgctggtatctctatgtaatgggtattttaatgcatttctgacttttatcacaatgaatagcgtgatcataaaaatcataagttaaaatagaaaacaagaatttattttcagcttcattcttttccaggctgcatcttattcagatattactttctcagaaccaaatggtctacaacactaagttcattgatatgcacttcaaagataaatgtgcaagtgtagtatgctgagcagaagcatgtcgatatccattgttgcattgtattttaagtattatccaccaacagaaaagacatacttttcagcatgggtcctgcaaagctgcaagcagaatgagtgaaatgtgcttattacaatctccttggcaactgccttccccaccactgtcccaattcgatcccgcatttcagaagcagcagcagttgtgaatgtcatagcaagaatgtttgatggtggaaattcctaatcatcaggcaaggagatatgtgaatatgtgagcttcaagaaaaaaaaaatccatacaatttcactctgattatatcaaccagtgaaccttacctctttgagcagtgtgagcacccgaccaaccattgttgatgtcttgaatcatgccaattatgggaaggaaattttcagtatatacaccagcatggaatttaatatggcatgacaggacctttgatatgttcaataaagctcaaatagacattattttttagtacaattaacttttttcaatcacaacaaagtttatggaatctgcaatattgttatgtgtgaccgatatgaaaaatacgataaaatggatggcacttgcaccgtttaacgtttgaaaggatataatctacggaatatatttggcttgaatggtcagatggatttcattcagaaacaatcattaactgtatcagctacaagaacaaaagctacaaaattaatgcatatcgataaatgactattatttttattagtcaaacaggctaaatcatgcatgatgttggtctaaaaggacctgagcatctgacgaaattggtctcagttggtttcacatcgaagctggggccaataatttatgacagcggttaactcaacaacatatgtccataatactgaagattaagacattgaaacaaaacacactggttatatatgcaattcgcagagaaaggatgtttgtacatacctttccacttcctggaccagcaactatcattagtggaatagtcacatcactacatgcagcttccctctgcctgtcattcagggactgcaaatattcgtagtacttctttggaacacacccttcattttcctcaatttctagttccgtttcctgtggctcctcctggcccttggtagcatcaccctgatggatagcatcaagatcctccaagaatgcatcgacaagctaaatattccccaagagaaaaggaattaaacacatttttcttgattccaaagcaaacctagtaattcaatttttagtttcccagttcaccttccgagaatgaggaaacatgaattagccaccaccgaacaactgttcatcatttatttgtcgaaagttaagaaatgaagcaaataagccatacctctccttcccgctcttcatggcaaattactgagggaactgaaggaccatcgctattttttccgtccatatcctcctggcacttggcagaagagcctgtatggtgcacctcctcagtaatgtcactgatgttccagaatgcatcctcaaactgccgcccaagcaaacaaaacatcctaagttcctttagccacttgacacctaacaactaacatgataatgtcttaaaaaatatgcacttcatacacaacggcatttcaaggggaaaaaaacaggtcggcattcatttgcccaacttttcttatcgaagtgcaacaaaaagaaaatttccaatacttcacagaccatcctaattctcttctaatttcaaagaatatatcacactctcctatcagtgttagggatgaggaaaaccacaattagactctcaaagttgagtgagccagattgctccaaccaataactattcatcaggaccttacagagttttccaccgtttgacatacctctccaccccctgtggcaattgaaatggccggtggaagtgaatcatcaccaaaccacagttcacagatttcttcttcatccgcatcctccatttcttcctggctcgtggctaaaggctgagcatcaccctcctcaccaatggcattctcctccttccggaatgcatctccagactggattccccacaaagaaagaacaatcaaaattagttccctattaaaagtagccacttcaggatctggtacagcacatttcatttctgatatatcgaaatggcggaagttttgctttcctagttcaaaaagaaaaaaaatcgccagtatacagttgaactgccagcagtcacagattcataataatatcacactgataaactaattctgccccccaaatccttctcgatcctaaagcaatcccatttcatgaaacaacaagtttcagaatcccttaggcctcgccacttccctcccaattacaagattcctaaatccacaaatgcgcccttagatccctaaaccccagtttagaatgaaacgagagagcagcaaaaaaaaaaataccactccgctctccggttcggaggggatcgatggcggcgcttcgccggcctccttatccttcctggccgaggaccgctcgtgctcctcgcaaatggcgtccacctcccgcaggaacgcctcgtccatgccttcgtcgtcgtcgagaaggaacctgcaggagggcctgggcgccttcggggcgggggtgctgtacccgtacccgcatcctccccctccggatccccgctgccgcagggcgttgccggtgacgtcggcgagcgggcggcgcggcggcgggcacgggggctgcggagggggcggggatgggggagggcgcttgcgggggaggagggaggaggagccgccggggtggagggggagaggggaggcgttctccttccagcgcgacattgccccccagcgaccgccgcggcgatcgacggcggtgcggcgagggtttgggggggttttttgggtggaggttggtgcgtgtgggcgggaggagaaaatgggggcttcgctgaaatgccatcctacaattgggattcgcccaaataccactttcaactgagcccaacccgctgaaatgccatcccaaatcattttcatcaaaaataaaagattttactctatttttcacatgatttgacgaaattacccctcagtcaatttcatcgttagaaataaatcggctgggaaagcgagacgcatagggttagggtttccgtccgccacgccgatctgggcgccgccgcgcgacctccctagcgccgccgcgccgccctacccttccctcccctcgcgccaccgcctcccctagcgacgacgcggcgcgcctcccctcgcgccgccgcgccgcgttgcggccgtcccgtggcgccgacctctccctcgcgccgccacgccgcgttgcggccgtccctggcgccgacgaggtctccccgacgaggtctccccgagcgccgcgtctcggccggcgccctcccctcgcgccgacgctcgaccggcgccctcccctagcgctgccgctcggccggcggcctcccctcacgccaccctgcgctcggccgtactgcggcccctctccacgtcggtgtgtcgccgtcccggatctacttgcaggagtgatgcagatggattgcagttggcatgagctcatcaccgggtagttcctaggatgtaaaggtccttttttcatatgttcatcacatcctgtgtacatggtactctatatcctctaaatcgaatgaaccaggggtattttggtcatcaaagttgtgagaaaagagagaaaatgattttgatttactacacaggaagagaatggcatttcagcgggttgggctcagttgaaagtggtatttgggcgaatcccaattgtaggatggcatttcagcgaagccctgttttgaggatggtataatccccattttctcgggcgggaggggagggagggcttcgccgaagcgttgtgtttttcaaacgaaggaaaaaatagaccgatttacgaaaaaggaaaatttatgtgtgtcggtatttttttaagaagaaatactcagcgtgttttcttgaaacaatacaccccttattactacactattaatcaagggcatctctctttgtttgtaaaaaaaaagtgcatctcttttctcttcaacctcaatgataaaaaaaccaaattttgatatgcctcctcccccgctgcaatgacaacggattcgttgtcatgtatagaaaacgaatataccaaaatgataatccgttttctaaaaagtgtacctcaatgataatccgttttctaaaaagtgtacctctaaatatttactaggctgcaatgacaaccaaaatttgttgcatatcaaaatttattatattatatcatatcgggtagaagggtgttatagtatgtaatggagggagtacgtttcgatcaatactccctccgtcccataaaaaaccaacctagtactggatgtgacacattctagtactacgaatctgaacatacatttgtcatgtgtcacatcccgtcctatattcactttttttgacggaaggagtatgtaccaaccagttgcgtgaattacaattgatgggcttttaactttctttcgtataatataagggatataatatccaatatgttgctacaagaatttaagcgtaagaggatatgggggatgtgcacattgagaatgttaaaaggttaatattgagagtgttgaaaaatatgaacaaagttattgaactgataaaaacacgtttttagtatgcatccatgcaaaagaacggtacaacatataagtgaattctgcatgtggacatcacctcaaccgataccactctgaataggagtcacttttcaccagtttcaacagttagatgattctttataccttgtttcatagttaagcgatatgaatcagatccgatttatatttactttaagagaactagcctagagctcgtaaaactagaatattagagaaggacctaatatcaaataattaggaggggtgaggctttgaacccaagtcgtctagcccaccaccttgtggagctagtcggaagacccctgggcatttctcaagctagcctagagctcgtacgttacaacggaaaacaaactgaaattcttacttattattaaatcaattaataaacacttatttagtctaagtaatgttatgattattcttattgaacaaataagttattttgaattttgggggagtcaatagtgatataggagaaaacttgttgaaaaatgatgtaatagtatagattgtggtcattagatatcagctgtaagggtgatgtggaagaacaccacccctactattaacattttaagtactctatatgtttcatattataaggtgttttgattttttttccaagttaaacttttatatgtttgactgagtttataaaaaaagtagaagtattttaaacaccaaattagtttcatgaaatatagtatgaaatatattttgataatatgtgttgttttgtgatgaaatgatactcgataaaattagtcaaatgtaaagaagtttaaatagaaaaaaaaattgtcaaaatgacttactccctcgtccctccgtcctaaaatataaatatttttagctatgaatatcagatttatagctaaaaatacttatattttaagacggatggagtaacttataatacggagagagtagtatagattaaattggacttttttttcgattttgctatatctcactcgaaagattttttcttatctcttactcgattttctcactcaaatttacagtgcattttcttataagttacaatgtaatttatggaacttacactgtaaattttgtaagttacattgtaatttttgaatcttcgcatgtaaattttaaattttgtattggatttggtctttttcttaaggatatggtaatttagtgtccattatggtgtttcttaattgttttttgttttttattatatctatcggattttaattcaaagattaaaaatctgtgtgatacaatcataaaaatctttcgagagatgtataggtactcttttttttttttctgacggcggagaggcgaggcaatggggtggtctttaacggatgggttgaaaatgggttgggctttaacggacggcccacatgtcatctggtccatcagaaccagcgacgcggagagactggagaactagggctccgcctccctataaggagcgttgccactagtggagacccgagtcccgaccacgacgtccgccgcggtcgctgccactgcactgcactgcactctaccccggcgagcaccacgaccggcggcgagagatgcagatcttcgtgaggacgctggacgagtgcatcacgctggaggtcgagggcagcgacaccatcggcgacgtcaaggtcaagatccacgacaagaacggtatataattgattaactcgcttagctgagctcctccccttcgccctgctcgtcggtggccggcaaagccaactgcatttcctctcgcgcttatcggaatagtccagctccgccttttctttaaccgtcccgattcgaggatttcagggtatgaaaatcatagctttcctttctcttaaaaaaaaaattatccgattgggtagtgaacgatcgataaggttattggattagtttgcttccacttgtgtttcttcagagcaagaattgtatggggggattggtgtatttcttgccaaatcgctggacattccaatttgattaccatttaccagtttgtaccatgaatttgggggttaatttggtttgagttgtacggcaggcatcccggcggacgaccagcggctgatgcacgccgggaggcagctggatgatcgacggacgctggccgactacggcatccagacggagcacacgcttcgcctcgccattcgtctccgccgccgcggccaacctcctcacactcgcgctcaagcacaatgagaagaagatgatctgtcgcaggtacgtcctttaatttgcgcatttccatccaaaaacccaattagggcaagtacaataatctactattagcctgtccacctcagcgtgatttgacgtggaggcgcgctatgcgaggagaagggtgtgagccggcgcttgcatgagcgcccgttttgcacaggctaccatgcaatcagtgggacccacatggcctaagcgcagcatgcatatggcccggtatgcttgatgggccaggcaaaaccaatttcattggttggccaagcctggattgttgagccttgtagagactattattgtatacatcaactgtaaaacaagttctaaatgagttggataagaattagagtaagcaatcggctcttctattgcccttgcccttaggggagtcactctccttgatttgagaatctgcggcggccccattgtttcgttttttcggggaataatccaaacggcatatttacaaattaaaaataatttgtgaacaaaatttttataaatgtgttcttaccgatctaaaagttaagcttggaaaataagcttgataaaaaaaacttcaaaatcaacttcaaatttaagattgaaaattcaaattttggttgataagtataagtataagcgaaaagatggggccgtagttcgccgcgtgcaaacgaaagtagcagcttttggttgcaaattaactaatttcttggttgcagatttgcggtggtatgaaatgcgaaatagagcttacttggtgcatcaccttttcagctgaggcgtaagaaaaagctagtactccttagtaaataggtactctctccgtttctctccgtttcaggttataagacgttttgactttcgttcaagtcaaactgcttcaaatttgattaagtttattgataaatatagtaatatttataataccaaattagtttcattaaatcaataattgaatatattttcataataaatttatctttggttgaaaatattattattttattctacaaacttaatcaaatttgaaacagtttgactttgaccaaagttaaaatatcttgtaacctaaaacggaaaagtgggatggagaagtgaacaaaacgtattgattccaccattctttgataggtactccagatgaaccgtggggatggaaaagcgaacgaaacggttcatcagtttttttttttgagatgtcttagcatcatagaactgcagttattatcacatcgaagttttaacttcagccctagctattagtttaatgttttcctgttggattacgaactttgaatctttgatcaccctttttctccatgctaatggtagttttgaagaagcatggctgtgacatgctcaagaaaccactgctgaaagttactttcttggggatgaacttttatcactctctatgaatatatacgtcgtgatggttcggatggaaatgctagttactggtgaacattgcaatgtgttctctggcgatctagcctcacccatcatatttgttcttctcttttcaccatctattgcaactgtttttggcatgctctgtgttattggatggctgtggatgtacaattggccagattgatggctatcatcaggccatgctgttctcgtctctttacaaagtaggagctgatgccttctgattctggatccctgatgttatatgtgtgcacgcgttgtggcttgctaggaaggcaaagcaggtcctccgaccgctgcccagtgttttgctgatatcctgctggatgctgatgtctcacggagatttttcgacaaactatttacatttgcaataaactttcagcaaatttcacggattccaatcaaatttggacccgccaaatgcactcggagatcgtggtagagagagaatcaggggcagatctacccattaggcagggtgggtcgaccgtcccagctatgacatatgttgcctcacaccccccaagaagcccagaccatcttagagtccccctccgcggctagcattgccgcattggacacttgctgtggctagcgccgacaaggaggtggcacctctctagtggtgctcgtcggagacgggagacccagatgtgggagattaggccattcacagcacctcatttgcgttacctcgtatgccacataggatagatacacaacgaatccacacatcttacagtgcagggtactacgggtgatcccaaaacaactaccccaacctattctctcttccactttcccctttctctcctttcccctttccctctcctactttcactcccacccacccgacacagccggagcgcgcggcggcacaggtcgccgtcgtcgccaccgacgcggcgtcgtcgtcgtcgcccacggcggcgcgcgtcgtccccgcgaatctctcggcggcaatgagaaagcggagcgaggaggacggcggtggcgcgaatctggagcggcggcgtgggaggacaacggcggcggcgcgagaggaccacggcggcggcgcggattctggagtggagcggcgtgcgcgtcctcgtgctcgtgctcgtggtcgtcgtcctcggagcggtcatggcgggcggcggtggcgcatcctcgccccgccctcctcaccgacggcgctctcctcaccgcctgccccaacgccgagtggcggcggcatcctcgggacctggcgaagaagcggcggcggcgcggatcccaaacatggaagctggaatcaaggacctgaacgatcctggagaccaagccaccggcgacgccaccgcgcgcgcagcgatcactgcgtcgctgagagccatcgccgtcacctccggtctctccacgcgccccgacttcgccgccaatctcttccccgcctactcctccgccgggcgcccagtccttgccgccgcggagctccgagctcggccccctacctagctataggctgcaggagcctccgtccacgcggggattccacttcaagttcgtcatcctggagggtgctggttccctcgcggtggcgtcgtcgctggtcttcatgtacgccaggcaccgcagcgtccgcgacgcgccgtgaggctgttcgacgaaatgcccgagaggctgttgaatgtgataccaacagtttgttttccataatttcttcttgttaaggtttgggcagactacgattaggtcaaccagcacattgttatttaaccgaacacttaatcggtgaaaattcatcagatgcaaatgcattaatcatcatgtacggaaagagtggaaattatgatcttgcaccgaaaatatttggttcggtcaaaacaaaaacatatgttgtcacactcacaactttggtactgtatgaccagaagctcactgaaggtattttaaacccaactcagcaattttggtcactgtcatttcagcttctgcaaattaagcccaatagcctcacttttcttgccattctgtctgcttgttgcgatgaaggacttgttgatgagggttgatgagggtaagaagttgttcactagaatggaggaatactcccttgagcctaacctgaagcactatgcctgtatggtgaatcggctagggagagcatcttcaaggggcagaagatatgatctctataatgccaatagaacctgatggtgaaatatggggaactgaacttggtgcatgcaaaatgcatgacaattttgaaacttgcaattgtagaacaagttcttttattgtaaataagttcatgcttttgcttttggtactccctccgtttcaggttacaagatgctttgacttttgactttggttaaagtcaaactgttttaagtttaatcaaatttatagaaaaaaatagtaatatctttgacccaagataaatttcttataaaaatatatttcatcattagtttaataaaaactaatttggtatattactatatttgtttataaacttagtcaaatttgaaacattttgattttgaccaaagctaaaacatcctgggcatgctatggttattatgtgatttctcttgtgagcaagtggcatttcagcggtttagaatcggttgtaccaggatgtgaaatatgtgtgatcaagtggggtgatcagtatgtcagagtgatccctgaaaatcaacagaacgataactcaacagacatggtctgaaataaaaccgcagatggtctgaaatttcaacaagtagcacagattcctacatcagattcacaagcacaaatcacagtttcataaatatgttctcacagattcatcaacacattgacacaaattttcagcaataactaagagattcttaaatatctcacaatcacacatctctccaggctagcaacatcgggcgaccacatggcctcattctcagcccaaattttaccattcatcgatacaacacacattaaactgaaggtttagttttatgtctagccaacatcatacagtgcatttccactagcaacatcacttcagggctatggcaacatgcacacggcatcatttactcacagcatacaaccccaagctgcatcccgtagatcagcagcaacaactggaacccagggcatcacaaagcaacatcacccaataatagcaccacatccacttgacctgcacatgtaaaaaaaaaagttttagcatcattcacaaaagcatttttgtaagaggcaatcagatgaactccacacctgcatgctgtgactttctcaccctcaactagcacaggccatccaaaagatgttggtgccccataatgattaatgacaaaatgaccagcacttgggtgatcaaccaaaccaccaaagttgatcacaaaatgtgttcatgttgctagccgcaaggaataatatgattcacatattagacaacacgacccatgtatatagttcacagaccatccaaaaggaagaactaacttactagggagaagtcaagctagatgagaacctatccactcctccacaaatctgatcagagaggagtgcaacagccctgatatgcacatccttagcccatggctccattttaggagtgtaacagcctgatatgcgcttccttagcccatggctccattttttatgtgtctacctgtaacatttgtgcaaacatgtccatagccttgctcttgtggagcagctgatgaggtaattcttgggcagtaccaggttccttatatgaactgaaaacaaaaatcgaaagacatgtctacctgctaaattagaaggtcattgttcagtttcaattttaaccaaataaactaagaatgcttacacatattagccatcatgtactgattggaaaaatgcatttgcatcctgtaatcaggcattttgcagatactttgattcctgtaattactagccaccggtacaagctgacaatgaccctttacagttacagggataattcgggcctgtttggcacagctccagtttcagctccatcaaaactgggagtggagttaggtggagctctttcacaaaatgtgctagagttgtggagctgggtttaggtagctccacaactccactccagactcaactcctggagttaattttaggagttggagctgtaccaaacaggcccttccattgatctgcgcctgaagctgctctttgtgcatatccttgagcacctgcctcttgctttttgcccaggactacctttgtgtgatccgcaggtgcttcggcttccatgccaaaggttcatctaggacacagtataccaagtaattactaaaaacatccatgggctcgacatcagttaaaaggatactatgaagtagaagaaattatatgttttgtttgtatttccatgatctctgtgtcactaatgagaacaaggctgctaatatagaataatttaatcaagatggaaaactgtatatgtacaattttaaaaggtacatatagttacatggttgaagaaaaaacaatataacattgtcatgtgattaccctttttatatcctgtttcatatttttgtgtctacacttctgatatttgttcttttagtatgtataccaaaccatgttttttgttttggtgctgtacaggacaggttcaattatttggttttcctattagtcctgcacaatgtttcacagcacattggtgtgggcaattttggtagccttgccttctaatctttctctggagtaggagtactgttgcagcttgagtaatagttgaacaatgttttttctgacatcttgtgagctagggatcatatttaatagacaaacaatattaaaggtttaataagtactaagtacctcaaggtaccaaaaattttagtgtaaaatttagataccttaaggtgctttcttctctatgctaataggttgaatcatcaatcaaacattcaaaagtaacatgttgcattgcattgcataccttattttgcttgattactgtctttcctgttgccgcttgcccagatggccggaccgccagatgctcacaagccaggggcagcctgccagggatacagcccctcatggaagcacaggcactgcagcatgttgatcatattagaattgccaatgtacagaattgcccccctgggactcacccctcgtctctcctcagctgcccaagaagacttagcagtagtgcagaatatcatccaacaactggagctctcagatggtatggatcagcggatctactccccaaatggccattcagagatcttgtcctccagctccctatatcaattcctttcctcctccgatctacctaactgtgccaactgggatttcatctggaacaatgcagctccgccaagagtgcagttcttcacctggctcatgggaaaaaacaggctgcccacatgtgcaaacctctacaagaaaacaatattgtcaactgctacatgcgagctgtgcctctgctaggatgaagacgaagatcacctcttcttacactgtccttttgcttcaactttctggtctgcggtccgaattcaaccaaatatcccctcagcacaactcttatttcagctcaagccgcctccgataatcccaatggtagaattcaagtgcttctacctcctttgcttttggtgtttgtggaatcaccggcacgatgtggtattcagaaaagaacccccctccctccagcggatccttcgccgatgtattcaagatgcgtccctctggtcagaacgaatgaaaagcgatgtatgtcccatagtttcacagtggaagcgttgcttcgcttctgccctttcatccctgtaactgcttttattcttcttactcccatgtaactttaacaatccctttcaatgaaaattcaggtggggaaactctcccccctggtgaaaattaaaaaaaaaaagaaggatggggcgctactaagtaaaccagactagaggaagtcagtttctttcaatgatacaggcaaacagtaaaccagttctttacaaagcacatgatttttgaaacacatcaggtcatctatctgaacatttctgaagattacaacatccgtatgcacattctcatagccataaagatttttcactgcacatgtatcaaacaattcaagagaacagatgactggacagattgattatgaagctaagaacctttgaaaagagagtgtgtgtcatactgtcctgtgcaccgtgaaacatgaaaactaacaacagtaaagcttatattataaacttaagcataatctagagaagtggatcgaaattaagcaaaaacgagtcggctataacctactgcatttgctacctttcaatcccatctatgtgatttcatcgaaaatccaccataatcaacttaaacttcctgtaatttcagccataaaggtcagaactttctaaggctgtacaaaatttaataattcatacatttcctgactatgtgattcccagttaccccctcaaattgaatacagcaagcacacccgagacgagggtttacgattcgcgaacctgttgtcacttctaggcctgatgcctctggagcgtcggttgctgttgaacgcgattccggcgatgcacattgcacgcgcctccagtcttggccgtcatccggccgccgaccgccctccatcttcggcatcatccgaccactcctgcccgccgccacgacggcgagcaatggcgtggtggagagcgggatctcaggcggcgccgctgttgaggacggaagaaggcaggagactccggcgagggaacgagggatcaaatcaatgtagctggcggcgggaggggtctttactcgtaaaacctagtcaaataccccatctgactaaaatcccagctggctgcctctcaattcagtgcaactaacagctcccatctcgaagaaaattacaagtgactcaaggacctatttgtttcagattaagattattataatctaaattataaaattagattattataaactgtattataataagacaatataaaataagctgctagctatttgtttctctatattattatctgtttgttagttgttagccacccaataatctaaaaaagcacctttatagtaatctagcttatagattataataatctaaagctatctgtttgtttcagtttactcctaataatctagattataataatcctaagttgaatcaaacagtaccctagtccttcctatatcaaaaagacttcgctccctatctgacgcgtgtataacaccaatctcaatgcaagtacttcatctccttcgtctggccaaattttcctctctcctcttctacgaggttgccgccaaagctccacgggggactgtccgccatgaatccctcttcttacgattaatggatcattgggctatacatcttggattgcatttgattcgatttgatttgaaggggaatcaatctgggcatttgattcgattcgatttgggccatgaagttcgctgacgagggacggttcttgaacggcataacctgcttatcaacaaccagaagcccaaaagccaaggccactgagttggcttgtacaccggccggcggccgtgctttccatctcaaagcacagcaattaattggctggttcaatcttatgccatggacatgatcaattgcaagaactaagagctggatctgctggaaatcgaggacgacactgtggcgcacaagattgattcccacagaacttccacagccacgtgcaatgtgcttatctaagccgactgcgcggcgcgttggggttgcctgtgcatcgccccggccagagcacgccggcttgccgctgttccctggcttagcagccaagagcgagaaatttagcctgagagtctgagacgaaaggagtcggaggttggctgcttgtgttatacacgtgtcatatagagaagcaaagtctttctaatctcggaaggacctaggtcctacctaattttcttccatctcgtcttgtaccgttggacctgagatatccaaaatgcaaaagctttgaaagtttgagtccatattccacgagttacctaccatagtgataccgatagtgataactgatatctcccgctgataagtccaggtaccttcactcgattacttctttctgacatggatcactgatatgctgggcgggcccagatgatccaatacgtcagagacctacactaaaggagggaaagtaagtgagagaaactcaccttcaatgcacaaaaacctaaagccaggctaaaaaacccaaagctaaggttttctcccaatataagccacaattcggtgctcttcttcactttcttcactggagacgattctgcgatcccatcggctcctacaacttcctcaagtcaggtatggcatcaacattgtgatcttctcttacgcctcgcgctgccgcctccgctgagccgatcgggcgccattcccgtagtagctctgttgttattatgggacaggctataagggttgggatattttgcgcctcgatccgtgtcaagtgggaggccattatcttcctcgtcatcctggagtttggcttccgaaactggcaccgcaggccaacgcctctgcttgatcacggcagagacaacggaaacaacctcctcctcctcctcctccttggtgttattgtcgaggtaaacttagctttccctccttattcttggcaccaaatgcatagcccccaatccaaactgatgcctaatttcatgttacttctccagatctgagaccctctattatcatagcaatataagacaaagctctgttgttcgaatacttctttctcaacaagctgcaggaaatatcctgatcatcagcatcgtagatcctccacacccacttataagtaatgcctcattagtgttgatgatgcccaaacatccaaattccttatccttaggtcatcataacatgtcatctgcaatgagaaattacccctttatcagacctccttgtttagctttatccatcatataagcaagacaatctgcagccaaatcaaacaacagcaggaattagcacccccatttcaaacccctattatccccccgcctccctctcgctgatgttgatacaaaagttcccctgctgatagttttcattacccattatctcactcttctagcaaatcttttcctgcacagtggttcctccacattaatcatctccatgtccatgaactcagtgtgcttcttttgatttcctaaacatctgggttgcattccgacagatagttcggggggtgttgctccagcgaggcaggaaacccgtggcatttgccagcgcaatctatactaggtccatttcgcggaatacatcccgattggtgttggagcagcccatcgttccagtgacgcagcaggagaggtgcgaagcttatctgggccggcccatggggcagacagcgccaggtatcgccattgcagtatgcctgttagcctgtatactccctccctttctttcttttttttctttttcttttgtctcttccgtctttaacatcagcacgtactacttaagttgctctcatcaagtcagtttttctttccaaatctatattacctcctttccaaaatatagtaatgtagaatcagatgtaacatatgctaattcaaatgaacaaaaacaaactgtaaaataggataacagataacccatttcgcttttttttttgggctggcacgatatcaccccttaaaggaataagttcatttaacttgtcaacgaatccgattttcgtccctcaacctgaaaaccagacacaacgagtctctcaactatcaaaaccagtgcagattaggtccctcggcggttttggctgacgtggcgcctacgtggctaatttgactcggtcttcatctgacgtggcattgacgtggcgcttatgtggcaattcaattcgaaaaaataataaaaccagtgggacccacatgtcagtctcacatagaaaataataaaaaatgtgggacccacgtgggacccgcatgtcagtctcacacataaaataataaaaaaaaatagtgggacccacgtgggccccacatgtcagtccaactcaccctcctctctccccatctcccctcttcatctatctctcctctcctctctcccggcgacggagaggcagcggcacgcggtggccggctgccggcgggagaggagggagcggcacagccaggcgcggcgtacggaggcagtttggcgcggcgacgtggcaccggcaatgaaggggaggaaggcgaagggagctccatgggcggcggtgggtttggggaagggctggcggcggcggggagctcggtggtggcggggatggaggtgagatcagcgcggggtggaacggagaggtcggcgcggcgtcaacagcatcggccgggcgcggtggctcggcagtgcgcggccaggaagtggcgtatgggggaggaatcgggggcggcgccgggcagaggagggacggaaggggagcttcacggggcggcggtggattggaaggccggcgcagcgg

SEQ ID NO: 61984 - DNA, 1640 bp, Oryza sativa
aattgagtctggtcgaaatttatctatttcgtttttaactaattgactgtgtaatcagagcagtttgcaatggtttgacagccccacggtcaatggatacagttggcatctcaactaatgaatttaaatgcaatagtttgacagccctacggtcaatgatacagttggcatctcaactaacgaatttaagaaacgttgaatgaaactattaaaaaaaatcaagaaacataagctgtgcacatctacctatcaaaccatacagggaagcaccattcgtgtcgttagagttgtgagtgtacgactccattattacggtttaaatcctaattaatgttcagagactatggttgtgcataccattagttggtgtagaaattgcaagttatactttgtaaaaaaaaaacatcaaaccatatgcacagcttccgagtcttaactcctttgcctcaacctcaaagcaatagcagatttgattctagtgcattctatttttttttcttggagaggtagtgtagtgcatttgtttattgttttgtacatcaaaacatgtcctttttgaaacaagagttaaacttttaaaacttgaacattagtatcttctgaaacatttaagattagactagatacgcgctgcaaatctcctaatcctgctccatatccgctaatcacgctccaaatccccaatctcgctttccaaaaaccacgctttctttctcctctgaaatgtatctctatatatacacgaatcgagttggtgtgcaactgtacatactcgagcaggcagagcaaccaggccatcagatatctccacggtatgcaagattattcagacatgttatctcagtcttgctttatctttctcattagtatttggaatatagtgttatccagtttttgtgatatatatatatatatatatatatatatatatatatatatatatatatatatatatatatatatatatatatatatatatatatatatatatatatatatatatatatatatatattgtgccaagatcattggcatattggattgtgcggctgtctcggttggatgactatgctctctttctaaaataagagttgaaacttatcggatgcgtgtttatattcttgatgagggaatgaacaggggtgataacatttaggtcttaatcaaactattcagtaaaatatttattaaaattatggcagtcattgttcttgctacttctgaaattgtcttcgcatagaaatggccccaacgaatctaaaccgaaagagaacgtatgcacagtttgggcgccgtgcaagacctgttgcgcatgcaagacctgttgtgcatatgtaagttagttgatgaattggttagacttagtaaggaatttatattgttgtgttattgactgcttgtttgtttcagaaggttcaagtacttcgacgatgttgagtttgatgattgcagggtaaactgaacatttagtgttattgtcatggtagaatggtagatgcctagttccttgccgaggttgatggtgacagacaacccttcatattgatggatgctactgtaagtttcattatttcaatatgaaaaaatataaacaaaattaaattaaatatgattggtacaattgtagggcttgaaatatg

SEQ ID NO: 61985 - DNA, 18379 bp, Oryza sativa
  unsure (1)..(18379): unsure at all n locations
gagggagctgggccgagaggggaggaggcccaagagtaggagggagagaaggagagaaagagagggaggagagggagactttgaactgggcttggcccaaaggaggaagaggagggatttttagcttttctttttaataaactttgatcaaggttgttgttgcttaataattatttccggtgctctgaaaattcaagtaaaatttgagggctctttttagaccaaggagaatttaacaaaaattctccgggccacattggaatttttcttgtacgtattttagtgtttgccaatttcttttcgcattttaattaattctattatgccttttagcgaatgatttttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatagggcttcagttccagaactttgcatagttcatatctttggagtcaacctcatacaagttacccacttcatgtcatgcgtcgagatcagctcgtcattactaagataccatgcttgtcatcatttagcattcaaagtattcccttacacattcagccctgacgtattctttttagatttctcttatcaatcacctttcgacctacttctttgcccgataataaacacctttgctggtatcttctatcaataaccttttgaactttgtcaaccaagtactcttcactccaagagttgtggatgcttttggtgacgatgcggtcctttggtctgctgcctttcagtgaaaccttcaagtgttttgccaaaagctgtactgactgtctttgtctttgatccgaaaaagacacatctgaaattcttaatcccaacaaatgtctctttggttaatcgcttgattttcttttccatcctcaggttggttattagttcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttcctctatgggttagaattaacatgaggcctcacaggtacggcgtttgctccagtgaccacaaggcgagtgacctgtcttcttcttgcataatggccggagtgatggcgcaggttacgcttcggctgtggacaatctctggagaaatgacctggttctttgcagttgtaacaaatcaacgtcttctttgctgagctgtccatctggggatgatcattgtgacttggagttggaattggtggttggaaacccttgctaacattggcatcagcggtaccatcgttgctatcaccattggagtctttctcagtgtcaaaattgctaaggttgtcattctgggttccaacattgatactatcgttgacatcttggcgaatgctaccgacattgcacgctttattcgagtggtcactaatggggcaagaaccatggttgttggtggtatcatcattattagtattgctagtgttgttgtctgcattgcattcatcttcttggggcaggaactcttgatgcacaacaggagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgttggttgcccctgctgggttgttccgattctgtaagagttgaaaggctgttgccaacatgttggtttggttaaccacaacttggattagctctggtgaggtttcgttgatgcttttctcattcccattggcttgggttcttgagtcatcggatccatcattcccatagcctttgttaccagtgttatccatctgtcacaaggtaggggttgagagaggaagcatacaaggaaagaatagaccagagctagggacaggaccttaaaggaactaactctttttgttgatgtgttgtgtgttttgcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggagaaggagaaaaagaggaactttcgcaaataattttatttataaaatatgtccttaggttttatccatttggcttatcctacagtcgagatggctctgataccagcttgtcgcgaccgggaaaattgcctttttccgaacgcttgtgtattaatccccgtcccaggaaaagccggggtacaccatacaaacatgatataaaagacacatctttattatatcgataatatttacattattacaaaggcacttaaggcctgacaaacaaagataaacagcagcggactagcgggcctacggctccatcttcacaggcgctcaactggagtataagccaggactccacctaagacatctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccaactcgtcccaagccaacccaggccaaccattccatattttagttgttgagcaaattttaagaattataacactgacctgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgagccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccaccacaaaccaataattccatagtgtccaaatgatatgagaattcccaaagtctaaagttataaaaccacctaatgttgcctaattattcagcgaagcatctacctaaatttatactagtggaaccatgaacagagtacccactagttggggttttatttattctagggtgaacaaggtaataataataacaataacaataataaggtcataacaaaggtaattgggcatggctagataaaacagtgataacgcgggaatttaaataaagcggtaatgcaataatttaaatcaacataattttacaaactgggattcaatatgttcaaggatgatgtgacttgccttgctcagagagaacggacttccgatccttcggcgacgaccacgaaccacgcttcgggaacctccggaacgacgaaagctacgcgaagcacacaagcaaagctacaagcctataaagaagcaataacaatacataaaaacaaagcacagggttctttaggttatagcaaacattaggagacttgaacgggtcgattcagagttcgtatgaccaagatatgatcatccgaagtttaatgctgttatatggagatttgcggattattgtaattaggttttgcaactataaaacatgtgtaagcgctagcctggaaaagacaggaaggctgcgccgttgacatgcggaccccacatgtcaacctaaaggaccgcggtagaccgagtgcacagagacggtccacgggtcgacggaagcggatcccgtgtgtcaaccgaggcgagtggccgacaaacggactccactggacaccacacggactgcacacgtggaaaccacgcggctaccaagcgggcacacaaacacggacactacacggtcaccacccgcacacgtgaacgactaccgacaccggtacacgggtaccggggtcgacgaccgcacaacgggtacggggcgacgccgaaaggacgagggcggggaagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacggggcttgacgacgcggagccgagggcggagacgaggacggggctgcagcggctcgcttgacgaacgcggacgacggacgagaacggctcgacggagggacgaacgccacgacgaccgggaacgacgagaggacgacgacgacggcgacgaccgggaccggcgaggaggcgacgaggacagccggcagcggctgcacggagacgaggacgacgtgggacacgccgctgcgatgacgatgacggaggcggcgccgcgagacgacgagccgggcgaccgacgggacgtcgatgacgagaacgatcggagacgacgatgatggcaggcagcagcggctgagaggaggaggggacagcgtggaacacgccgctacgacgttggtgatggtggtggtgcagcggggcgacgagccgacgaggaggaaggagaggccggcgcggagacgacggcgttccggcgaagttcgggcgaggaggaggtggtgccggggatgagagcggcgtcgtggagccgaggaaggtggtggcgacgtcggccggcgctccggggacgtggcagaggcggccggaggcggagaagtggtggcgacgccactggacgccggcgaggacgcgtctccggtgctttccccgcgaaacggagggctgaccgagggagagggagcagctgcgaggccgaggacgacgtcgcggctgcgatgccgaagatggtggtggaggtggccgaccggtacacggcgaggagggacgggcggccgaacaactccggcgaggcggatgtagaggttcgcggcgacgttccggcgaaaccgagggcaggccggggtggagggcgatgcggcgtcgccgagggaggagacggcgacgtcggccgacgctctggcgcggcgaccgggcagccggaggagatgtcgacgaggaggaaggtgaggccggcgcgggcgacggtgttccggcgatgttcgggcgaggaggaggtgataccggggatgagggcggcgtcgcggagccgagggaggtggtggcgacgtcgaccggcgctcaggcagggagatagaggcggctggaggcggccggcgcgaaggaaagaggaggacgacggcgggaacgcgcctccggcggtcaccgcgcgaaacggagggtaggccgagggagagggggcagctgcgatgctggaggaggcgacggcgcggccggacgatgctccggtgaggagggagaggcggctggaggccggccggcaacgtgggagagagagggcgacggtggggaggtggctagagaccacgggagagcttgggaggagaccaaaacggtagaacgcaaagagggggttctattttataggagaggagagggaaccggccacgggggaggtcggaacggcggcgagaaccacggccggcggcaatggttggtggccggagaaaacgcgagcgttcccggcgattgggggcggcattcaagggggaaaacgggggaaatcgaagaggaatcaatggggattaattgcccctaatcaatttggtaagagccggcttgaatagagcggatttagaggaggaatggcgctagggctcgctcgggagagggagagaggacggccgggcgggaggaaggggacgacgcccgcctgacgcgcgggccccacgcggtcgggcggcggcgtcagcgcgcgcacgcgcgcggcacgtgcgggaggggagcggctcgggggctggggcggcttgggccggcggccggcccaggaagagaggagggagaggcggcttgggccgggcaggccgggaggggagggggggggaagaggcagcccgggagagagagggaggagggagctgggccgagaggggaggaggcccaagaggaggagggagagaaggagagaaagagagggaggagagggagactttgaactgggcttggcccaaaggaggaagaggagggatttttagcttttctttttaataaactttgatcaaggttgttgttgcttaataattatttccggtgctctgaaaattcaagtaaaatttgagggctctttttagaccaaggagaatttaacaaaaattctccgggccacattggaatttttcttgtacgtattttagtgtttgccaatttcttttcgcattttaattaattctattatgccttttagcgaatgatttttatttcgggatgaatttatcaggacgtgacaattgcccattttaccactcgtcctgtaccctctcgattatgcaagatttgaccgagggggtaagacgtaaccacagcgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccgtcttctgtgccgatgacctcggggtcggaagacgacaggagcggccttcccacagtggcctcgggaccgtcctgggggttgggggctcctggtgtcatcggacaagcgggcaaagggccaactccggtcgtcaggggccttaggccaccgttcggctcgggggcctcttctccctgctctctcccgggtcgaatcggtacagggttagcctcggggtcagagagtgataggtgcggcctccccgcagtggcctcggggccttcctgagggtcgggggcacccgacaccgtctgacaagcgggcggagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcagggactcatttggctccggggcgactagaaccggaggagagctaagatacgccttcaactgggcgagggcattttcagcttcctccgtccaagtgaacggccccgagcgcttgaggagcttaaacaggggtagcgccttctctcccagccttgatatgaaacgacttagggcggccatgcaaccggtgacgcattgcacgtccctaagtttgctgggggggcgcatccgctcgatagctcgaatcttctcgggattggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacagcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgcttcatggccttgaagctccggcgagagacgtgagcacacgcccctccatcgacggtggcaatggtggccccaggttcttggaaacctaggtcatcatcaccatcatcaatgtcaacagcgggggccttctgcttggcctcacttcgccgtttgccggatgggaccgccggggacttgccctcgcggcgttcctgcctcctgtcctcctcccacttcctcgttcgctcagccaaatttttgactgcgcgacagtccgcgagatggtggagggaggtgttgtggacggagcaccacctgccggcggggcgctccctgctgggtgtaccagccccgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcagattcattagccaaccccgcgcctgtccttttagggccatgggaaagaagttcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccaacaccaccggccgggggcacggagggctgatcttcacgtccatgtcggagtgacactctggacgaggaggctccctccgttgcacggggagtacgccggctattacaccgacgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggttgaacaagaaaaacttggggcacacggaagagtctgagagctctgaaagcacacgctgagccccctacctggcgcgccagatgacggagctggtggctcctcaccgggggaccgcgcaggcccccctttgccagttcggccgggggcttagggtgaaatctcaagctctcgctctctctctgtatgtggaaaaatcgtatgccagccagaaaacacgagacaccgacgatctatacaggttcgggccgctgagaagcgtaataccctactcctgtgttttggtggatctgtgtatgaatgggctacaagtgtgagctgacttctcccccgttctaagctcataatctgggaaagaatcaacaaaccccccactctatgggcaaggtcctccttttatacttcaaggggataccacacgcacccttctctttccaaactggactgttctttttctcttgaatgggcggagatcagcacggttgctgtccgaatgacgctccgatgggacagcccacacctacctccacttccgccgggagtgagcgcgtcgtgggaacatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcttaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagaatcccacgtgacggcttgagaatatttatatgaagtttaatgtaattttagtacattaagaatttaagataggtcaggggaaaactcaggacgttacacaggacgaatccaagctgatggcccaccttctattcccttcttctcaacacgacatacggcgtcttcgagcagcaggtgattctgatcgacttgcaatgcaagagcgccggcaaaagttgaaaaacaataagcatgtgtgttcatatctcgttttctgtcgtgtaactagatgtatcgtcaagaagaatctatatatataagcattctttaaattgcaacatatagattagtattattgtcaacagcttcagatcagttttaaaattgtacgtgtgattgccctacttgccgatggtacatgtgcatttatgggccggctaatcatgtggattattctggtttgtttactagtgtagtatattactattattctctgacaatagtagttctataaggttgatataatatattccaccaactcagtaatcatatgaaactacagtgattgatattgatgtttcatatgattacaatatcaaactatagcggttccctaatcttaattgtagtaaacttagccgctaaatccaacggcgtaagcatgtatatgataaatgtatactaaacataattaatatagaagtgcagttgtatcatactgtattatttaacaaaagtaatattttagtttcacctcgcgaagtgaaaacaaaaataatttttatctatgaaaaaaaattattttatataaagcaaaaaaataatatttttaccattaaaaactgtatatatcgcatattttgttatagtagtacgaaattttttataagataaatcttgttatgcaagataaaaattatttttgttaaataatatctcataaaataaactcataaatataatagtcgcatataataaatttatacactccataaatatagttcataaatttatattttcttgatagcaaagggtaaaatgaactttatgatacgaatttaacggtcaactaacggttaactgacggaaggggtatagaagggatccaagctgaaatttaggggtatggaaggaaatgagcaaatctcagaggtatagaaaggattaggcgaactttcaggggtacacggggaattttctcaatataaatacaatacccttgggaatactcatgagtaaagtgctacatcggtttgcgaatttatccgtgatcataagaaataccaacaagcgacgagcgacgaaggtggctctcctcggtctctgccggcatgtgccccctcctcggcctccgccggtgcatgcatgactgcccttgccgaacttgctaccgagccagtcgaggtgaagcatgcggcgggtgaaggtgaagcccgcaatgagatgtgaaaggcggaagggcggcgacagatggtggtgatgagatcacaacgattggatctagcccccagagcgagctcgacagtggtgaagccaccgggggtgccggggtgggcatgtcacccccatcctcatgcgctgcaaaccccccacccccgggtgataagccatctaatccatacaattaactcattaattagctgcaagttgagcctatacataactgtccaatagattttagctttacgtgattatctgagttaattaatgtaactaagcaatgtagttgcaagtctccaaaactaaaaaggatgaatagaaatgatgtcttgtcattaatgtattcagtaaagttggtgctatttagttccctaattttaaaaaaatgattcttttatgatatattaatgtacattcggacatacaccctccatcctaaaatgagttcaattttttacatgaatctagaagaatgtgttgaaatatatccaaagtcatatcaacaatcattttatttatatattagtgcaaaataaccacaaaattcaatacaattatacgaggggcgactccgcatattagagcgaagaggtgaggccaatctgcccctctataggaactaagccaccaagatccacaccattgtctaccgaggcacttgtgagttcttacatctcatggccagcacccctatcactaaatcctggcttcgccactggagctcgacctctgccccgctaagatctgcctccattttgcacctcggatctgtgcctcgttggatccgcgttgcctccttttggccggcttggagcttcggaggaagtggtgcggggatgtcgtttgtggtgggggcaacaagccaaggacgtggaccgtgccacctccgattcgttgctccttcagtcggtcatcggcggtttggttgaggggatttgtcgctactcggttgcaacctttgctgagagagagagagagagtaggggaggggatggcttgagggagagagataacaagtggtcccatggattttttattctattttctttgctgattggattgccacattgacgtctcgtgtgcaatctcaatcaaaaccacccaaaacaatgcttagggggttatttgtctggtattaatagttaagggcaaaagatatatattttttaaacgagggataattcatactcattgaatagttcaggggtaatttggattttttttctttaaaaatatttggtctaataatatattatagaaacaattcataaaatcattgaactctagtagattctctctcgttaccacttactagctttgtcctttgtttagccccatcgttctctccctttcgttgcaaagggtgtatttagtgttgattcgtaggtaagttgttgattttatcagctgatgccggttagttagggaagggataaaatcccaccggttttcttttcctaacaagagacaactaagtgataaaatatgttttgtttgatcggtacaaatggattcgaatttaattagagataaagcccctgagccccaccagtgtcggtttataaggaaaaggagagaggcatattgttggcaactttttgtgacaagtcaacaagcacgattgcagcacctaaacaccttgcggtgatactagagtcgccaaccaccctaacccagtaagcgctaagtcaagatgggttttgatagattaaactggctagcggagccgatttagatgaaactatggataactacccatcttgtgagcaaacagaaggttttaaggacaaacctacaaagaggtgtcgcactctcgcagcagcggcggacgatttacggcgcaaatcgaaaggtggacaaactaaactagaactagaaagcaatattgaaaaaagcgattcgattgattgattgtaggataccttacaattgaacaggccttgtcccttatataggggttggtcttgccctctataggccctcctccacgtccaactcggggtagaaaccaaaggaaacctgaaacataccttcccgagcaaggaaaactcgagacccaacaaaacagactcagactcggactctgttggtcagaccggccacatgccggcggtctaatcggagttctggccgcagcagtctgaccggcctatacacgacggtcaggctggccttctagaggaaaacaccggtagattccaaactttggcaatttttcctatttcaatcctaggtgtcaattttaggtgtaaacacatatgtcacggccgaactatctctaaccctaaaaccctatttcaatcatccaatctattcagcactggaaggggttcataaggtatctcgcaagaagaagaaacagagaagaaaaagaaaaaaagaagaagaaaatcgaaggattagatcattggattaaatggcttcacatcaaggtcagtgaatcgatttattctccacataagaaaggtgattatgcctaggctaagaactcaaattaattaagtggattaaactccacaaggtattccttgatccagcatactccaacaaggtaaataaataaggagctaaaagtaaaacctcgatttatatagttgaatattgacggattaattaagaaatgctcatgggtatgtcgatccacacagtaatcttatcggcagataacaactcaggagctttcggccttatcttttcgcttatgctttacttatcagccaaaatttgaattttcaatcttaaatctgaagttgattttgatttttttttatcgaagtttatttttcagcatttgcttttagaatgctaaaaacacgtatataaaagttttattcataaatcatttttcgtttgcaaatatgccgttacgcttatgcttaaaatcagccaagtgatggcttcctttgtttctactagttaagatttacaaatgtcggtccaaagaaattgcgctcgcaattcgcgtgtctctccatttgtaaaatcaacaacagagagatcgagcagcagatcgatatatatattcaggtaacatgcatacggcaagctaggtcaacttgcagctgcaggacgtcattccttaaagctggcgagttctgttcatgtgattgcatcaaagattgttggggaacatatataatgttgtttaattatgcaaatcgcctcgcaacaaaaactgtttgtttatgcaaagcatactaaagggatgctcactagattaataactggccagggcggcacatagctagttatattatcatcctaatccgatgattcgatctgcgtttatttggttctttaaggtagtgtttggtttggggaccaagtgggatgggttagacctatcccctttttttggatgggatggttccagttgtgtgtttggtttgtggtataggatggttatagttttttgtttggtagaagggattgaggtgggatgggatggacagtgtttcacggaccgttagaatgggggacggatgagcaggtcggcgcgagcgaagcataggcagcgccgcatcggagccgaacgggaggcggcgggagctgacgacgatcggcggaggccggtaatggaggcggtcgcgcacgaggtggaggcgggtgcggagatcacntgagtatcggtcntggggtaggtgtnagtgnaangctatcaaatnntnnntnnnnncgcctctggtgggggaggcgtgagcgtgagcagtgcatagccctatcgctcgcgcatagcggttacagtacngttagtttgagttggaaagcataccgcttcagatacacatagcatatgcgtacggctga

SEQ ID NO: 61986 - DNA, 58710 bp, Oryza sativa
  unsure (1)..(58710): unsure at all n locations
tatccacaacacagctgggtaaaagaaactgtgctaggtttgatatttctgatgaccgtggtttcactcacaaccgtagtagctgacagattgataggtcttgaggtcagatgcaattcaagaagttccacgtcaggcctattatcaggcttgctcaattacaataccatacttttatatttcaattagtaaggtgctaattctttgtttcgattctactgcaggatacatatgatcctatgttaagggaaatactttctgacagtccaacctctaggctattgtgtgttttcctatactgtgtgattgctccattgtcagaagaaaccatttaccgtggattcctcctaacagccctgtcatcctcaatgaaatggaaggatgccgtaattgtcagttcactcatgttcagcatagcacacttctccataaataattcattccagttgtttgtcatcggatgtatcacagggttagcttattctcgaactggtacattggcagcgccgctcaccatccattcattatataatgctgcaatattgcatatgactttgatgtcttaactttcttagggtttcaggtacatgctaattgtttccccactttactgctgcttcttcacacgtaggagttttttattcacaatccaaattgtttaaaatcagtgtgctatatgtggttaataagatgatgtaatcttagaattattgttccctttaggcctaagtacataccaataatgtcaactatcttttttcagtgacaccaaacgaccgtgcggtgattgatgacatatctttctacccttctttcagttaggctatgagaagtgctattattctgagttccacacatgtattttctagttttcggctgaatatggataatcttcatgatatgtcctggacattctttttatgccaatacaccataaccatctgagaaaaagggtactcttaaaaaattcaaaagcaaggctgaataactaaagattaggaaaatgatgcaaatgtttgtagcctttttaaatatcaaaagaagaatcagaaaatctacgaatgcatgtggatggctaaggaaagagtaataattcagaagttctaagagtgaattgtatgtaaggataggcatatttaccaaagtttcattttgggctacccctaaccaataattttcacttatggctaggtattggtaccaatgtattgcactttgaaccagtgagccatgtgtcggcaggactaagagataaaatatgacactagctagatggggaggagtcggaggtgtggtcctcttctccgttctcccacaccaatgagctcctttactctcaggcaacttttctttcttgtgcagtttcccactgccccctgcgctttagccacaaatccctgcgccttagtcaattaatcttgtgtaacaaacatccttacacacgcacaatgttaaaaaaaactgcaaattttagtacaaattgagtgtgacttttaaatttctttgtttttcatttactacattaatctagatttatttttatgcttatctaggctatattttcttttaccaaaaatgttataatttttttattagcatgatctacaataaagtaccaattcttcagaaaagtaacttgagttgtttcaacccaaaaaaaaaatcgacatgtaagatgttgaatgttgatatacaagttaaaaaatgaggttgataggtaaggaaaaaaaacaattactaacaaacagatgcccccttatccagtacaaatgatatccgccacaccagaaatgtttttgaacatttcatcttgcttttctctatagtctaaatattgagtcaactggagttataaatgactgtttttaggctggtggtctaattgtctagtgctagtctagctgaactaaattgtggtcctgaacttttaaaagtttaactgtggtcagaccacaaggagggtcttcaagttaactcaggcttggtagtttgattttttttcttttttgatttttgtaaccgttctctccctttggttattgaacaaatatatgcaagaaagattaattggaacatccatttaaatgaaatgaagtctttggaccaaatcattgccaaacctcaagccctttaatttgatactgctgaaagaaattacaggagcaaagctatatatggaagtgaaaaatagatgtaacaattgagatcacagcagcagtatgtgcatcagttagcaaaaaaaaaatatttattcttcatcacaagggtgcatatcgcctatcaatctgcagcttgggacaattagggatcgtgtcaacagaaatcataatggcattcactgcagcttcagcctcctcagcggtcaagccataacagttaatataggcatacaccttggtgaggcagtagagatgctgaatcccaaaatcaaagctgccatcccaagacttcacttgaaatgcactgatcaggatatgaaggtactcgagctttgccatagatcctgcctcaaaaaccaatcccatatgatagcagtgaatcttaaagaatgttagagattggaatccttggctactgatggtgagcttctctttaggggcctcatcggagaataggtatagagtgaggagagaaggtatgcttccaagcatcctcagatcttcttggttaattcttttgacatatatatgcaagtactgaaggtttgcaagggattcagtccagtttggtatcctggaaatgggatgccatcgaccaatgtataatttccggagtctacaaggagcaagggtccacaaatgtagtgagaaatcgtcttcctcgtcatgtccatggatatcaagagaaagagactcaaggtagcatgtgcctagcttggtgagagaaatggccagattttccctgtaagtttctgcatttccttgaaagtcgacgtagttccaaactaccctcaacacccttagactggagatctttcctatctcttgcagaaatgttgaaggatacatgaaaacagagaaacctgttagctcttccaatgcttgcatatttccaattccatcaggtagtttaacatggcaatcaacaagcagatgcgccaaccgttgaagctgaacaattgctgaaggcaattctttcacatgagttgatctgatgtctaatgtctccagatattgaagttcccgtatctgacatggcagatcacttatatctgtccctttgatgttcagatacctcaactgaattagtcttcctatacttttaagatcatggtttttcaatccactacaattttcaaggtccaacacacgcagaccataaaaacccagaagaggaggcacctgtccagcgtgcaaaaatgtcgtcaatgaccggacatgggatctgagcaggtatgttggcattgtgacacttccttcactgtttttatggaatgataggcgacgaatcttgccagttggagtagatgtgagatctgaagcaccaaccatagtaacaaaattttcttcatttgatctggacacgacgaaatcaaggatggtatcgtgcactcggcaagcatgcacctgaccatcatcctctatgtctactggctggagcaagctcctattgatgagctcattgaaataattctctcctatctcatataggctttccccttgttttgcatgaatgaatccttcagcaatccatctacctattagacgctctttctttatcacataatcttctggaaatatactcaaatacattaaacatgtctttagatgatgaggaagatcaaagtagctgagagataaaacccatgccattgtttcaatatctggactgttttcttgtgtataattaattcgacttttcaccttatcccactggtctaatgattttggtttggtagccagcaaacttgatatagaaataatagccaatggtaagccaccgcactttctcaatatgttattggcagcttccctcaattgaggagggcacctttcatcagaattgaaaattcttctgaaaaacaatcttttggagtcagtagcacaaagagctttcatttcatatacttgatcaccataagagcagcagcaagatttagctatttcatttatacgtgttgtggtgactattctgctaccttgactgttcttgaccaatgcacactcaattattctccaagtttgtgcatcccatatatcatcaatgacaagaaaatatctgtttcacatgacttttaattatcaaccaaggatgtattgatacagaaaagtttgttccaaaaagcaatagaaagggaacatcatttgagcctgtattgtttctacaacttatcttctaaggatgctaattgtatcgtttctacatttcggtacctcaatacttaaaaggcaccaaaattaatagtaaaagaaattgattaatttatgctccttttgtcgtaagaaaacattggttctagaatccaaaactgaaacccaacataccttttatcctggaggtattctcttagcttgttgattaagtgatgttcatcagccaatgcaccaccaatggccccggaaacatcagagaggaattttgccagaacatgcttcacgtcaggattttgcgacacggtcacaaaagcgctgcaatcaaactgatttttaacttcaaggtaaacttggtttgcaagtgtggtcttgcccaaacctccacacccaacgatcgccattgttctgagccgttgtgagatgcctccttgcgtatccattagccatttgatgatcttatcctttggtccatcgattccaacaagtctctccgcctccgtgtagagagcggacaatcgaggatcaactgatctagttctagaaccggaggcatctctgtgcagatgtgcttcagagctcatgctggagatgttcatcgtgtcgtaccttctgtaccgatcgctctcgtccatgacacgagccttcagctcttgtatccgcccgctgatccgatgcgacaactgtagccccttgattctccatgccatcttcttgatgaccccggctttcccggtgagggagccgaggtgatgcacgaagaggtcgatgcaatcctcgatgtcgtaggccatctcccgcaccctgtccctctactcctttgtctgggcatcgatttcctccatgtctgcgagcctctcaagcatcgagttcatgctgcgaagctcgctctcgaggaacctgatctccccccttaaccctttgagagatttgtgttcgcttccgagcaggtcattgagcttgaagagaagagagttcagtgcccccgtcagagcgcttaccatggctccctccatatcgctgctgagctgagatattctgcaggtaggcacaatgttagagttgtcctagcaagtgttactatatgattactagaagagactatgcaagtctctcttcttgagatgcacaccatttgcaagtctctcttttgcaaacacgttattgctaacgtttctttagttgttgttgactttggacaagtacatatttggtacccaaaaacttagcttaatacgcctctagattggtgcatgattaacttaacaattttcttttttctgttacacgcatacagtacaagataaaattaacagatatactttagggaaagtggaggatctcctttagagtggactcaaggaataactagtgcaagatgttaaatgttaggagttgttttttctttccattattagaaaaaaaatgttgtcttcttgtacctctgcctgcctgagtacttagcatttactgaagccctaaatggtcagagaaagagagagaaccatggctttaaaaggtcacaaaaggcatgcatactactacacattattaagatgctaccagttgcaagcatagttaaaataaccggaccagcagtcaaatcagtagtgctttcattggttcattggtctgaccggtgggtcaaagctcaaccgcggaacaatgttttaatatatgtacttatatttaccacaactaacaatcagtagctcatggggtcctactgagagatcacccgcactcccctccccctatgccgattccttcctcttctccccctttctcctccccatcttttcttcctattacagtacaccataatttttttttaaaaaaacaaaagttagaaaaaattatggatagaaataggatgaatagctaatttagtccttcaagtttcatcgaaggctcaatttggtccttcacgtttcattttgtccacataactcctctaaatatttgttttggcttgaaatcatccttgggcccacttaatatgccatatggctatttgtagtcaatatttctattagaaaatgtcccttttgcccttaatttgtatttagctatatactagatagaaaagagaaaaccaagatgaataaataacattgcagatgtttttcctattatttcaacatgtgcacatgaaacttaagcaattactatcgtatacatttgctagtacataatttattttcgttttacataatttactatgcattttctataaaaaaaaatcaagcatgcaattttctgttatatatgtgaatgatgggggtataagtgtcatttatcaagagagttgttggttcaaggataagtttgaactaagatgaaaacttgaatgactaatatggatagattgaaacatcaaggactaaactgagctttcgatgaaacttggaggaccactttggctattcacccatagaaatactatatataaaaattcaaattcaaattcaaattcaaatttgaatcgggtatgtaaacttttgacttataaactttggatctataaactttaggtgtataaattttagatgtatagaaatactatatatagaaaatttttgaattcaaattcaaatttgaatcagatataattcaaattcaaatttgaaacgggtatataaacttttgacttataaactttaggtctataaactttaggtgtataaattttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaatagaaaagtaatgcggtgccaaaaaaaggaaaccaggtggagggagggaggggggaatggggcgattgctagccaatagccagggcgattgatcgctcattagagtttccgttgctcatgtggtcactgtaggaagtttgcaatctatcctccacaacctatttttgcaccgatgctcaaaatatggcctttcaactctagtttggggatttgggtcctctacattagagaagctaatgcagagggtggcattagctccaatccagtccatccatctgtatcctctggattagataaggcaaaaatgaaatgggccttaggggaagagcagtaggcccaggttgattttagatgccaaaacctttgcaggactcctttttcctccaatttctacggacttgcttcctatgagtcttttcattttctctctctcatgccatacctcttccaatttctctcaacactgaagtggatctatgaagataaatgaacaggagatggagagaagtacgatcaaccaaactttagagaggcaagtgaagattgctgcttgcatctatttttttttatggttttcttggcttccagtaacaaattttgaggcatatttctatctatcatgtgttctacttatctcccaatttctcttagcgccaaagatgcttccacaaatatgagccaacaggagatggaggaaagtaggatcaaccaaaatgcagagaagtgaaggtttgttgcttgcatctattcttattatttcattggttttcaatagcagtttttggggcatcttccaatcaaacatatgtcacagatggttttcttatttatttgtagaatggatagcacaccatgttggatgcctaggactggaatgaagtttagctgtgtagacgaggcttggaaattttgggttagctatggtggtaagattggctttgatgttaggaagcagtataataacaaaagtgcagcagatgggcccaagtagatggtttgtttgctcaagtgctggttatcgaggaaaacataaaagagattatctaaccaaaaatcctctagtagagacaagaactggctgcaatgttcatatgggaataacattaaacagagttgaaggaaattatgagctatatatatgatttggtgactgaacacaaccacatccttcggttgccagaaacacaccatctaatgccatcacaacattcgaagagtcgtgagataggggagcaccctctttggcggcgacgcggcaagtgccggttcctccatgcacgcgcgagagagtggagccttatccggcagtgacaaaatgggcagcaacaatgttctcggcgctttctctggtgatgggatacctgagtcttgcaatggtaagtggatgttgaggtatgtcaggacacactccgcgctaggatcaccctaggccaaataccaatatttacatcctttaacctactatgtggaatggagaaaagcttggaatagtattgcgcctcttactttttagcccggccagctagggtatcatgcgggtaaagctgggtagacgctgcaaatacgtattgtattcgaatatgacatgttcccggttaatggagatgtgtctgtgggtgactctagagtaagggtgcaagttaaactagttggctattaattaatatggttgaaatgattatcagataaaatggttaataatatcactaaaggtaactagatttgtttaagttagttactaatgatgtttatattaaacgtttaataatgatgtttaatcaaatggttattaagatggtcattccaaaataatgcattatatttgttattacaagcatgcttgctgagtaccttctgtactcataaatgggtttagatcacgatgatatgctgtagatgttggtgatttctatgatttgtttgaaggacctatggttacggtttctaggtcactctatgctcaggctgttcctatggttaagtttactagttaaactgtttgtgagaataagacttatagtttatattcccattgtgttgtgacctctgtggtttgaataatgtataattgaagtttgtgcttttatatcgtttcatgcgtaaatggacttccttggaagttacgtatacgtggggcactttgaccttcttggggtgtccccacaagtattcacatgttgtttttttaaagtacttgtcattctcatattgtaaagcacttttgcttaaaatctccctcttctatccctcatcaatatattcacccctctcattataatccacgtatttagcaaggagttaacaataataaataaaggttagctcggtgatttgccacaacttcatatttcgtctgagctagaatatcttgtcaatcagaaaattcatcgactcaaggaaatcatacggagactaaaaaaatttgtcgattttcaactagaaaattgtcctgccatgaatcaaacagagaaaccagcaaacaagaatcatcggtgcgtgtatcttgatcaaccagagactaccgttcatctcgaggctctcgcataataagggctgacaaccataactctcctagtatctagtatctatccctgttggaagtgcacatgctatgttcatcccagtttactcgagactgatgaattctcaacacctcccattcttaaattcctatggataagtaggtgccatcattggcaattggcaggatatcacagaaattgcagcgaatttgacaaaagcaattggctagcacgaacaagaacataacaaaaagggagcaagaacaaagtctgcaaaagaaaaatggggcaattccttacatacccctaaaagtttgctccatcccttgcatgcccttgaattttgtcacatcccttgtatacctctgagatttcgtcttgatcccgtttatacccataccgttagttcaccgttatcttttttccaaaatggccatgttgccctttttatagtcatgtgatcacttcaaaaggcgctaaataaagcttaatgtgaactttttaaattttgtatagatagttgagcctaaatttcaaaaccaatatttattttttgaaatatttttaatagattttcaagcaagctttaacaaaattaatgaaactcatatagaagtttcaccgaacatttagaaattaaaactatatttaacttgaatttaaatataaataagaatgttttatgaaatttgatctaaatttttaaaattttaaatttaacttttcaaactttgaggtcaaataaacacattctttttgttgtttactaataaaatatttttcaactcgaaaattatgttggtgaaaaagctagcgcataggtactctaagtaggggtaatatagtcattttgaaaataacttaatggtcaactgatggtcaactaacggtatgggcttggaggagatcaaaatgaaaactcgggtgcatataagagatacgtcaaaactcaagggcacagaagggatggagcgaaatttcaggggcatacaaggaattttctcaagaaaaattggggtaattttgtggggttttctcttcctcgaatcaattacataagtaaacattctacatatagaatgaaaagaccaactaaacgaccggaattgtcgttccatcccatgatctgccaaacgcgatctcactacgcacgcaccacgcatcatgcacgcacagaggagtgtcacactcaccataaccactacactttcactatgcgctcaccatggcctgcctcctaaacacgtgctccaatttatcgcttcctgccacaattcgaagcgttgctagggctgcaccacgacttagctccatcaaccaacctcaacatcatatattttttagataatggattttaattagggggctgctatatcaagttatcatgtttggacgagatgatactaggtaggtactagctctagtaccctgtaggtactagctaatacccatcgatactaactgatacccatcgacaccagctgataccctgttgacaccaggctgatactcctttggtatcaggcatgataccgatcgattttggtctaatactgcacctctgacaaatagaagttgctcctgcagcagacaatgggcaacgtctgagtggtgtcgcattcaatggctgtacaacttacggtcgatggtggcagtcaatggatgatgagccaaaggggcttggcgatggccttagccggtggtccgggcatggggccgacgaaggtgtgggtgccggagggagtaggtggtcgagctggagcggcgccttgaacaacaggtcaaagtcatgtggatggagatcggcattgttggcgttgggaaaaagtcacatggagactagagtttaaagctggttcgtgctgcaccgaggacactactttggcttatcatcacgctacactcactattcctctagctcgtgcttttcatcggcagtgaaggtagggtggcggcactgggtggacataagggaggcaactgcaatggtagggatgaatataaggagtgtggcgaggacaggacgagggccgcggagtattatatttttttaaaagaaacaattgtgcgaggcacaacagttaaataacttatttcatctagttataattctatatatatgtcggctcccaaaactaacgatttagaaaccgacatgtttaactgtatcaaaccctggatcagtagattgatacaggttcaacaagctagatcttcatcgcatacatttggtcaagactccaaaggagatatctttatataaaataataggatatttacaagtttgtggttaactattacagcagaagctatatgatgatccaactttgctgttttactatagaattaaaccatctaattatactagacttgaagattaggtttaaagggaactaacttatgtgattgaactcccagcttcggcaacaactccaaatagactctgaaaaagaggggttgaagcaagggtgagtacaacgtactcagtaagctattatattattcaacaatgaatgcatgagaggtaatatctgtgtagaggtagatttacttgcagaaagctgagaataaaaaggtggaaatcctgaaatgtttcatatatgcaacagtatttaagaaaatcttgaattatatttctaaccaaagtaccatatgagtcccaatgctcagatccgtgagcacggctattcgaatagattcaaggatattcattctgcagtagatgtatgctttacctgtagtccataacatgccaataatcattagcttattcatggcccagtattaggttattaacaattgtggtacctgttccatgaactctagtccccatgcgctctgaacgtaatgttatcagcaacgagaggagttctggcgttcccggggtttttagagagaattggatgagagaccccacgtcatctcaaccaggttttcataaattcacacacacatcgcgcgataatcaagatatttacctgcgcctcggtaaatatcacatttgcccttctcggcataagtttgtctcctttgcgaggacttacataagaaccactgtacggaggtaccacattgttaattaacataatatctaggtctgtccccattctagaagctgcggtcgtactcgtttgtttgacataagtacttggtaaacttatatcgactgagacagtactagccacccggaaatcaaccaaatcttgcgtactgtcccaatctaagttcattatattttatgcaatttaactaggcagggctaagcaaaagctagcatataactggtttgctatatgttcagattatgcattcaaaatcatgaatggcaaatgcatagaatagaatgtagaatataggataattatggtcaaaggggaggaataataacttgccttgctccaacgcaaataaatccaagataggcaacctgattatccaattcttgaaataccataggttgccatccaaaagacaatagactctactaagaaagaggaagaaccaatttcaataaaaaccataaaataataagaaaacgataaacggtaaagagggcttgggtttaatgtataacctatctcttttatagggtatagggattatggggctagtatttgctagcggtaggtttaggtagtataatacctagggtttagttgtatgggagtcatttgtggagtaggatagcatatcggctaggctctatattttatgtggaggctctcgtggtttggatgataggaaatatacaagatagttgatatggttaaataggtatgtggctaatatgggtcaaggttagctttgatagaatagtggctaggatttagttgtttaggccgatatcgaggtaggataaatatcggctagggttttaggtgtttgctagtcgttgctagagttggacagcataacgactaggtttggtatcatttctagacgtgtcgatagacagcatatcggctagaagaataggaggtgggcgcaggtttagtggggcggaagtgttactccgacaaccgtgagtagcggcggagcggctaggatcacacagagcccgagagctaactgtgcggcgtgcaataaaggtcgaggggatagtgaagctccgaccgctgtacgcatcaaggcgtggggttccaggagcagcacttcgaccttgggtttggtttaggccgggctttacaaccaacggtccgacgttgaggtccgtagaccgcgaacgtccccatggaaggcgtaaagttccaaccggcggctttttagtggctaaagggtattttggaaataaaagaaaatatttggaaagcaaatataagtttaaattgtaaattcaattataagattaaatcaaatatttattcggatggtatttgaataaattaaggaaattcaaataaaatcttaaaatagcaaatttgatattaaaatgaagagtttgaatttagatgaattgaggtccaaatttgactggaatcggatctacggtttaggacatatgggcttctaaagaataggatttgaattaaatctagaaaatgagaaaagtcactgtgcaggggcccacctgtcagtctttttctttttcttctccttcttcctcccgttcctttcttcttctctgttccagagagagccgagagaagagagaggagaaggcaatcggggcggcggcgctccggtggctggagggcggtgacgtcggcgtccacgcgtgttcccgagcacgacgcacccggggaggtcggtgtctggtggagagagaaagggagatggccggaacggcgacgacaagagctcaactctggcgagtaaaagaagtggtgatggtggcttataggatggctaaaggagaggggaaactagaaaaatgggttcgtcggagggaggcaagtatggtggcgcgaggatttggttagtgttgctccggtaaaggagattgggcatggcaagatggtggccggcatgggagagagagaagagagagagagttcggcttgtgtgtagagaagggccggctatttataggggtgagaggcggtggtgagaggcggtttggaggaggagatcgagaaggacacggcgacggtagcgtgagaattcgaacgacggcggccggcttcgtttccttagcggcgacggaagaggagttggcggcggcgtgagccgtgcacggcacgcgcacgggaggaggagacggctcggctgggatgtgggctggtttgggccggctcggcttagctgggccggcagcccaagaaggaggaggaaaaatagaaaagaaaagggattgggccaaaaggaagaaagaatggagtttcggcccgatgacaaaaagaaaggaagtctaatttgaatacttgatttggataactagattttgcgaagaatttgaattcggagagaattcataaaagagatttcttaatttatttgagtgcaatatttagaggtggagtttgagggaatttatttggaagcactcaaataggaagggaaattaataatattcctcaaatatttttgggaatatagaagggaattagttgaagacaataaataggatttgagctctaaaattggtgttatgtatatttatggctaaaaggggaagttgagtgaagaatataaattggaattttcttagcacaagagcaattgttcacaatatttgtaataatacaattcttgtgccgaagaggaaattaagccacagagattaaattggtggctagatcaaaaggaggaatttggatatttggatcgagaatcaaaggatgggtttaagatcaaaggatggaattaacaattaattctaatgagattggaattactttggtctaggttcaagggcaaaattggaggttttcttggaccataattcattatagtaaaaatggttttcaaactaaattttgaataaaagagttttagtcgaaagaaggtttaatattcaaaaatagaattccaacaagaaatatcaaatatgtttttaaatgaaaaacacaaaagagattaaataccagagaggttttatgcaagttagttttaggaggtcctactaattatattttcctaggtttagaaggttattaagaacataagaataagaatcagcatgatgcaagattagaaaatgacacattttcaggatattacaatataaaacaaagtataatgattatatgttctcattttcacaacaaaaataagcgcaatgcaacacatcacaacaaacacaaagtagtattaaaagtaaaactaaatgatttaggacaggcgaaattttttttgatattgtggataccactattttcgaaaataatttgtagcaatagcagtattcaaagttcaatcgagctttagtattctcaacgccggtatgaaccgaacattgcccaaattactatgtcaggccaggcttgcaggtagctctttggcatgcattttcatcaggggcatggcatgctcttctggcctctgcagccaattaggactttagaggcaagcaaaagcgcagtcttgaggagaaaggaggtaggcagtagactacacgtgtgattgccttgtaatagcccgtggggagttctgctttcgcttcccagtttggccaagatctactatgattcctttgccacgaatcatttcatttcccaatacctcccaatccatataatcaaactaaccaagtaacaaaaatcacacggacttctctgttctcactaaaacgttgtcaccttgcaagcgctagcaatggatcgactccctcttatggtgccttatggtgcctgtagatcgaatcataagaactaagccaaccagaggagggggtgaatggttgatacacccaaaaaccgaaaacttttagcggaaataaaagttatcctcgaaatcgacggaagtcggtctgaccgagattgatctgccggtctgaccgagtggatgctgccggtctgaccggtgttgaatctccggtctgatcgccgaagtcgcctgccgcacctgtcgccgccgccggtctgaccgccgcaatgccgccggtctgaccaccgatgagttgctggttagaccgccgaaacccggtgaaacacaaatcgaagaactcttaaagtggatgacgactttattatttctccctgtgtttacaaagtgcaacaacagcactccttacaaaaattttgactaaactcgaaaccctaaaccaaaactcaactctattgctctctaaagcgatataggaagcctcacgctccctctctatttataccaaaaaaacccctactcaaagtatgtgtataactcctatacacaataggactccatctttcagtttccatacgttttacaatttccaaacgtgcagcaaacaaccgaccgcaccagaaatccaaaacggattcgctcccaagctgacgtccacgcgtgaccgtctccgactcgctgccaactgggcccttacttctcctgggccgacttggcatgccgccaacagccaccgaagcccactgagccgctctcctgctgctcggccaaccagtcatgcacacatacatgcttcaccatgcatgtatcgatcacacatacatgtacagcaccgtacatgcatgcatacctgcacgctacagtacctcgtgtactgtagcaccatatactactccaactttacaattctcttcgcgaacaccggcacttgcacgcacacctcgtgaagcccgttgcgaagatctctcccacacgatgtccatccactgtatgctatcttgtatccaacttcgtcaccggtatccttgaccgtctggaactcaactcctccctgagtctagtcccgatccccaccgttgaccgaagttgacctccaagaatccagactctagtcaccttctcacatggtatcccgaccgcaatagacctatgctcctccctgagcatagtcccggtcctcaccattgaccaaggctggactcaagtcacctgcacacaattagacaaaacaaccgtttctgggcacagatatcacaacctgacccacattagtcacacgcactcacaccaacattcacacaaactctcaaaccaattctttgattaaatcatttgcatagccaattgttcgtcacaaatattaattatgacaatgatttcacattgccatatgaagaggttttgtttgttgcaatgtagaggtacacatagccaactacagaaggagttcaggtttcttcatttgagatactcccatgagaagatacaatatgaggagttgaggatcacatttacatccatacatatatatacatctttaaaaagaatgtagtgatggtgacagtgtagttatcactacacctactcccattgtaaatttgcaagttaacccctgaacttattaatattaaaaagattaaatctaaatggatagccacataaaaaactagagtaagatgaatattccctatagcaaaaaagatgagtaacacattaatacgttttcttttatccgtagcaaagcacgggcatttagctagtatgcacaaatggtcggtagtccttttgttttgtgcaagaattgtttagtctgagaaatcaaaacgatatattctcatggaagatctttatagaaaggcagggggcaccattttacatacatagtgggaacaaaaatcctgacctctgcatcatgagatgcagtcatgcagctacagtaatttatattcaaccttgttaagcaagtatgataatttcataaaccttaatttcgtgatttgtacaacttcatatggatgtagggatgaagcaatccacaataattctgatctctagagctagtttgctataccagtcaatgacctttctaatgtggacaacataaaatccgaagaattcacatacacaaactcttcaaaacaattagaattaatgaggtgtgtattgttatttttatcaaatagatactccctccggttctataataattgacgttttgggcaagtttgaggtcaaacttttataactttgaccattaataacttcaaaatatttagtttaaagaaactagaacaacatatatagatttgcctttcaaaacactataataaaagtaaacatgtatttattcattgtgtatattataatagaaaaataaggtcaaaggtatattttgtagactatgtcattgtccaaaacgtcaattaaaatgaaactggagggagtaatttggtgtctcctacattataccatactgtgtgagtgaggcttcaaaatagtaaatactaaaatatcatatgccattatattccaaattacatatcttactgattatctgaatttagttaccaagatatatagtaaaaaaacgtcctatctttggagatataaagtagagtaagggtaatgtcaccaaatctggtaacattactgtaggattgcacaacaagaactaagccaactagaaaggaggtgaatgcaccctaaaaccaaaactttcagtggaattaaaagttaccatcgaatcgacggagattggtctgactttagtagatggccaatcaatttcatggcagacatggcgttgctcggttaatccgatctgctatccaattggcaacaaatttttttttttgcaaagcttatgaagcagtgagaaaacacaattgtttgtgattggcaatggtgcaaaagccttcaagcagcataagaaactgtgatggtgatcatagttgttgtaattatttgttattttttctttttacacagctttaattggatttgctaaagttgattttgttttttctcctaattatttccaggcaggattgtccatagcaattcttcgtgttatgtaccgtgcaacgctggggtattattagaaattattggtccataaccagtacatcggtattaaaacaagactgccgtgatgggagagagcagtagtttcttcaagtggattgctaaaagagacatgttgcaagtttttggggcaaaaaacttttgaatgtaactacgatataattttgagttcgatcacgtatgtagatactggaaatgatttttttctcaaaatgtccagaatgtgatcgagatgtgcaaaaaagaaaaagaaaaatggtttgttgagttaaatggcatttattttcagtctgccagtcgatctgccacttattgcctaattatcgtccacatggggcgttattttttctcacttagcccaacgatacaagctgtctatatatagttcatatagatttgccccactttgcaaaaacctgcttcagtcctgagttcacagcttgtatgctaaaaacgataacttggcttcaaaatcctctttataaacttaaaattccggccgatgatactcataatggccctgatctatatgtcatgtggaattaatgctctctctcattttggagagaaaaaaaatagggcaaccttttacaaactttgagctatcctttagccaatagattggactttgaattagttacttatcgaaccaaagatttcccctttttaatcacaggtattgttagtacatgtcaagctaccatccgagcccgaagtaactgaattcccaagaactccaattcctagcatcacaaacgaaataagatggaaaatgcttcgcgtcggccatccgacgctccagcgaaatattggacgtaacattatctcatcacgtgcatgcctctatccactgtcttgcctccatgcaaagcactttactactcccttgctctatgtagagcactttaccaaatcatgcaccgatgcacgtatacatttttatatttaaatgatctttttttcttaaattacttctccaatttacaatccgattacactattaaacttgttgcaattaaatcttacaacaagatcacacatggctatattccgatgaaaaaatattttttattcttttaaatctgtcaactagtactagtatgctatgtttcactaatacatctgtaaatgttgcacatattgttttttcaatgttccaatttgtattttataatgtttcagatgtaataacttaatgttttatacattacatgaaaatattttaataatatttcatatttgcaaatatattatatctttcatatgggtttttatgtcattcgttttttttatttttatgtctcactcgttgagactcaatgtttcatacagtgattattggtgttacaattagtatttcttaaatgttgcatttctctaaaacattttatagactgagttagaacatttgaccaagtttttttttgtctcactcattgagactcaatgtatcataaaatgattattggtgttgcagttagtattttctaaatgttgcatttctcagaaacatttttatagactaggttggaacatttgaccaagatttttatgtctcactcatggagactcaatgtttcatacattcattatcggtgttgcatttagtatttcttgaatgttgcatttgtctgaaatattttatagactgagttggaacatttgaccaagtggtgaaacaattttttacaagtggtgaaacaacatttattttttctcatcaaaatataaccgtctgagatcttgttgtaaagatttaattgcaagcagtttaatggtgaaatcaaatcataaatcggataattaatttaaaaggaaatttaatttaaagaaataaaaagtaggttgaggcaagtaccgcaactatgcagtcatgcatgcacaagcatataggcttcttacacgtgctactcaactagagtagaaacaacagtcatgcatgcacaagcatataggctttttatacgtgctaatcaactagagtngaaataatagaacataggtttacatgcatgtatagatgcgcggtagtgcagggtcgggcgtccgatatttgcaaaatatcggacatccgacgcgtagaatcctccaaataagatcaataatttttttgccacctgatgtgtagggagtttggccacatcctaataacaggcaatgaagcaatatgagcctaggcaccttggcaaatatagtgtcacattcaggccaaatgaggccttgcctaaacctgcgcagttttgggctgtgacaatatgctcttgcctttggctccctttaaccctcttcctcttctcttgttctccctgtgaatcttttatagtgtactgtccctttattttgtatttactgaaactattcatgttgtcatgagcctgttattctcgtcttacttcgaatattcccagtaaaacttaaaatataattatattatttatgaagatttgattttaaaataaagtaattctcacaaaaaaaaacgacagagacattttatttctaccatatataggttcccttgtctcacagagttttagcaccgagtaggtgttcaatttacagaatccagcgaggaaaaaatatgcactatttcccttgtttttctactccataggactatagtaccatgtaactcctactagagagtaatccaaaagggatcgcaacaattctagaaaagtagagacccaaaatataatataggggtgagacactctttcattaaatctcttcttattcaatagtatacaatagcttattctcttctttatctgtaggcatacataggtagtttcatatttagtgatggacccaattagtgagtaaccgggctaggttttcatgggtcgccggtttcctaacacttcttcttgggctctcattgcgtgatgcctatctttcataaaaactctataaaaacctagtaggaaatatttggagaaaaaagtacatagtatacgcttgcaattaaaaaccttgataagaaactacatgtaaaatttatcaaaggaaaaaagagtacaattcacccaatttttggttcaatttttctacattgattttgggcgcttgattttctatatcaaatattttagaatgagtcagcgaaattctcccatgaatttggcgtttatctaagtctcattattctgattcctcggatatatttattcaagagaagatatcaataataatttagtggataaatctacaagatttccacgtaatctcacaccaactgcacctactagttttctgacagtatcgataccaattccaaaaaataataaaaaaatatattattttcaactgtaaattttagtttctctaatttctttcaattgcatcgtggattcaataataatttggtaattagatgtgatttagtgcagcaacatgcaaattaatgaagcattgcaatgcaataatttgatgttaggtgcaatttagttaaaaactttcgagctaatcaatccggtgcatgaactaatttcactacaaaataatagtggatttctaactagaaaatatcccaccgtcaattgaccggagaaactaacaaatgagaatcatcgactataatgataaggagagaaggcaatacgacaagataaaagaggaggatgagctatggtatgcttcattaatttggctagggatcagcattttatttctgtactagtgtaggacatgatgtgttctccatgatttgcttatcttacattattcttgtttaatttgggtggtagcactgtaacaaggtacgtctgtaccacaaaatgtaaaaccaacagattcaggcaaaagggtaaaagaagatttgtgtagctattttttaacgttattatatttttcagaaaataattatgtagttaattgtttaaccaaccatgaaagttcaatcatgtatgaactttctcctgggagtcaaccaaacgctagcgatcacaatgcctaagagcaagtttaatagtatagccaactactagcttcaattaatctatagccaatctaatagctcattcatacaatagttacatactacactattaatacctggtcccacctgtcatacacacactgtgtcttggagtccgtgctacagctggctaaaaatatgtagcccgctactcttctctctccttatttatctccttaaaatatgtttgtagctggtttatagcatgctattgtacctgctctaactaggcaaagagaaatcattaaaaagttcaggtcctttctcgggcatacatttttatttgtatattttgatgagccaaaaaggagctacgcctgatatattaaggagtaaattaaaagagtaaaccagaaaagcaggttaatgagtataacagtccagatgaaatagaaacgaccagtgaaaaaagaaagagtacgtcagggtggttcaaatatatgctagagtgcgttggccgttggtctatgtccttaatcacaataagatttgcatcccagagatcgttgtagtgatcttgttggaagatacttctatttctttcaagccaaatattccaccatgaagaaaatagctctccgatggcatatattttcatccggaagggctctttcctgcgcatgcattttattcaggcaccctcttctggtcatctcctaaacagagcattgcaggcttgcaaacctgcagcattgcacagaagtgaggtaggcagtggactctacaaggtgtcctagtgattgtccagtaattttgattttgctttccagatcttcctcatagcctacacaaaatctagatctagtagcctcctcaattcccgacacctccgaatccatatgaacaagaaccaaccatgatgagtaacctatagattgatttatacataaaccttgttgtcaccttgcgtgtgctagagatggaccgtgtggtttcatatttgaagggtttggaaagttgcgacgcaggctatattaatagaactcccgaaggagtgcatctcaccaattacaacactcccatcatatcatacaatgaggattacattcgcatctctctcttactgattgtccagattaacttgccaagacagtgaaatgatgtcctatgatctaattatatatttctttcaatgatacagagcagagctaacgttgccagttgtcacaattgtggggcattaataggggtgggaaaaaagctggggcttggctcgagcttggctggcttggctcggcttgtaagtcaatagagccaaacccaagctataggtatttcaacaggaaggcttgcaagccaggaaacgagctgagccgatcttaagttttagcttctttctctaactgagccgggctaagctaagtctaatttgttgcgggccactgcaagctgagccgagcaggctttggcctagctcgtttccacccccaggcatgaacatccaaatgacactctttcaagataatagatcactaataaatttgtacgatttgaatatggttggacaagatccaaatagagtatcggaaaaatatgaacttgataagtattcttgtatttttttcacgaacgcgcaaaaagattgcatgtcaatatattaaaagaaaaagagtttttgttacacgacacaatcagccagactggcttatgccaagggaagtgagaaaaaaaaacaaaagctgaagctaggaaaaaacttctacggcggctaaacgcaactccaaacagcaggaaggggcagagccacggtacactcccaataaactccaaaagcagcaacggtagctaaagaccacaaatggctctctgagaggatggactctataactactaagaccgaagagagcacagagtcgaaaacccatactagtggtagatttttcttctgtaagcagcattacatgtgcaactgatggcctcggcgtatgctgatctacccaggaacgtggcaatcttcctagcgccacccattctcagttgatcaaagtttctttccatctatggacagaatctaagaggatgatataacaccgacaggttaactcattgatgcctagtaattagcatagatacataagaggtgttgacacatgacagggctctctggaggagatgaaggccaaccaaagacatggcctgcttgagcgtagtaataattagcatagatatatatactgttctgtttgagcgttaggcatggcaaattaatgctctaggacgaggtcagaaccaaatactacaagagtaaatgatggagatcgaccatgtgattttcacaaacatatatacgacacacatgaaaagcaatgcatggtaatatacagtggcatacctacattcactacaacataaatggtaataggtgctggttgggaacctcacatgggtattggatttcctaaccggtacctcgtaggtggtacttatgaggaggaattaaaggtaccaatttaggaaccgataacctttgatgttctaagaattcaaaaaaggccagctcgattcatcggttcatcaagccgctactcatcacacccagaccgtcatcgacccaataacattcccatagccggatctgtaggagttgccactgtcgaggtgtggaggggaggcggatggagaggagaaggaggaggcggatggagaggtagaggaggcaaggttcatgtcgacctacagagacagagagagatggataagggtaaggtggatcgagtggatggggagagggttggataagatcgacgctggctcggcttggttctttttgaaaactgacacatatagtataggtgtcggtttttcctctagaaccgacacttgtagttgttgaaaggtgggaaaaggttcattaagtgccagttttaaataaattgacacctatgagctgaagcccattaggagtttgtagcagtggttcatcttcctggggttaaagcacccaccggttttaaattcactcgctgtcaccgtcgtcgtggcctaccatgcttcccgtcgttgtcatccttcaacggagaagccaccggatcacggcgccgccatgcttcccaccaacccaaggagaaaaccacacaccaactgtaacacaacacacagagagagagagagaggggggaggcatgggaaatggaggggaggcggatggagaggtggacgaggcaaggagcatgtcgaatgacggagacagagggagatatggataaggataaggtagatagatagatagatagatatatagatagtttttatatttgttgtcagtataaaaaaaatcttttcagtacatatttctcgaaatgatatatacgtaatgatcatttactactttgtatcaaaatacaacctagggacattgacaaaaaatatatcacaatttgaacctttatatatgttatgaactaagtaatatttcagaaaattggatgtagtacaagataaaattggtgaatttcaaacatccaaataacttcctataaaatacataaacaccaataaacaaatattccatgctaaagaacaccaaaacttaattagtactattattttcaaaatcatctgtacaagtagtctacagtttggatatgatcaacgaaactcgtaatgaccttctatatagcttgtgttgaactatccccaagcccatactagtgagtagaaaacagtggcactattgagcccttacggacgttcatcgagacaatgggagggatattgcatagttgtggtaggccagaccaaacaaactctgctgtcttgttagatgtagacaagcctatgatgccagcgttactagctgaattcccaacaactcctatgcctagctagaaccacaaaagaaacgaaatcaacaaaacttttgccatctaacaggttagtgtggctacatcctaacaggttatacagtttctcatccggctttgtcactaactaaaacctgagccactttgggctgcaatgatatatatgcacttgctctttatcccatttaaataaatagcaaatttggctattgcctatcagatgactgctgcgtcaaattaacttggatgtcatttgctgaaacacaatacaaaattaacaatttcactaacgggctactgcaaaatctatcacaacgttttttttatatattatcttcctcttcttttctctctcttggatcattcattatgcggcctctctttatttctccccgaaattgttcatgtcgtcatgagctaaccccacatgccatactacaactaaaaccaatttgagaagcagtaatacaggcttaattcgaaaattatcgaccaaacttatttacaattaacaaatgacgttttttccctcaacatattgtgttcccttgtctcattgagtgtttatgctccatacacgggtgatgagggaagtcgtcatatagtggtaggaggatcatcatgctgacatgccaaatgaatccaagaagtgatcaataacaatgttcctgataggactagggatgacaatggggcccataaccctgatacccggtggaaaaaaaaatccttttaaggtctataagtactaaatcagtctccacggggctcttgatgggcaaaaaaagtcccctcatcgtgtgggggcaggattagggatgttcacatggtctttgtccccgtatcctcatgaggccctgagtacaccatcatatgtctgcatccccattatctcacagccgaaacagaaaataaagcccaacgaaggcacatttagtgtgctcatatgtacacaaaacaaaccccaagtcccattcccacatcctagtcccagatctagatagaatctacaaccgctgcaaactcccagtcacggctatagctcggcacctcggcctccatcctgcgtcgcacgctcccgtcgtccacgacgtgctgccgcatcagcagggccgtcccgtcaaattcgggggccccgtgcaaagttgaaggataaaaacttaattgatgatataatatgaaaataatttatactccataatatatttcatagcaatctagaatggcctaaaatgataatccaaaatagggattaccggattagaaattaccagaaaaaattaggttagggacgcgacaggtgtcaggcggcacgaccgcacgagagaaagaggtgaggcatcgtttactcctctcgttcgttgcgattggcgattggtgaggtccacagtaggaggcgattcaagattgcgaaccggcgcaactatgcgaactggcaaagacgtaatcgaagccaaaacacaagaaaaataacaaattttcgggactagttaggctaccaatttacttattgagttgtatatctagtgttgaagttttgggcctacggtgcccctgaaaattagaggcctatgcggacgcgctggttgcacgcccatagggacggccctgcgcatcagcatgaactcggggcttcggcctccttccccgagaatgctaatcagcgcagacacgctaattagatatctcgcgtgcgtttccggcctagtcattcgcgtgtgattccgaccggcccaccagcgaaaaagaactcctacttttccacgcaaaaaaaaaaccgttgggaggcacatgccgacgtcggtattggagcaaaaatcgtacttcctataataaccgtattaattaaccttttctttttttattgggaatttgaaaattacgtgaaattttaaacttttaacgcagatctgaaaactttcaactcgaaatttaaattttttgaagtcaaaatttgaaaacttttaacttttcatctaaaatttgaaaacttttcaactcaaattgaaaaatttcgatccagatttgaaaactttcaacttcaatttgaaaactttcaactcaaaatttgaattttttgaaatcaaattttgaaaactttcaacttttcatctcaaatttgaaaaactttcaattcaaatttaaaactttcaacccatatttgaaaactttcaattcaaaatttgaaaactttcaatccagatttgaacactttcaacctagatttgaaaactttcaattcaaaatttgagaacttttaagtcaaatttcaaaactttcaagtcaaaattaaaaactttcaattcaatatttataaagaggtatgcgaaagattaaaaaaatagaagaaaaaaacacatcgtaaaaaattaaaaaaaagaaaaaaaaagcgcacggggcccagctaacgcgcgcgccagttaaattgctggcacttacgcgagcgctaggagcccccctccttcccacggtgcctgagctgtgtccagcggggacaggttcacgccgctctcgccgtcttcagtagagacaactccatgctactgttgctgtctccaacagggataacacgcctccattgcccttcatcctaacatctcttagtttttcttgctctgccacaactactgaacgtccagtgttatttgattcccaacacctccaagccctatactatctaattttctaacatattggcaccaattttctcccatgatttctagcgaagcccttgctagctaggtccagctatatgtgttctcaaaaataaataaaagaaagtagctatcctatcttcgctacactagaaaagggactctctttaagaccatactagtcttatatttgtgcgttgcaacgaaattacgaggaaagcatagatatgattttatgacatactatctggtttttctggtacgttgattttcatgtgcaaactctatttttttttggatgcggtgtcttttaagtgcagttttctgtatgggaactacgatagtggggaaccagaggattaggacgacttcgcttttaaagtagtagagacatgtaaggctatgggtatgttataactcataaaaaaacagaattaatatgtattcatttaactttttttagacaatagaaatggtttgcgtaacctcttatgttaattaggcacctaaccaattttgcaattagtacaacatttctaggagatacaaactaaggaagactatagttatatataagccccaggtgtcaacatatctgaaattctagcttactacacaaaataatctgaagtctgaattttttcacagaaaacctattttatttacgaacatccaaacatccacaacaagaagtaaataatgataactatccacacatcatgcatagatatgctaccataaaaaacttctacaaaataaaccaaataactaatctactaccacacatgatatgtaccattttattgctacgaaaataagtttagttcaaatttgtcataaatgtgaaggtcaaagggtgctacttgtccacgcatgcatgccgtagatacattgtaactaaaaaaaaccaaataaaaaacataagtgtgagtttaaaatactccgcaaatacaatatgaaactagaaaaatatatatacatagtaatttgcagtaaagaacaaatataaactttttcattttctttgtgttcaaaagaaaagacatttatcttttttgaaagttaatgaaacagagccatcttttcaaattgttgagctatgcttcaacaagtaggataactgcatagttattgtgagccacacacccaaaaaaaaaacctagctagaatcacttctgaattttatttggagcaagtcttattagttctaaaaaagtatatcatcctagcccgaagtagctgaattacaaagagctgctactcctagcaccgcaaacgaaacaaaaacaacaaaagttttgccacctgttatatggagtgtggccacatcataacaagcaatatgagcctccttgctggcccttgtatattgtgtctcattcagcccaacgcaaaacctgcctagctttaggctgtcactcctagctttaaatcaatggaaaaaatggcaattgcatataaattctcctcctctcctcttttaatttctccttttgaatctttcattatacgacctgccatttatttctccccaaaattattcatctcaccatgagcctaacattgtctgcttactgccaattttctaagataataattttattacaaatattgaattttataatggagtaacccttttagaaaattggcagacagcatttactaccaaatactccctccgtccctaaatatttgacgccgttaatttttttaaacatgtttaaccgttcattttattcaaaaaatttaagtaattattaattatgttcctatcatttgattcattgttaaatatacttttacgtatacatatagttttatatatttcacaaaattttttgaataagacggacggtcaaacatatttaaaaaattcaacggcgtcaaaaatttagggacaaagggagtatcaatcaggctcctttgtctcgcagagttatagcaccacattgggcttgaattttcaggagccccggaagtaatatgcactctagcatccttgattttttgctacatacatgggtgaggacaacctcaacaggttccaaaatcaatttcagtaagtcgtgcatgattcctctcaatgtacagccagagagaaagttgagcatctgtctaaaatgtttggatgcatggtaggagacttgccttttacatatctaggcataccaatgggtatctctacacccaaggtaatagatttcagtcctctggtggatagagttgaaagaaggttgtctgctacttctgctctcctttcttatggggatagactgactctggtcaattcagtgctttcttttttgcccacatattatatatgtactctttcattgccaaaatatatcattctatctattgatagggtaagaagacattgtttgtggagaggatctgatatcaattctagcaagaaatctttggttctttgggatagagtctgtcagcctaaatctaaaggggggttaggagttattgatctcaggctacagaacaatgccttactaattaaaaacctgcataaattttataatagacatcctatcccttgggtcaccttgaggtcctcttactatgttgataaggtcccacatgctttataccttaaaggttctttttggtggagagatgttcttcaatttgttgatatctttaggggtctctctcaatgcacagttggtgatggcaaaacctgcttgttttgggttgatctctggaacaactagataagacagaccagttatcctagagctttctcttttgcaaagaatcaaaaggattcagttcatatgacctccctaaaggacttaccttgtcagaacaggcatatcaggaatatctttctttaatctttgatgacccttttcaacagctatctaatgaacctgatatttggtcttatatttggggtaatgataagtattcatcaagaaaggtttatgctacaaattttctgcatgtgcagcctcctgcttacctaaaatggatcaggaagagtaagtgtactatgaaagttaaggtttttggttggctccttatgattgacaggttaaacacacaggatatgcttgatagaaaattatgtgcgcttgctggaagtgatttaaattgtgtcctgtgcacctctggccaaatagaaactctttttcaccacttcttcagttgttcttttagtactgagtgttaggcacagtttggaatagtttgggatatttatttgtcttttgaaaatatgctaaatcaaacaaggacctcctatcgatcttcgcatttcctggagaaggttttatatgcatcctggaatatttggaaacagcgaaatgattacatctttgataatattataccttttgttccttcttggatgacattcttttaggaatgatctatcccttcttgctcatcgtttaagtttagatgagagatcaagttttataaactggttgaaccagctgtaattacttttctttaataaagttttaaacaactgtgggggcttcccctaccgtgcttccccctcccccgccccccccccccccccaaaaaaaaggtcctcttgtgcaatatactatatctgttttttaatatatgatgtcattaactttttgagatatgtttgaccatttgttatcatttattttattacgacttgttttattactaaatgttctttaagaatgaattaaatatttttatatttacaaaattttttgaataagacgaatgctcaaacgttgataaaaagaaaagtaaacgacgatatatattgaaatatggaggtagtacgagtggatcaatagataggagccaccgccaatatatgaaacagtgcaatttcctagttttctagctctagcacaactaccgaacgatcaatttctttcatgatggcaatttgactcccgacacatccaatccctatcatccaatcaaacactctccaatgatatccaggcattgccctcgccgcttggtaccacagcagctatatttatagatggccttactaaaaggagaagtaacaccatctatcgtgttcactgcccttaaaaaaaaggcttttgactatgtctttgcaaaacttcaaaaggcacctagtacaccactatttactatttttagacaatggaaatggtgtgcatctctagcctcttgtgttaggcacccaaccaatgtctccaattaacacaatgtggtgggcgacacaaaccaagaactatatatgttcacatcgatgtgtgaatccaaactatgaggactcagtttgtgttcttttctttaaattcagaaaagaggactgtttaatgtgcatgaacaaaattatatagtatgccataaaaagtaatcgtctttcgtgggtagtactaaactatatatgtcccactgaggcatgggatcgccatatattacacaccgcaataaccacgaactaagcttaaacgtagtgtttggcaagaccaactcctttacaaaggccaaggccaatctaaagtagtgaaattactaaagtttctccaatcctgattgtgccaggtcatcaattaaacacagaccgttggatacatataaggaaatcaatagctgccatcagatgcaaagtaaagttgagttgaaaaataaaatctggtcaatggtagaatcctccagattgtggcaaacggcctatgggccatggagccgaagcgtcgtgtacgtatataaagataaagagaaccacggagcaggtaagaggatacaaaaaagaaaaaaaatagcgcagaacccatctcctcccgaaacccatcgccgccgcctccccattgccgttgcctcctctgcctcctcctccaccgcgcccactcgcccccttcatatccacgtcgcttgcgcaaccccaccggctcagatcctccctctaccatccggcgaagttcctcatctgcctttccatccaccccgactcccatgatgtcgccttctcctttccgcccccggcgtcgtttcccctccccctctctgcaaccggcatttcttcctcgcacagtccaccggctcctcccctcacccattgccgccacttcctcgcctccacgcaccctccactcactttctcatccccatccccatccccatcccatgatcccaatcccaatcgcagctccaaaacagcatcggatcacaactaaatattttggtaagtcacaaactcagataatcccatcacctcctatctttgctttctcacactgtagccgggaactacatataaggtcaaaaaaatatcagtaataggatggattgacaaagagcaatgctataaaaatatattaaaaaacacatgtacaattatgtttctgttaaaaaaaaaggattgttgttgtgttttgttcagcaagggaatattaatcttaaaggcggatagccaactcaaatgattcttttttcttggacgatggttttttttagcatcatcagcaatgatataaaggtttggtttgacattaatgtgccttcgatgacagtaaaagacacttggtttcttgccctgcgtcagtctgttgtgcaaatatgcgaatcaaggacatcgatgtattagaagtttaggacacaattaaatgctaagcagatagaatatctattattacctgttcactttaatatttttgccttctgagttttgaagctaaaaaccaagcaaacagctcatggtcactatgttattggttctctggtgtgttcatgaggcctgatggcaccttaaccttaacctgttaattaacaacaaacatcgatggcacctttttagttgtacaccaatcacctgaatagtgtaatttctgactttgcatttagcctatgtaattagtaaatgtcaatcatatctactttctcaggcctacagggaagagttgagaaatcctccttagctttgggctgaagggtttttggttggcaacaatgcacaaacagacaaactacactaattgtgatgactctggattttttattacacttcataacaaaattgtgcatttttattttgggatgtttattatgttattttcttgagatactcagaggtcaaatgatctttgagcaatttgtgttggtttcaaatcatggactagattgccgtttattttgctaatgtgtattgcgttaggtttgactattttatgccttatgcatcatatttttgagtaaacattctcatcttttgatggtatacgggaagaggttgatcctggacatattatttgaaccttcagttcaaatatagcttgagttgaatctatagttctaactaatagtttatcaagttgtatgattctgtaaaagaaaaaaaaatcaaaattaagtatgattgtacattacgggcacccaaagtcgtgcaacgcacgactaagtggctagtttaattgagtacacaatccactttcaacacaattagccaattaaatcactttttcaatatcgcaactacttttttgcttaggtttagtcttgttttgtctatctttgttgatttgtgtctaaatcgtctgccttcactgtgagaatgcgaaatctctatgaaggtttatcccgtaaaccttccgcttactcatgagacttgtgtttatccttgtttcatctaaattgactccgttagctgatttaatcttacgaaacccatcttgatttagctgtctagatcaaggtggtagtgaatacatatcatcgcaagacgtttaggtgtgatttaattatgacataggcgcaaacaaaattttgtgcataccactataatatttttttgtccaaaataagtttgtagtacaagcaatcatgaaagcttaatcatgcatgttttcattttctctacggcaaacaccaccatgtcaaacatgccaagctggcagcgagacagttaaaaattatcaaaactaaagagcaggtagctctcaggcatatactttcagcagaaaaaatttgaatatatatatatatatatatatttaataagttgcgtttatatacatgagtggggagaattagtgaaaatatatctctctggcgcattgggcacgcgggagcgcgagaaaagcgcagcgtgggggcgcggaagtggctgcggattaggtggggcggaacaggggagtgggaccggcttggtcctgcaaaccgggagagtggcaccgggtcggtcccacgccataagtgcggcagtggggtacagcatgggaccgaacatgcaccaacacaatcccgcagaaccgaggcgcgggaccagcatggtcccgccggctaaacgcgcggtaccgagcaggtcttgtgaagcaggcgctgcgtgttcctccgttcccgtgattcagagccacgggaccgacacggtcccgcgctccaccacgttcctgctcgcccactcctcaccaccgaacgggtgccgcccgttcagcacgcggtaccgacactgtgccgcgcacccacccagcgtgaccgacatggcctccaatcccgcacacccacgccgcgcttaaggtgcaatcccacattaccatcgtgcgggagaggtatatttgtgtgaaactttttcatgcaagtatataaacgcaaattattaaaaaaagtatttttccaatttttttctactttcagaaagcagcaagcagtctcatagatcatatgaccaaactggcccatagcgtggcaaccgaaatcataaccatcagcagaagggaggttgccagtgggctctacacgtcggcgtacagtaaattaaatgtggatcaaggaatcactacaagtctgcaatcgccgacatctcccaatccatatgatcaaactaactgatcaacaaaacacaaacagactatataatttcccgttctcagtagcactggcgcctaccatccatacttgaagtgttttgttggttgaaatgtagataatactcatatccagctacactcaaccaactacagaaggagtgcgtgcctccatatatatgcacaaatggcagggtagcccttttgttttggacaagcattgtttagtatgaaaaaaaaaacctacatatggtctggagaactcatacatcattaattacagaggcagaaagtacatttttatgtattggaaagataaaatataattctaacctgactattcgtatcaaccttaatttggtaatttgtagaacttcatatggtttgtaccgccccacaattctgatctctagttagatataccaggcaatgtgaattaaaaaaagatatactctctctatcccataatataaggcgtgcacatatttcaagatttaactttgaaaacatttgaccaacaattattacaatataaattaaattttatttgttaaaattagtatcatttgattgatatttaaatttactttaagatggttataattttgttgcaataaaccttataatatatgagaaattgtaagttaaagattagttttaaagactgtgccaaatttaaccatgccttatattatgagatgtagggagtaacaggcaatggccttaattaaattagcatgcttgaactctatacaagatgagatttcacatgcagaaaaactcctcgaatcaatgagaatggcatgccattttttcaaaaacaaaacaaatggcgggttctatactatggctagttgagttggagcatcccagcagatactccatccagtcctctatccataaaatagaggttgggagaagaaaaatgagcttcagcagatactccatcccagcatccaaatttagctatcctccatccagggagagagaaacgtcaccatcatccacatcctgtaaccgccagcatccccctcccccatctagagtccggattgacctcccctccgccacgacctcccccgatttcgtcgtcgtcgctggtcggatgtgcatttttcactatggactgagggtggagagggagagacatagcagatctggaagctgcaaccgacgccggccgtcgcgcctctgtgcccgtcggccgcggcgcctccgcacccgtcatgccgccacgccgcagcccccgtcggccgccgcgcctgttgtgccgctaggcccgtcgcgccaccgcggccgccagcctccgcctccacgctgggcggagagaagaagaagaagaggaatagaagaggagagaagaagaggaatggggaagaggagagaaaaggagtagagagaagaggagaaaaaaaatatccggaccattaaaaatatatccaattaaataaacttatttagatttcggaataaataacactgttaaaatttagttgtttaaaatatagttcttaaaaaataatacatacaatgtatggttagttgaaaaatattagtaaaatataggagggtgtgatatggaagatgcaatatagattatctgttggactgagaaggaatatggataaggaatctttttagatggccatccatataagcatatggaggatcaaatttaaatgagctgctgggatgctcttaggcttcatatatggaagatactaaaacatcacgtgacaacgataattccaatggacatatcctaccgattatccaaattaacttaccaagacagtgaagtgatgatctatgatctaattatttttaaatgtatatgtatctaggggcactagagatattttttttctgtaaggtgcaggagatctgagtattactccctctgtttctaaatatttgacgccgttaattttttttaaaatatgtttgaccgttcatcttattaaaaaatttaaatttaagtaattattaattatttttttatcatttgattcattgttaaatatacttttatgtatacgtatagttttacatattttataaaagttttttaataagataaacggttaaacataatatttagaaacgaagggagtattatattaagaagaagaaagatgggatagaaccacaggtacaaaaccaaacacgcacattgaattctaggaaccatgcgtatccgcaaacgcaatcccaaacacactaaagaaaaaaaaatgaccacggcacaaaccacccagctcttgtgcaataaaaaagaaatagtccacgagcctcggctaaacaccacaactcagcatgcaaaagagcacgtgccaagttaggagcaggtccataaaaaacataacagttttgaggtatttcatctcttatgcacacaatatataagccattgagacccaactcaatggaagttcaattcataatcccccaatctcttatctcaaaattacaattatatatttctttgcatgatatagagaagagctaagagtgttgccactatcgggacattgatgcaactcatttgcactatggccgtgtttagattcaaaagtttttcttcaaattttcaacttttccatcacatcaaatatttagacacatacatggagcattaaatatggacgaaaaaaaacaattacacattttgcatgtaaatagcgagacgaatcttttgagtctaattacgtcatgatttgacaatgtggtgctacagtaaacatttgctaatgatgtattaattaggtttaatagattcgtttcgcagtttacagacggaatctataatttcttttattattagtctacatttaatacttcaaatacgtgtccgtatacttaaaagaattttgacacacgaactaaacactgcctatacctcctttctcttgatggtccaagttcttgtgccgagtgggcaactgtggaagtgccggcatccttctctcacatctgctttttctctcccacgtcagattgaaacaatgtgtagtggctaatctcgcttgcttgtaagccttgctcttagtgcaaacgctatgcgagaagacacttcaattctcaacacctcccaagtcatatggcctaacttgatagatacaaaatttgctcattgttcttatggtcccatgctattagaagctgttttttattatctcataagtcacatggtctaacggagagagttttttcttatccctttagataattaaaattgagaagatagttaggccaatttgcacatgtatcttaggactcaccagaactgccttccctcactcctttatgttttttaatgggatggaaggagagctgggtgttggtgatatgccctagagacaattatagagcaaggcaccgctatatataaaactatatgtatacatataagtatatttaataatgaatcaaatgatagaaaaagaattaataattacttaaattttttaaataagacgaacggtcaaacatatttaaaaaagtcaacggcgttaaatatttagaaacgaagggataattttcttttgatctaccgggctccttgtttcagtagttgtctcttgtctctgctctttctgctcctccatacatccctgtggacaggagatcagagatccatatctgtggcatgatcgatcgatatgctgcccaactaaatcgatagaggaagcgatgaagccatccacacataagtgtctacagactacagaaggactctgggggccaaggaaagcgagtcgccattacgcattagtccagtgctctagtcaccactctcgatcgatgctcacaatacttcatcttctagcactgaaacaaattctgagcacttacttagcctcatggaggcaattcgactcccaacacctccaatccctatcatctgcaactctcaagtagaaatttggcacatatttgctccactgatgacgaggcaatgcccttgctataggtaccagcagctatatatagatgctctgcaagacttcaaaaaaaaagagaaaaaacagcagctatatcctcactgcagtagaataggcttttgagtatgtcataactaaacttcaaaaggtagagtatttctacatttaatttttttatacaaaggaaatggtttgtatctccatattcttctattaggcacgcaaccattgtctccatttttaaaaaatatattgataggacatacaaattaagagtgtgtttagttcacgctaaaattaaaagtttggttgaaattagaacgatgtgatgaaaaagttgaaagtttatgtgtgtaggaaaattttgatgtgatgaaaaagttgaaagtttgaagaaatagtttggaactaaacttggcctaaagatgactatattcctgtgaagttatgagtccaagctatatgaaatatcagcggagggattcttttcgatccacatgtagtacatgagaaatgtgtagtttggtagttatgagtccaaggttgtgttctttagcctaaacttctcaacttatgtccctcgttttccatgtatatgttttccaaactgtgcctaaacagtgtatttttttcaaaaatttagaaactcatattaatccacttttcaagttttatactacctccgtttcacaatgtaagactttctagcattgcccatattcatttagatgttaatgaatttagacatatgtatatgtttagattcattaacatctatatgtatgtgggcaatgctagaaagtcttatattgtgaaacggaggaagtaactaatatttaattaatcatgcattaattcatcgttctgttttgcgtgtggaggggagtagggctgtcaatgagccgagctcgtctgtctaggctcgagctcgatacaagctcgagccgagagattttataggctcggcccgagctcgatcaagctcgagctcaactaccgagcttgatttctaagcaaaacaatatatatttctaagataatctttaaaaaaaataattaatttatagttcatcatattaatagaagaggaaaaaagaataaaataaatatatgatgtcacaaaataaatatatgatgtcaatataagacacacaaatatcatatttgatctcctaatttattaaataacaacaaaaattatatattactaggctcgttagaagctcgagctcggctcgacaaagctcgcgagcttagggagaggctcgggctcggctcgtctggagctcgagccgagctcgaatcgagcctaggacgagccgagctcaagcagctcgcgagcctcaagctttttttgacagccctagagggaaggtttcctgcaaaagaacatggctaaaaagaggtgggtaaaacttataatgttcttaaatctccttcataacattgaaagaaatcttatcaaacattgcacttttgcaaatgaagaagattttgtgccgctgaacatggctgaaatctacccttgactaacaatagagaatgaaaagtgcgaacctaaaataacacaaaagtggtctctcatatcccttcatatattagaagtctttgcaagtgacacaataacaccaaccagactttggctaaacagatatgcatgatattgcaatgtaaaatagtggaccaatattcattttgcactcacattcaactagtgccatgtaagaactttttaggagctaacagcccctagaagttaatcgattttgctataaatctggcgacaaagatttttgaaccgttcgataaacctcgggattcatgcttatgtttctttcgacgtccgcaggccacaggcacgattcattcatgcgtagtagatgacagacgaagggcaggcataaagtggcacagggcatagccgaacatgtcctcgtttgatgtttcatggcatgcatgaatgatggccaagcactgtatgctggtagatgacggcaagcattagttcgatggcatgccgcatgcacaagttcagccaaacaaacgttgcgagttcatgattcctcttttgcgtgagcggtgtccaagcggaagttttctaaagttatatcttacttacatgcaagttacattgtagttacattgtaattatatgtaagttacagcgtaattatattgtagttacagtgtagagttacactacaattatatttgacaaatttttagaagaaaatttatcgacaaatgtatagatttgggcttatgcccctaccaatctcaagtgggcccaacttgtccggatggacgggcccatccatccaagttgaccgcgaccatgggcctcctctcgacggcggcggtgcttttctcccttgccgtcgctgtcgcgccgcccctcgtgcggctccaccagtggtacgccgctgagttccgcggcctcaactgggctggagctcctcctccactggccgctctccgtcgccaccctctacgtgggctggcgccacctccctcgtcgccggggtctccgtcgtcaccacaatggtgagtagtcgtgatcccccgcgcggatgcttggatgtcctcagattcaacattcaagtacatgttcattagggtcttcagcttagtaggtatgcgtatttgttgtaatttggtattgcaagaagctgagatcaaatactcaaattcatgattttctcctttgctcctttgtcaattatctgagaatttagggcaaaatgaggaatttgaagaggaagaagggtacgtgtcatgcccggaatttctatccaaaactccaaacgcttacatgtgtgtaaaaccctcgtccaggaatcagccgagagacacaataacaaattgataatagagtgcaattattaatctaattaataggcgaatataaagtcattacagaggtagatagttcctctcaaacattaaatatctaagcagcggaaaataagagaaacaacgcaggcgactccaacccacaagcagcttgaccaaggctacgcctaatcctccacaccttcagcatcactgtagaactcctcctctgatgaatgattgcaaggtgagtatatgacatactcaacaagccatgcagcaaatatgcaaatgcaagggataacaaaggatggcataatatagtctcatttgcataaatggcatttaataaatacttcagaaattaataaaacagtaaagtatttaattaaacaatattaatccaacgctatacaatatacccgttgcataggcccaaccattctgaacaaccaatcccggctgcacagttctatctccaaaccaggaatataccattccaaaccaggagctaaacaaattattatcatcataatttattatggtgagagatatgagactaatcacgaaagacattgttagacccgccaataaccacgggcacggctattcgaatagttttactctggccagaggtgtaccactgtacccacaagacacaacctcaacatcatgtcaaccatgcgtcgcgatacttaacaagtacccgaatagagattgtgacaatactctctgcataacacaattcaaagtagtgcacctttctgttgacagaaaacacgaggcctgggagatctgcttaactccagtgcaggtccaaaactcgccttcggatgtatgagcgtgctagttgatttgatcctgtaatcaacaagaaacaaagacaaagaaaccgtggttaaatctataaatgatagccgatcggctaggtgccgatgacatatcatttattttagaccgatgtcatatgtgcattgattggcaagtattagtaagcaaatcagaactaaatctactcgatcggctgtagatattaatgacatataatccttacatcgatatatacttaaatcaagtgattgggatagatcgatcaccttgccgagacagtataaatcacttagatcgaaatatatattaatagtgagattatatatattcatagcatagccgatcagatagatctagcatgtatcggctagtactccgataccactctatattaagatattaaagcaaacagaatataccaaacagaagcttaatatacttaaatgcaacaagatcttaatataaaggacagatttaacctatcaatcaagcatataggataaaaaatagttaaatcaggtaagatcggctgaaactccgatactaatctaatcggcaaccagaaggcaggctagatattatggttctaagcacgacttaatagatcaaactcaactgatgcagcattaagtatgaaaagaagaacaatatctagacaatcaagccgctggatgtttcatagagtggtagatatatcacataatctaagtcaacgacgttatttaacctaatcggctgccttctattgacagatgctagccgattataagttagataacgatattatcaaagattatgttagatatatgataactcgacgaattacgtaaacaagattagagtatcataaagatggaagcactaatcttgagaacacaagccgtcataacaagttttacctcttgttgaagatcaaaaccgatgcagctcaacccgaaagcaggaactcgtcgaaacaaaacgaaagtaaaagggtggcgatgcgccgaaattgtattgaacatgtgttaataattacatagggctcggggtctatttatacccgagaattacaagatatgtccatatcagacacgactcttatctctaacaaactctaagataccataagtctttgcggcagacttttgcccacatttatctctaaggaatttacataaaatatcctaatttaatagatacaattgtcttcccaggactctatccatgcgtggcaatcatcttgaagcacaccaactcgaacccgacgtcgtacacaggtcgtattgtcgaaatcggccatatcacttaacccagtctgactcggacttagccgatcccattcgtagccgatccggactccagccgattcttactctgtttccgcgacaacccttatccccgattccgcttcgatctaatcttcatctccgattccgatattaccaaatttggtcgttaacactttcctggatcataatcaccccctcataaacaatgcatggactccccagcgacccccgtgggcttagctctgccacttctcagtctggtgctccacaatgaaccatactacacaaaaggtaaagccgttgcccacgctggcttgtggttggcacggttaatgtttcacaaccgaaaatcgtgaaccggtccttaattgatatgagcacgaccatcaaaaccatgcgctcacaactcaccattatcaagttttagttggcatcttaattaatcattagttatcccattcatatgagctaatgtctctaagcatggctaagcatcctaatcactttagctaaaaccatatattgttctagctaatccaattattaaccaagtgacaaagtataggtaatcaataacaaaggctatgacaaaggcaataggtattcccacccagtgacattcaaaaataaatgcaatagttgaatagaaacaatagttttaaacgggatcaacatgttcaaagggttgtttgggatctatgtgacttgccttgctggccttggaactcttcaaagtcttctcctgcaaaatcggactctccgggaacatcggaatctaagcataaaagagcaaaatcaccaaaacagtacataaacaatcataaacagcacatgtgaatatttttatcatgtagatctcaattttagaaaaatttagagacttgaaccaactaaatccgagctaagatgaattagttatgattttttaaatattaaaccggattaaatcagttatttggattttaattggattatgacgcaataaagaattattttttaaaaggaaaaaggatttattgcgtcagcggctcgggttcacggtggaccgggtacacggaagcggtctacgaaacgaacggccgatatctaatctaatcaaaacggacggccgagatctaaccgatctatcgcgggtctacggctgtgttaacaaccaaatttggtaacatcggcgttgggaaagaggattaaatcgaagcaaagtcggaagcggagattgagtttgaaaacagagcaggaatcgattggagtccagatcggctatgatgagatcggctgagtctgagtcgggctaggtaagccagtgtagccgattccgacaatatgacttgtatacgacattgggttcaggatgatgtgcttcaagatgattgccacgcacggatagagtcctgggaagacaattgtatctattaattaggacattttatgtaaattccttatagataagtgtgggcaaaagtctgccgtaaagacttgtgatatcttagagtttgttagagataacagtcgtgtccggtatgggcatatcttgtaattctcgggtataaatagaccccgagacctatgtaatttagaacacacacgttcaatacaatttcggcgcatcgccatcttttgctttagttttattttgacgagttcttactttcgggttgagctgcatcggtttcgatcttcaacaagaggtaaaacttgttgtgatgacttgcgttctcgggattagtgcttccatctttacgatactctaatcttgtttatgtgatttgtcgagttatcatatatcttacataatctctggcaatatcgtcatctaacctataatcggccaacatctattaaggaaggcagccgattaggttagacgccaatgttgatttagattatataaggtgtctaacaccttatgaaacatccagcggtttgattgtctagatattgttctttttttcatacttaatgctgcatcagttgagtttgatctattaagtcgtgcttaaaagtataatctctagcctgctttttggttgctgattagggtagtatcggagtttcagccgatcttatctgatttaactatatttgttttatatgcttaattgacatgttaagtctgccctttatatcaagatcttgttgcatctaaatacgttaagcttctacttgagtattatacttgctttaatatcttaatataaagtggtatcggagtattagctgatacatgctagatctatttgatcggctacgctatacatatatataatcttgttgttaatgtatatttcgatctaagtaatttatactgtctcggcgtggtgaccgatctatcccaatcacttgatttaagtatacatcgatataaagattatatattgttaatatctacagccgatcgagtagatttggtttcttgctacttattgatgatcgccgatcgattcacatatgacatcggctcagagataaatgatatgtcatcggcatctagccgatcggctatcatttatagatttaaccacggtttctttgtcttcgtttcttgtttattgcaggatcaaatcaactggcacgctcatacatccgaaggcgagctttggacctgcactggagttaagcagatctcccaggcctcgtgtttttgtcaacacgcttttggcatgcccagtgggacgcttaagaagtcagatgacagttcttcctcatggccgaaaaatagccaccaccgccatctagcccaggttccattaaaggcaaggtgttgaagcagggattgactgacattattgatgacaacgtcatgctgattgatccagagaaattcacgcctgagcagaaggcggagtttgaagcaactctgcagcaggcacgggatcagttcctgaattcattcatgcagacccgtaaggggacacttgttcaaaagtataaaataaaagtggttgctgataattctgggactagttcttctaaagatggagaggggaaacaagctccagatggctcgactcagccaagcatcaaaggtgctaccgacggctctttaggaaatcaaggtgacaaccctcaaggagtccatggagtacaaggtgatggagtgcatggagctcaaggtgatggtgctcaggggtcgcaaggaggaaatcttaatcagaatagtgaagtggcacaagactttttcaacaatttccaagatcgggtcgactatgctgttcacaatgctctgatcaatcagtccggggtgttggttaacactttgtcaaatatgatgaagtcgatagccgatggttcaatagctgagcatcaggctgcaggcccagtgtatttacaaggaggcgtcttcccaaattatcgtcctttgatcaccgacgctcagccatctattcaggcagttcctcccatcccatcaccagctcagccgacggcaccagcgtcggctcccacgcttgctgtgcaactttcagctccaggccaattgattaatccccaactgttggtgagagagcaaccacaccatgctggaccaaatgtgacccagctaacgcaggatcaggttgcatctatgtttttacctcctcggaacacggttgatccaactcagcagcagccgattcaacaaacgccacccaggcgacaagttgtgcaacctgttcaacaaacacccccaatccaacaggtcgcgcaaccgatccagcaaacaccaccaagtcggccggttgtacagccgattcagcagacgccgttgagacagcaggtcgttcagtcgactcggcagcagggcttaatggatgtatcagctggattcgcatcgcacgctggtcagtgtgctccaaatcaggttgtcccagagcacttgatccatcacgtgcagccagatgacacagtagtaccctaagtgatccctgagcatttggtgcgtggtatccaaccgaaccttcacaattaccagggaggcaatttgaattatcaatatcagcctacatcaccgcaagtccagtaccagcaggccgaatcggctcagccccagttggttcctcagtacaatcagttcgggcctacacctcaacaacctcaggggacacctcagcaacggccatgggccgatgtgatagccaatgtgatgagggagcaatttgggctcaaaccaaaggaaactggaaacttgtaccgacaaccttatcatgagtggtttgaaagagtttctctacctcatcggtttaaagtgccagatttttcaaagttttccggacaagatactacatcaacctatgagcacataagccgatttttagctcagtgtggtgaggcatcggctgtagatgctctgagggttagattgctccggttgtcattagctggatcggcttttacgtggttttcctctttgccgcatgggtcaattaacagttgggccgacttagaaaaacagtttcataattatttctatagtggggtccatgagatgaagttgtccaatctcacgtcgatcaagcaaaagcatgatgagccggtgcatgagtatattcaaaggttcagggagatgaggaataaatgttacagcttgagcttgaccgatgcccagttggccgacttggcttttcagggaatgattgctccgattagggagaagttctcattggaatattttgaaagcttgtcgcaccttatatagaaggtatctttgcatgaacaaaggtttgcggaagctaggaagaactctaggaagattaatcatgtttatccttatatgtatgcgtcggatgatgaggatgatgattctgaaatagctgcagccgagtgggttaggagcaaaaaggttataccatgtcagtgggtaaaaagttctgaaaaagaggagaagtatgattttgatattactaaagctgataagatctttgatctgctactccgagagaagcaaattcaacttcctgctggtcatacgatcccatcggctgaggaattgggcaagaagaggtattgcaaatggcacaatttctcattctactaatgattgtaaagtttttagacagcagattcaggtggctattgaagggggcaagattaagttcgatgactccaagaagccgatgaaggtcgatggcaatccttttcctattaatatggtgcatacagctagccagacagtcgacaggatccgtgcaaagggttttcaggtgaattcggctagggttatcaacaaatatcagaggaaatatgacaagcagaaggacaagcattatgaagaacacgatgatggctttgatcctcattggggttgtgagttttttagattctgctggaatgaagggatgaggttgccatctattgaaaattgccctgggtgcagtgatattgtcgagagttcaagccgatcatataacaggggtaatcggctgaggcaggcaagagtttctgttcatcaaagattgggtcctgtgaatcaagatcgtggccaagaggatgaggtaaccaggaagaatcaatggtgtccttctggtattttcacgaagaatcaaaaaaggagggttcaaagattgaggagaagggagcgcctccagaaggttgaacaagaaattaaccatcggctgaggaaagcaagaccatgacatgagtgccgtgttaagaatcaggttcatgcagccgatgacgttgcagctgatgaggcgaagaagttggcaaaagggaagagtgttgtaacagcaccaattaacatggttttactttgccagctgagttcggaatcgatcaagccgatgtcgaagaagtggaacaggaatcggctaagttggttctgtcaccagaacaggcagtgttcgagaaacctgaggggacagacaatcggcatcttaaaccgttgtatgtaaattgttacgtcaatgggaagctgatgtcaaagatgatggtcgatggtggagctgcggtaaatttgatgccttatgctacgttcaggaagttgggtagaaacaccgaggacctcatcaagacaaatatggtacttaaggactttggtggcaatccatcggaaaccaagggtgttctaaatgtggagctgacagtcggcagtaagactattcctactacgttttttgtcatcgatgggaagggttcttacagtttgttgctcggaagggattggattcacgccaattgttgtattccttcgactatgcaccaatgcttaattcagtggcaaggcgacaaaatagagatcgtgccagccgacaggtcagttaatgttgccagtgccgatttagctctttgggagatggatggccttgattgtttatctggaaaggtttgggatggagattttctaaaagtatccgattctgatatacagccactcaaagatggagaaccgaagctattactttgagggcgtcgtggagggttcaaacgtctacaccgaggacacggtagatgatctcgatgacaagcaaggtcaaggttttatgtcggccgatgatttggaagaaatagatataggtccaggcgatcggccaaggccgacatttattagcaagaatttatccccagagtttagaaccaagcttatagagctcttgaaagagtttagagattgcttcgctttggagtattacgagatgccagggctcagtcggtcaatcattgaacatcggctacctattaaaccgggggttagaccacaccagcaaccgtcgagaagatgcaaagccgatatgctcgaacctgttaaggctgagattcaatgcttatacgatgctggttttattcgtccttgtcgatatgctgaatggatttctagtatagttcctgttatcaagaaaaatggtaaggttagggtgtgtattgattttagaaatttgaataaagctaacccaaaggacaaatatccaatgccagtggccgatcagttggttgacgctgcttcgggacataagatattaagttttatggatggaaatgcgggatataatcaaatcttcatggcagaggaagacattcataagatagcttttagatatcctggtgcaatcggcttgtttgagtgggtcgtgatgacttttggattaaaaagtgatggagccacatatcaaagggcgatgaattatatttatcatgatctgatcggctggttggttgaggtctacattgatgatgtggttgttaattctaaggagatacaagaccacatagccgatttaagaaaagtttttaagaggaccaggaaatatggcttgaagatgaatccgacaaagtgtgcttttggtgtatcggctggccagttcttgggttttcttgtccatgagaggggaattgagataactcaaaggagtattaatgcgattaagaagatcaaggccccggagaacaagacagagttgcaggagatgattggcaagattaattttgttcgacggtttatttctaatttatctggaaggttagagccttttacgccgttgttaagattgaaggccgatcagcagtttacctggggggcagagcaacagaaggctttggataacattaagaattatcttagttctcctccagtgttgattcctccacgaaaggggataccttttcggttatatctgtcggccggtgagaagtcaatcggctcggttttgattcaagagctcgaagggaaagaaagagttgtgttttatctaagccatcggcttttggatgcagagactaggtattctcctgtggaaaagttatgcttgtgtttatatttttcatgcacaaggttaaggcattgtttattatccaataaatgcaccgttatatgcaaggccgatgttatcaagtatatgttgtcggctcctattttgaaaggacgggttggaaagttgatattttccttaactgagtttgatcttcggtacgagtcaccgaaggtgattaaaggccaagctgtcgccgattttattgttgatcatcgtgatgattcaatcggctcggtcgagattgtgccgtgcacatgctctaagtctgtttgcgtagttatggtcagccacacaaaagaaacatgaatctcttctcaaatatatttggagcgtgtcttgtgagctgcaggaaagtctaccgtcccagcccgaagtagatgaattcccaacaactcctattcctagcaccacaaatgaaatgaaatcaacaacatttctgctacctcatgcggggagtgtgtccataacctaacaaacaatatgagcctagccttatatatatagtgtgtcaggctgtcagctcatattagctatgttcccaaacttgggcaactttgggctgaatcattgtgcgcttgcctttgttccctttaaattaatgcaaaaattaactattgcctatcatatgacagatataaggatgtcattttgctgaaatatattgcagaatcaacaacttctccaattaatacttgcagcgaaaaggcatgtaatatagtggttgaagtgacctgagtagcaatccaaggttctgagtttaaatatccatacaatcgaatttcatattgggttatttgaggagctaagttttcgatttaaaaggctgcatatatcctattaaatatagaggccgggtaaaaaaatacatttctctttggataatgccatttataaattttcaggagctaatggtccattaaaaattcattactccatcagtctcaaattatggggtgccctcttttcgaggaaaattaaattcggtagcttttaactaataatcatactaattatataagtatatactaaatattatgcatgttatatcactagattcatattttgaaatactttcatgtgatgctaatttcatatttgttgggatcataaaataaatactaggcaaagtatattattgaagaccgtgtaaaaaaatatagccttataatttacgcgagagagagagagtagggcctgtttgggggagcttctagcagctgcagcttctcttagaatctccagttgtcagaagctccctaaacagtccagctttttacctagattctgagaatctgtagttgtagaatctgtaaaatgaactagggcctgtttgggggagttttagattctgagaaacagctggttggtagccagcctccaagaatctggaaaagctgggttttccagcttctggcttctagttcattttctggattttacaactgcagcttctcagaatctggaccaaaaggctggactgtttgggggagcttctgattctaggagaagctacagcagctagaagctcccccaaacaggcccctagaagcctccagattcttagcggctagcttctcagcagttgcttctcagaagcttaaactccccaaacaggccctgtatttcccgatttactactcaaataaaaaaaatctatgaatggacttgtaggtttgggatggattgggcttaggcccgccctactaatttcaagtgggcccaacacgtccagatgaaggggcccacccacccaaagttgaccgcgatgttacgatgggcctcctctcgacggcggcggacgcggcggtggtgctcttctccctcgccgtcgccgccgcggcgcccctgatcgacgcgcaggccgtcctcccgcgccgcctcttcccggcgcccctcgttgggctccaccggtggtacgccacggagttcggcgactacctggcggccgagccgccgggcttcttccgcggcctcgtctggctggagctcctcctccactggccgctctccgtcgccaccctctacggggtgctcgcccgccgcccgtgggccggcgccaccgccctcgccgccggggtctccgtcgtcaccgccatggtgagtagagtcgtcgcgaccaattctctcagattcaagtccatgttcgtcagtgcctttggtttagggggtatacgtatttatatttggtattgcaagaagctgaggtcaaatactcaaattcatgcttttagcatttgctaattatctgaggatttaggccaacatggggaatttgaagaggaagaagggtacaaatatgaactgggtgattggtgaattcgttttgttaactcggtttatcttcgtcattgcgacgttggggtttacgtaatggaagttccattgtcaggactcgcaaggttatgcttgatttgcttgtcactagacttagctcaatttttatctataattacttaacatacgagttcattttttttctttgggaaatatcctgataagttctaatgttctacacactgatgggatgggcgtctttttaacagttgatggttgcctgtcatgatgtgccccagcgatctgatagtaatgttgacattcatcgatgctattgatgtcgtccagtgctcttttaatacgcacaaatagattgaaatagtttgagcagtaatttgtctcgaagttaaagtaacatttttcctattctaacttaataggaactttccaaattttttgttcgattttgtcttcatttagaagtagaacttcaatatgtgaagaactctccataatcctagatatctttcaaaactataagttagcttgcttcagaaatctaataaaatagcaatgggagaatttgattgacaaaagggtataagaagaacagttactacttactataacattaccttttctaagttagaatcatgcattcgcacgttgattgatttgtctttttttaacgatctgttttgaatcttaccttgtcattaatcttgactttaatcgtttcagtctgcagtactcggtgagtttttggtctcagggcgagcaacacataagctgcttcagatgtatgtcccttttgctgttcttgcagtcattgcagctctgcgcggactggtcgtgtggtcttcgcagggtactggtttagcacctgcaccttcttctcagaagaagaggccctaaggattaattttatttcttgatcttgcggtaaatttgttttttggttatagtcaatcatgtatttcttgctcgcgtgtattatttacagcaacgtaaagatcctcgtgaatgtttttgaacaatcagtgtcgtctccaaaaaggcaatgttcctacttatcttagttctttgagaatttacaccttttcagcaagcggatccagcatacctgttaggttgagaacatttctgtgattataggcttatatataagactcttccttttattttatccactttttaagctctatcgtttcacttattcttatgtctataagctaaaatttaaattttgcaacttaattttggagttgattttggtgtttttcatcatagtttattttacacaatttgttttggtatcactaagaacacaaataaaaaaagtattacccattaattattttttgattgctaataagttatgcggataagcgtaaacataagcaaagcgatgaggttgtttgtgagaatctacaactcgtacctctttgcgtagtttcatttaataaaagagcttcaggactttgagtacaatatttactcttactatattaatttttatgagaaaaggttaatctggtttacatagtaattctctcttttaataagagcaatgagggataaaaacggtgcagaaacggatggaaaccacgttatcgttttcgttttcatattttttttggaattggaatcggaatcggaaaccccggatacgaaaacggaattaaatattattgaaaccgaaaacggagtgaaaatgaaccagcgcggatacgataacgaaaatttatcgaaatacaaaaaaccttcaaagcgagcttcaaacttcgatggacaaaaacttcaaatagacggcaggggacgagacgacatgagatctagatgtgtcgcttcgccgcccggctctagaatcttcgatgtcgaagccgcccggctctagaatcttcgatgtctttctcagtccctcactctctactctctaagtctctaggttacgtgaggtattatagactatgggaggtatcatactgaataggctggcctggggaggtattatggattatttgtattttatgcgcctgtaactttgaaaattccgaaaaagtttttggaaagttttcgaccgattctga

SEQ ID NO: 61987 - DNA, 18429 bp, Oryza sativa
tggctgctgcctagatcatgtggatgccccagtattagtttataagtatggtgacataggcttgcatgatgctcttttcggtaacgcgtggcagcagtttgattgtcctttctcttgcgaaatacgtctagagattgcagttggtgctgcagaaggccttgctcacctgcactcacttaatgtggttcacggcgatgtcagaactgccaatgtagtactggatgtttattctaaatctaagctcgaaatgcctgggataactgcatttatggcaaagattgcaggttatggaacacaaaggctcctttccttggataaggccaagcatgaaatatttctaacagagaacatccattacaaggatccacacttcctcaagactgggctcatggctaaggaatatgatgtatatggttttggcgtggttcttgtggagctcttcgcacagaacatggtgcaaatgcatgacgtaaacatggtgctcaaagaacttgatggcattcctgctagatgccatcatcttaaggaaattaagaaacttgcttcttggtgtcttgcatccaaggtgacggagaggccagcaatggacaaggtagtacgatgccttcgagctgtcttgacaaacctgcaaaatcttcatgatccctgcaactgcaagtcaatgtataataagtctgcgatgcagtccgagcaaattaccagtgccaagtctgccagtagctgatagctccacaattgtgatataggaagttaatacaagttcccaattaatgtgacctaaatgtaatattaatatatattggtatatatgtgtttgtagaactatttgctggtcaaatatagggcaaagccataaacagtaataatatttcttgctggattttctgctgggatccagcgattggagagacagaaaatgtactgttagtagtagagatggcaataatgacaacacaaacccttctaattgtgtttccagcagatatccagatcttaagatgctgtttatatatgtgtaacattatccaattttacaataaccctcgtgatcgacaatacgggggttaaattcatctcactagagcttttttggttgttttgttgtttgttctgaggtttggttgttgcatgtttgcggaattgcatgcgccacagatagcaagtagcaaccgctgtatttagttctactagttagcgtgcacgtgcaaggcacatcgaattatatctaatggagtacaccatgttggttttttacactaacaatgaagaggagaaatatcaattcaaaaaaaacacattgcttgaaccaatcgagatacaatttatgttgtcaatcatgttcgaagaacgtgcggaagcattaggaacacagagccacctaggagtgttcaaccctagcacatgtggtggttagtgggggtgtggcgtcacaacgctccatatttaaggttagaggacttttacggtacattctacttcaagtattcaagtatatactgttagtatataatagggtaggttcggtatttgttaaaaatctgaaaagggttgtttagtcatttaaaatagagattattttggtttttttaatcatgaatagtgataaactttcccgtggttttttttctgttgtggatatcgtcatccgcgtgtagcgcttcttttcatttcatccggcgtccccggcgacggaagctcccggcgcacctcgctcccgccccggcccagcgcctccatcccgatattacctccggcgccgggagaagccgatcttccatgcgcccggcgtcttccgccgttccgcatccccggtgccttgtctctagccctagcctgttctcccccttatccgacctcccacagcttctgtcttccccaaaccacggcggcgagggttgatggttttggagtctaaacatggtttatatcgtataaagttcgaaacgatgttaatggttttggagtctgaacattcttctttcacggccttctctggaagactggaacgtgggagttgaatggatagtagtcacagaactgttcatacattagttatattggcatataaccatgctaattatacattagttatgctaattatgccgccctgccgctgccacctgccgccgccgggctgcccttgccgctgcgagctgccgcagctgcacgccttcttcccggcgcccttctgtagctccgcctgcccgccgcctcccgcagacagggcgtatgtcattgaactccgagttgaggatggtgtcgaactcaacgacgaagaggtggttggtcgcgttaacgtcgccatgccatcaaagctgagattcgcgccagtgaacccgttgaagacgaactgctcgtggccaccgcctttcgcagcccgccggcgccgcctcccgcaaacctgacgaattggggattttcggaagaactaggttttgggtgaggaaagggggagggaaattgaatcgattcccgatggcagcgacgccggttgtggttgtcgacggcggtgcggcgcggcgtgctcgcagaggcagtcagcgacagtggtcgcccacgcgcggcttcgagaaaaattcgctttgcctgtgcacctaaggccagatctgactaagtgagaaacacgaatttacaaaattacccccacgcaaatagataaaaaagacaaatatgccccattcaatttatactgcagaataattgggagaaagatcagatgttattttctccgttagatcaaatatattggtagtatatacttcaagtagaatgtatcttaaaagtcctctaacggcttgtttggttggagggagttttgaataaggaaatgggagtttaggagattgagctttttaatctctagtttgattagaggacttgggaattttagagggactggcatagagaattaatctatccaactcccaccgatcccatccctggggacctgttaattcacgagacttggtgggaattaaacagcagaagtccgaaatacccctctcccgcacactccgccgtccattgccgcgaaaaggaataaaaacgcgcgaaaaatcctgttcactgccgcgaggaggagtaaaaacgcgcgaaaaatccccatctcagcgccactttcctcgcccactccgttggccaccacgagaagcaataaatcctgtgaaatatcaccagcgattctccccattcacacgcgaaaccacagccaaggttaggttctgacgcaagtttgttgtgttcttgaaaactctccctctttctccctctctcctgtacagatcgagaccacagcctcatgaggtctggattctctctttccccatctttctgcagtacatgactgagaaatttgtgtctttctcctgtacagatcgatggaagcagctttgtaaggggaaaaggtggggggggggggggaaaaggtggttctgatctgctgttcgtacttctacgtctgttgttgctcaaggctgatttttttgtagttttgctctgcagtttatcacaccaaaagctgtaggtactgatgttattctgttctctatttttttttcatcagtcgattgccttgtttgattttccaagacagatcaatcagatttggtattttagtattaatggtagtaggcattttcccagtgtatagagtagacctgttcttaatttttttttcatcagtcgattgcctttatagattttccaatatagatcaattcgatttcatattttagtattaatggtagtaggcatttaatctgctatagaatgacacatagtgtattcgtcaatttcatacgtgatacatacagaatggagggggatatgatcagtatcaaaattcatcatgggggatctttttcaaaggagggtcaactttgctatgttggaggccaagtctctatttttcgcaattgtgacagcgaaaggatgtcatacttttgtctagtagacatggctaaagatgtaggtttcaagggtggagatgaactattctatgctatccctggttatagtcttgaaaatggaatcgacaaacttcatgatgatcattcagttcgtaaaatgttgaattttgcaaagaaaggcaagtcaatggaaatttatattaagcatcttgaataaggtgtaagtgctactccaatatttggacaggatgttgaagataatcatgtggaggaggtactgtacttagaaacaacttttcttttccttccgtattttttttctgatgtgctgacgtgtgatactgtgtcatttcgctatgtttttttttgttgtttgtgctgcttgtgcattttttttcctcatgagcatggtaccttgataaagtatagttagtacttgatcttgacctatttaaaatcctaataaatttgcaatataattttgttgacagacatggctcgccctccaaccaatcgagatattgtaatcttttggaacagaatgagaacacgtagagtgaaaatagtgatgacattgtatttattgatccatagcggactgtggagactaactgtggtgttgttcaaggccaccagcatcattgaggcccctggactggcagcggcagcgagaggtctcagcggcctagggtcgagtgaggattgatgtgcatagatgtaaatccaaacgatatcgtttcaatgacaatgtgagaataaaaaataaaataaatagaatatatagattatttgacaaagcagagataaccgttctttcgtttacaactatgccgtaggttgccttcaatatgaaataatcattctagtgctgcgctgttttaaagctaaacaggttgaatagagaattgacaagcataacaagtcataatagtgtcagtaatcagttacaaaaattgtcatatatcatgaactgaacatacaggaagcaaacacattctgtcagttagaaaaaaatgaaaagttatcaaaaaaactttcattgattttcagcctacaaatcataagaactctcattgattttagcgattccagttttcaattgtttcaatcgatctctagatcttgatggtactaacaacccattcaatataacttgattgtttctaggaagggatgatcatggacgtaagtaatacatacacttgattgtgaatcaatgagagtttcttttgttgaacgactgaaaaatttctactgcacttttgagtgaaatgatggcgaaaagaacacagtgaaatcaagaacggcctgctgctcaccgagtcaaggaggatgttggatgccttgaagacgctagatgaccggtgtgtcggcgtagtgaaggaaggcgagccccttcaccgcaccaatggcagtctacatcctcctcatccatggtacaggactatcgagaccttcacacaattacagttcaggtcagcttctacaagtctttccggaattgacacagaggtggtggtgacaaactgacggtgaaggtagcttttgtagcgtgaggttcagaatgaataaatgacattgcagactattaatatactgatggaaaacattgcaagatgtgtctagacaatgaactcaggagataacgataaactccagagcaaaacatggctgtccaaggttatgaaagattacaacgtagcccatattaatttggtaaatgttcagaattaggattataaatttagatacgttatatgaactataatccattgttttccataacagaacaaagatacaagtccaacgtagcccatattaatttggtaaatgttcagaattaggattataaatttagatacattatatgaactataatccattgttttccataacaatacagtaattcacaatccaaaatgcagattcaagtttagtttatggactgaaaaaaataatgtatgacaaggttcagaatcatttaatcaataataaatactgtcaaattttcaaaataatcaattcacgttcagtttcatcaaaacagtacatgtaaaaatgcaacattcaaataatgctgtacaagcatcaattgcatcgttccctcggcctctgccaagtgccaagtgaccaacatggctaaagagatcaatcatacagcattaatgtttcattgttggcctgataccgtaatgatacaacatgaaatattcatgaagtgaaaaatttctcaaaggtataaaataaaaaggaatttagtccatctaaaggcactcttagttttatatgcagagcatgctcaaaaccaggaatgacatggcaagctcgatgtttacataaaaatctctagaaagtttagaatgcgaatatacttaaacaaacttcaaagttttaataccaaaatatattaaatgaagggattttgtgaatctaaaggaaaaggtatcatcaagcagagtagcaagtcatatatatgggattagcatcatttacctctctcctgaaccccagttgttctcttatttgctgctggaccaatgcattccattcattccagttattgcatcaacttctgctacaggatcactaacaaatttcacaattccataaacctattaacacacccttaactgaaaggcaatggaccctaaatgcctcttgtagcatgtagtctgcaatatctgcagccagatcccaactacaatggcccaattcaatcgaaagaccatctcaacattcagcatcatttgtgcagtgtccactatatgtctgatgaagaacttgatcagcagctgcctgcaacgcttgtaatctcaacaaagtcataaccctgaagttgtccactttgtttatcccagataagcttcacagattgaacctgcaaatcaatgcaaacatcacaatatggtcaggcaaaaacacaaagttgacagcagtagttgttgtcattcatccattatcactggagcaaaaaaaccaagtcacatatagcagctatgtaactgttatatggtctgcaaacttttttttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgtctgcaaacttagcacccatgtggaaacatgtggaaacaatagataagtagaaacaatcaaacaaaaccttccaaagcccataaattagaggaagtaacctgttcatatttcatgggcacagctctagaaaaaaataatcagagatcagattgaacaaatatctgctgctgctaacaggtcaacatctatctagccaaaagcaaaagggttgcaataaagttaagtggaacctgtatcataaagattatttattcttcgttaagcaaaatataaaatgcaactattgaattgcagtgtgataagacactgcgcatgttatgaataaattagactttgtacacctttgcaatcagtattattatgatcaaatcctttccaaattgctctaaaaaaattgtatctcatcagtattgctccgatagaaatatatttccaatcagcattgctcctatcaaaattaattgagatacatgccctgaaaaagtatataatcacatccaaagtttaattacaacgataatataatcatgtgtttgcagaaacctcaaaaatatggattatacataaattgagctgtaagaagcatgcatgaactaaaagtaaaaatatagttagaatatgtatgcctattgcaaactaaaatgcaatcttaaaaataaaatcatgtttaccttgaagccaatgtcacatggattgaaattcaatctttaagctcaaaatagggtggtaggctgaggcgaggagatgattgacctaaatacctacaggcgcacaactcaaataactcccaccttagtacctgataatatcactggcttatttggagcagcacacatctgttctacttcctccgtttcacaatgtaagtcattctaacattttccacattcatattaatgttaataaatctagatagatatatatgtctagattcattatcattaatatgaatgtgagaaatgctagaatgacttacattatgaaacggagggagtaacttctaaatcaccttgcggtggctgtcattaatcaacccagtaatattaccctccactttaagtgtttacttccagaggctcacatgaagtagtcacattcaaaaataaatataaacattacttaactgaacctaacaaacacgttcacatattttactgttcaccaaaagaaaatgcaattattttgcctggtgatgttacaaagagtgcagaagacaaggaaaaatctgaaactaaataagcaaatatctgctactgctactaacatgtgacatcaattcactcaaaaggaaaagattagacattaagtgggattggaaatttttactacatgtgttcgtaacgatttaaatgccaatactaaaaattaaactttgatgaaaaaactttaaaattaagttttaaaatttaaattttggcagcggctgattttgtatagaggaaacgaggggagagtgttcggatcaccttttggttttacttttattgggacttgcatgttgttctggaactgaatttggcaagggcactaattgggtcagatatatgaacctgaaacaatgcacatgtgaattttcaaggctgaaaactcttaccttggtatattttgattccatggtataataatatgtgagaatgtaccaaaattagataaagcctttatctcagcatgacacgacaatgaatcaacagcttcgcagtcctggccgggagcaactcaatgagaccctgctcctacctacccgctggcagatttactgctccacaagcttcatactgcaggccaaacaattgtccggctggaactcaacataaattcacctttgtcttagacaggagcagcgagggagacgtgatccggatgagtttgcgtagggggggcagcgaggaatcgcggtggcggcgcagtggacaccggacatcgagggatcgacggcgaccggacagcaggagatccggtgccggcgcgaggctaatgcggggatcgacgatggccggactgcgtgggatcgacggcgaggtgcgatgcaaacacaagggcgaagcggctcgacggagactagatgacgatatatcgacggcgccctgacagcggggatccggcaacggcgcgaggcggcgagggaaaggcagcggggtggtgctgggaggatccaacacttcgtataagccgttggatgaatatatctaaggataaaaaaatatatataggtgtttgatgaagtcgtactttttgtgtgacaccttgaaaacctcaaatttgtaaaaatcaagtctaatttgatatatattaacaaataggtagaaccgagtctaatttgatcaattagcataggatttaggatttagttttagatttatttttcgagcctacttaagagtttatccgacggactttaatttgaaaaatgtgagccatattgtttgatcaaatttacttttggcccaggtcttcccaagcaggcccaaacttgggctggcccatcatcggcgagttgagtcaattcgacggcccttaagctgagcggctgagcacggcccacatatgcggggacggtccgatgcacttccgcggcccattgggcgcagcgtaatcaatagcagcgacggcccaacgctaggcaaatctgagccgtccaatctaatggacggctccaatcgtccccaaatccctctctcctgattccatttctctccggcgacgagcgccgagcggcctggacctcgtcggcggtaggggcgacgccaagccgacgcttcccgtcttcagcaaaggacggtggaggggtgcaccaggacagtgcgtgcgcagggacacgactgcgaggaggtgaaggtgcggcggtgccgcttcccggaaagctccggtgagctcaggggcttcaagtccgataagtaacccgaaccctcaggggcttcaagtccgataagtaacccgaaccctcagcttaattgatttggatttgactcttatggttattacctgaaattagggttcttcgaattcagagaattttgtcgagaaatttcaatatattttattcccccttttcgagttaggagagtttcattatcgtttatcctcttttaattttaggaacttcaatcaagtttatccctttgctcaattttgttttttttttctttggctggcgtttcatcgcgcggatggggacggagggcgccgctcgtccccttggaaagattgagattaagataagattttcacggacaacggaagtaaattgaatcgatctttttttttgttttaatgtttttttcgctattttttcgttattacggacaacggaaacatttttaattttttttaagtagtagagatagagaagatagagatatatagtaccgtgtcaaatataataggattcgatttttttttttccgcgtcacatataattcttctttttttgaatccgacagatttgtttttttaattttttttttgctctttttttaccacgtccacgcggattcgtttttctctggccgatcttttttttcacctggtttttttcaccctttttttaggaatcggacatattccttttttatttctttcgccttttttttaccgtggaatgggattcgtttttcttttcccttttttcgcccgttttttgatcggacattcttttctttttttcgcccggttttttttcattcggtttttttcccgttttgttttggatctgacagatttttttcgcctggttttattgacggacgatggaagcacctcttattttttaatttatatatatatataagtagtagagatagagaagatagagatatatagtaccgtgtcaaatataatatgattcgatttttttttaccgcgtcacatataatttttttttattccgacagatttgtttttttaattttttttgctctttttttaccacgtccacgcggattcgtttttttctcgccgatcttttttgtcacctgtttttttttcgcccgttttttaggaatcggacagattccttttttatttctttcgccttttttttaccgtggaatcggattccttttttttttccctttttttttgccccttttttgatcggacgttcttttcttttttttcccccttttttgatcggacgttcttttctttttatgcccggttattttcgttcggtttttttcccgttttgttttggatcggacagattttttttcgcccggtttttttcgacagacgacagaagcaactcttattttttaagtagtagagaatagagattaatatcaatataaaaaaaactacatactacatctcatccatttggcatagacccaaactgattcgatgtaagctgcataaatcatctattcaccgatttcactcgtttgacaggtgccaaattctggtgcctggaatatgatgcagagaagtgtgctcactgctctgttttatcgtcaaggtaggtagcaagttattaaatctgtcaaatcccctttgaacattatatgaatatagtatatcaagttatcaaatgtacattacatcaaaattgttagtggagaaaaaaatacagcagggctggtctgctagcagtaacaggtaactgggtcctcttatttgtcaaaaaaaaaaaaaactcctaatattgccgtgtcacaggtatagcggttcttttccactggatctttcattagaaaatcaaacaatcctaggacaagttgattgaaaagatttatgggtaccgcacgatgcctctagtagtctagtagttaattggttagatgcgaccaacgtgcacaggtttctataactttcagcttatatggtttcatttcacatgttgtaaagaactactttcagattctttggagatatcgaaatacatttatcaataaaaatgttacttatgtgtatcctcttgaactcccatggtatgattcctcctctccacagaccactttaccattgtacacctaacatagtaagttgattagaaaatacacccatgactgtacattgatgtgatttgctaaattgttctcagcaaacctgtagcaccaaaataatttccagatgtgaatgtttgattggatcgcttgaacgttcaaactttagctattagggaaaaaaagattgctttaaaattcaaactttagctatgacaaaaaagaataaactgaaatagatggggttggcaattttttcttattagccaattaaaaccttataattgacaacatgctggagaacaagccagattaactaaaagtaaaagtagcacagtagtatcagattcagaaatgccacacaatcatgtcttggttgctcctttgatgtgaataaatcaaacgttgagaacaacaggaaaatattatggtccccttaatcaagatcaaccactcatcccccctaatcaaacgccatacaccaccaacagcaggtaaaatttggttagagaagaggaggaaacaggaggggaaccaccacacctggactcctagagacgagaaaatggacatttcgccatgttcaaaacgcggtttcgctagaatgccatctcaaaaacatgattcgataaaatgccaatatagagcgtgcgtctaccgccactttgccatttttgccattttattcattttcgaaaagattttctctcctctactaggtgatgagacaaaattgccccttatcaactcagagaacacggtgaaagatgagacagaataggcaaggagacagagagaaggggcggcgacgccgttgctgcccacaactactctaccggccggtgcgccacctctccccattcctcaacctcgccgctccccgccacaccccacgccgccaccacctgtgctcgccgccaactgaacagccaccccgccgacaactgccaccaactgtcatcgtcgtcggtcgcgccgggacctgcggcagcggcggcgaggaccgcatcagcaacctcccggacgaccagttgtgtctcgtcctacgctggctcgacacccacactgcggtcgccacgggggcgcttctcttttcttctcctcttcccctcggtttctcttcctgttccccttttctctcttccttcttagctagcgaggaggcgcagctggtgcagtggcgaggctgggtgcggcggcacggccgacgacccgaccaaggcgatggcggttggcccagcgcggcggcggcctaagggcggccaggcggcgtcgggtggatggggagagaaggccggtgcggcgaggaggtgccggggcggcaccggttagaggaggcagaggtggaggtgctgggtggtcacggaggcagaggcggcgcgcaaggaggcggtgctccacacggcgcggcggtgtcccagcgcccatgaagacggccatgggggcgctcgcgttgctcggccggcaagctcggtcttgccccatctcacaccaccgtcgacgccctcgtcagcaacggtgaccacctcgccatgctcgatctcgatcccctttcaaccgacaaggaggggcaatttagtctcatcaagccgaattccagtgaaaatggatttgaaaatgacaaaaatggagaaaatggtaaagtgactgtgatcacgcgcttcatattggcattttagcgaaacatgttttcggaatagcattccggcgaaatcgctttttgaaagtggccaaatgtccatttctccctggagacggcaaggtcatccattgtgtagatgaagtcaaagccctggatcttctatcggtcggcactgtcaccacgaggagagcgggcggggccatgggggcgtccaagcagcgcaccgccactgctgcccttgcgttcacgcgaatcaccagcacctcctacacccgatgcagcggcgcgcaccgtgggagtcgagctcaatggcggtgcttgaggtgccgaggggtggccctggttcctcctcctgatgcgacgcgcaacgtgggggtggctgcgactgcagctgtgcaccgaaaccggtcctctccaccgtcggctcggctgcctccctaagcagtccgtcgccacgtttttcctgatgtccgccatcgccggagctccatccctccgtggctgtcaacgaatgtggctggacacggtcacagagaaggggaaccgaagatgggaggccgccctgggatgggagtggtgggaggacgggatttagggggtggatggagacgggaggtgaggcggtggatcggcggcgagggtgaggtggcgtgggagggcgaggtcgggcacgacgattggggcgaacacgtgatggacgaggagcgggagtgcgggcacgatgacgttctggcgggggagatcgtcggcaacgtgtgaaacgacgagagggagagaggattagggtggcgtggaggtggaggagacgcagggcggggtggtggggttgagatctgagcgaagggcgtggggcggtgggcggaggagcgaggccatgaggggcgtgaagggatcgatgtggagcactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaatgactttctcggatttaatgcgtgaatctccattcttccacacaagattggctacatgggcatcgagaaatataaatattaatgaattgttttttttacgaggaataactaatgacatgtttaaatggatgataagtagaattacttacccttgttcattgtgccaagataaaatatgtctatcaaaagtagacggagggagtactagttatttctcgtaaacaaacgattcattaatatttacacgatgcccatgtagccaatcttgcatggaagaatggagagtcacgcattaaatccgagaaagtccttaagagtatatgtggttggattcaaatatgcctatcaaaaataatttttttaatttagaaatatgcatatcaaaagtaaacggagggagtagcatctataggaatggtaatgggtcaaggtccctgagttcttccacaatcttatcttatctaattctagatcaaatatatatatatatatagaataagtatgtaattggcctaaggaagctgcagtatttttttaaaaaaaagagagatgctttgagttgactggccacgaaccccccggcgtctcccaaccaccgcgtacgccctacttctttgtccccctactctttctcccatctgcactactctcttctactaccttgttgttgcagcttgatttttgatgtattagcagttttacatgatgacggaagagcgagatcatgttaatttctttagagaactagatcatgctattttttacatgatggaatggcgcattacaatgattaagataagatgtaccacaggcgcatggaaattcgcacaatcactgcaggtcgccagggttcgatttcagttcaatttccccaccatttggttttgcgaaaacacgatagagtacaatgtccaatgtggatgcgtctggagctttaggaaacgctcagtcttgaggttaactgattgttgaaatttgaaagagaactgatgctatttcgaagactacataataaagccatacatgcaccagtctttagtggagtattaatgtattattattcatagcacaacgacaatcttctccaaacttgttagttgttactactaacagatagcatcttaattcattattcagaactagcacattgaggagactcccggggtctacccaattcccttttttcagagctagcacatcaaaattcaaggaaggaaaagataaatctgagagcatttttacggtctttgaggaggtaccactttttctactgtaaatttggtatctcatagtacctaggtaccaaattttatactaaatttttggtacctcatgatacctcctcaaggatcataaaattgttctaaatctgaaatccgtgccccaaatctctttttttttctaagaactactccagcacatcaaaattgaaggaaaagaaaaatctgaaatccctctctttacatcagaaacctttctagcataacaatgcgaatggatgaaaacaactatgcactgtcccattagcatgccgaacactccaccaaaaagaacttgttatcaaatactccctctgtcccaaaatgttttgacgccattgacttttttaatcatgtttgaccgttcgtcttattcaaaaaatttaagtattttttaattcttttcctattatttgattcattgtaaaatatacttttatgtatacatatagttttatatattttataaaattttttgaataagacgaacggtcaaacatatttaaaaaagtcaacggcgttaaatatttagggacggagggagtcctagttcctttcagttcagcagtatagagcactagtacgcttgtgagtaactataatcaatttgggggttccatcctccaaaccgttaccctccaagtattatcttttgattcaggagtccagcagattcaggttccactgctctgtttctgtgatgatcaatcagattttgcacctccctttgcgtatttttccttcatcttgatgtccagtgctgtttcgggaccgttctcgcatgttttctaaagcaagaaaatttggtttacaagaacatgaaaaatatttgccatgtgcatacgtataattattgggagaataatgaaaaagggtactacaatcctaaaacagaggccaactgtgagaggaatgtttatgcatataaagccatcattctttcatatataaggaattttttagatgtgtactgccataaataatttctaacgtatatatttttgtgacaacatgctaagattagctatcttgcgacatttgtttcttcaaattaacattgaattgttgttgttatcttaattttcagtaaaattaagataagctgtagattgtacacatgacttcctcagaaaagtattccatgcattttattggctttgcacattataaagtacagactaataataaatacagtgctttgaataatgcaccatcttcacgaattttcaggcacaaatataaccacatcttctgtgtcactgatatgggagattggtatgataaactttcacaatcttttagggatactgcaaaggaagtattggcaaagacagatattgatccaaatgttaggtgcttcccaaaaagacagatgaagcgcatcaccaacaactacagcactaccctgggaagaggagggttttctgtggtgtacaagggtaggctcgacgatggtcgttcagtggcagtgaaacaatataattggagaacacagaaggagttcacaaaagaggtgatcatacagtctcagtgtagccataagaacattgttaggctattgggctgttgtgtagaggccgctgctccgatattggtcaccgagtttgtccccaacggaaacctttctgaccttctacacggcaacagtggactgcttcctgtcacattagagacacgcttacagattgcgctggatgtagcagaagcacttgtatatatgcattgctcccaaagttatccaatccttcatggagatgtcaaaccgtcaaacattcttctgggtgacaagggtgtagcgaaactgtgtgactttggaatatcaaggctgctctctatggatagtgatgaatacacaggatttgttatcggaagtaaaggttatgtggatcctgttttctgccagactgggcgattaagccaaaaatgcgatgtctacagcttttgggtggttcttttagaactcttcaccagaaagaaaggaattgatgacatgaaagtgtgtcttgcagaaatttttgcttgttccagtagaaaaggtgatgaacataaactatttgacatggacattgtaaccaatgagaatatggagtttcttcaaggaattggcagggtcgcactcgaatgtataaagtttgaagtagaggagcggccagaaatgaggctagttttagagcagcttttgagtctcaaaagatcccgagataagagcattcatgagatgcaggttgtacgtaaa

SEQ ID NO: 61988 - DNA, 21005 bp, Oryza sativa
acagtagctcatcagattagtagatggtacacacatggcacagttgtatatcacaagctgacatcgtcatacagatcttacaatctattaataatacaagggtagcccaaatgggatccgaatagaccaagcatggtcgacaacaacacaaaataccaacacaaataaatgaggtagcggaagcgaagcagcggcggtccattttatcccacacgcatcgactggtgaacctaggtccctattccgccgtcctcggtactccttgccagcatagcacatgtacagatcgacaccaacaccttttctaaaagatttaaataagcaagagtgagtaccaaccgtactcagcaagccaccactacagaatgcatataatgttcataggggttcaaggatggcttggtttacttgcataaagctagttttcacaaattatttcacaaacctatgacatagcagttttaactgaaaaccacgttaaattgaagttgtcattaacctgcgagggctcatcccccttccccaagcctcgcttggtccgatttaccctcgcattcaatttccacagttttaaccactacgacctttccgcacatcgggcaaggtcataccttccacacccatcatattttaagcaatattacaaattgacgaggctagtcaagagtaatacaagtcccggcgctcattaaccgcgagcacggctattcgaatagtttaatttactcacactgcagtggatgtacgcttttaatcccacactccgtgacgcacccaacacatgagacttgtcacggcccggtttttcagttaccctcgcatggcggcacccgctccaaggactatgactccccattgcacccccggcgccacattcctacctcgagccggttgtgaggggagtcctagcgctcctgagattgaaggttacattatacatatataaagctttgacgtcattaaccacacactttcacatttccataccgatatccagaacctaccatgtctggggtgctaccccacgagaataacctagtctaccgggtctaaccccactcaagaagtgtggtcgtactcggttcgtttcttgcttagcttcttgactcggtccttaactgaccagggtcggcggcttaccgttcccagaaccacccatattctattcgtgccgcccaatcgaaatcatttttgtttaattaagtttttgagttttcgcaaaggttttcatgctgtgggtggcgcttatgtctccacccgatctctaacaatcactcccatcgagtgatcagtataaccacatccacatatcacacatatggagtgtataacgtctatgtaagcagggctaagcagtgaataaataatcacacgtaaagtaatacactcaggtaacaacggtgtgtaaatacataaggataaacaatatcaaaggtaaggcttaaacaaatgtaggtacacattttataattagtatgcaattttatttgtaatcaacacatttataaaaataggatcaacatattcgaggaagagggcgtagtgacttgccttgctcaattgggggttcgttctcaattagctcagtttcctcctcgcagatgtaccctgtccggttgaataataacgtcacaaactactcgctaacacaaaaagagccaaaaattccagaaaaaatcgaaaaataaccaaaccagtgccattgcgtagatcttgattttagaaagattttgacgaaagtttcgttcaaatccgacttaaaacaagggagatacggaattcgaaagattgaaaaagttttaaatcgaagaaaaggaaaaaggtctgacgggtgggaccgcccttaactcctcacgtgcaggttttgtttttaaatgggtgtgggacccgtgagtcagcctctctctcctacttcttctttcttgcgcttccttctctcgttctctctctcctgccatgtgcctgtgtttgctcgggctagcgcttggctgcgccggcggcgagctccatcgaagctactgcggccggggcaggggggttgtggggggggggtcgggcctgccctgggagatggcgcagggttgggggaggccggcgatggcaagggagctcgggtgaggcgacggcaatggcgtggcacaaggaactcggccggagcctacggcgacggcatttggctgcgaaaatggaatcctcaggtgtttgtggtttccctagggtgtgcacatggtgaggcgaagggtttgggcgagctgcaagcatgcatgcatatgcatacacacggctagctagctgcatgcatgtgagctgcttgcatgcatccatgcacacgtacagccaactgcttgcatgcatgcacacgtacagccagctagctgcatggcgcatgcatggccggcggcgcagcggcgattgctgcggagggcggccgcgcaaggaacgggtacagtgtagcgcctcacaacgtcaccgcgccgcggcaacaacggtagacgagaaatgcggcagccgggtagcggcacaccgagcggtggtcctcacacaaaactacggtcgtcgatgtacagcctggggacggtcgacccgcggatcgccctcacacaccacgtgttcgattggtggtaacaaacgaacacacaacgttaaggactaaatgttagcgggttagtgcaagttagggttaggggttagcgagttagaggtcagtgagtcagtaagttagagtgtcagcgggttagtgagtcaatgggtcgaatgttagatgttagaggttagccgttcaataagttagtcgttctcggggttcagatgacggcggggcggcctatccgtcctcttgctcaactgaggcctagccggagccggccgcggtggagcaagcggagagacggcagcgtgtgcgcgggagggagtggctgaggggaagcaaaacgaggaggaggtgaagagagaatggagagggaccggttgcgtgctcacccgtgacgacgcttaaatagagtctggggaagggacgtttgctgctgcccgcattcattccatcccaaaaaatgcgcatgtgtaggtgggagcggtgacggctgcgtattggcggcggaaatgtcgtccaccttgtcggggcacgtggcggcgatgaagtggtagtgcggccgtggcggccgtcaaaacacggcgctgtcgaacgtggtcgctgagcgaccgtcgccacctactcgacccgaggaggagcggcttgatttcgagttcgcacagtgttggctcgaacggggtttgccggtgttaacgaccaaatttggtaaatcaagtattggattcgaagatggaatcgaagcggatttggaggaagctggcggttaccaaaacagagcaagaatcggttggtgaccgagtcggctatcgtgtccatcggctgagacaaagtcagacaaggttagccgatgtagccaattctgacgagaagataacagagtctttgtcgggttcggttgatgtaaatatagagaagggtttttcgaaaatagttggcatatgcaaagattaggatatctcataatcatagttctttgaataaataatatttgaaatcaaataccgacatattctcagacgttcgtctattagcccacgcataaaaggaaaacgacagatcgaaataaattaatcccggcatgaatgtattttgaaaaagatttttgattattccaaatttttaatttcgtatttcaaagttgaaattttcagggtgttatagtagccgagccgcgaggcgcgtatgggacaccaaggaggagtcatagacgcacgggagggcgtcgtggaccaaggtgcacgaggacgcgctagagatgaagacggtgacacaatcatggcaatcgttgagaaagatgacgccgaagatccgatatagtcgaaccgtaaaggacgagacgtcataccgggtttgccagaccctcggacaactcaagacgaacgcgcgtaacggtgttgccaatatcacgtggatgaggtaggagaccaccgtgaatcatacaccaatgtcggagaagactagcagagaagacctccgtgacagtcgcggcgtgagaacagtgtagagagagaattgtcgtagcagcactcagttgccggagaagagcgaagtgtaatcgaggaagatacggcgatgctggtgatgagacatgctggacgaagacaaaggcgaagtaacgggaccaacagcctggacagcaacgtcggtggccatgtagaggtagctggaccaccggcctagagcggtgatagtggcagcttggagatgcggtgacgatgctcgaagtagacgaagaagacccgagtggctgacgatgaccagtgcagacgacgagggcatcgaaacgcgaacggcgatgaagacgacgagagggacgaggctgtggtccgaaggaacaacacagctgcatctcttatgtcgatgcagcggcgtgaactcatcggcggtgaggccatgctgaggagaacgcctctcagcattgcaacaactagtggaggtggaccatggacggcggcactgcggcccaaggggacgatgcagtagcaacccgaagcttgatggcatagccatgtgctccatgacgattggttgcagaagtcgttgtagccgggcggttgaacgggtgattaagccgaagatgcacgaggcggaacgatgaagtcaatgccaatgtcgtagacgcgtagatgttgacgaggtggtgggcgacgcaaacccattctctgaacgggaaaaagaaaaattggcggcagtagcaatatatgtcgccaaaaccaatctgaacctcgagctcacggcgttgatgttcctggtagcatggaggagctcacatgcagcatgttgactcaagccatgcatgcatatgtgccgccgcagacgtcgagcatgcatgctcgttgcgtgcatacacaggtgcagaacagctagagccatgagtagacggtagacgatgagattgctgttggtgctgcttgacgcgaatgacaaaagatgccgcccaaggaggtcgagaccgattcccacacggcaactaaacacgaggctgcgtcgaggagatcaagattgatccttcgacgacaaaccatgacgacgacatgacgccaagagatcaatctctccagggcagacgaacaatgacaatgagagaaaaatcgatgaccaagaaaaaagacgctggccgcccccgggagatcgctactcccggggtagcggcggcggaagcttttgagcggagctagatcgtctgctctgataccatattgaatagtgcagggagagagatactacgaattttaaacatgttgtattgagcctcggggaccaatatatataggagtatatgaggaggaggtaagaaaggattgcagatatgaaagaagtccacataattcaatcatatcctaatataactttaactaccatatactctaacacggtcatggggggagagagagagagctcgagaggctcggcttgtgtggagaaaaggggagggctcgtcggctatttataggcggtgagaagcggtggatcaagtcggttgcggaggaggagagcaaggggtacacgacgacggtggcgtggaggagatggggtcagcaccggcttcgttctcccattggatgacaatagcggcgcgcgtacgtggcggctgcagtatggttgggcggcggaggaggaggagcacagcacagcgacggcagctcggtgaaaccgcggcagtggcggcgcccatggcatgtggtggcggtgacgcgctcgcatgcgccatgcgcgcccacagaggagtggagagggtggcggctcggctgggctggctaggccgacttgggcggttagagagggagatgggctgaggggagaagaaaaaggatttcggcccaaagtgaatagaaactgtttttgaattttggaggagatttggatggctaggttttggagaggatttgaatttggagagatttatgtatggagatgaatttcaaaagatcttctaatttatttgactgcaatatttttggaggtggaatataatggaatttatttgatgcactcaaaatgggagagagggatatatattagcatgaatagtatgattcctaaaattgaatatattattgggaatgtgggaggaaaataaataggattttagccccaaaatatatggcatggattttagagaattatttgaggataataggaaatttggattttggatgagaaggataaaatctattttcttagcacaagagcaattattctaagaatattattcttgtgccaaggttggagtaaagccatagaaattaaattggagactagatagaaatttgaccattggaatagatatagaaggatttataaaatatttggatagaggagaattagagataggtctagatcaaaggttttggtcaaggattaattccaatgaaattggaattatggtggtttaggttcaagggcaatattggaggttttcttggaccataatttataaaaggttttcaaataatttgaataaaagatttttagtcgaaagaaagtttaatattcaaaaatagaattcaatcaagaaatacctcaatttaacaaaatatatttttaaatgaaaaccacaaaagaaattaaataccaaagagggattttatgcaagttagttttaggaagttacctctaattgtatttcctaggttttggaggttattaaaaacataagaatcggcatgacgcaggattagaaaatagttaattttcagatgttacacacgcgcacacgtctctcctactaaattacattacatgtgttgtctctcctactaaattacattacatgtgttttatatgtatgttcattagattatacttaatcaacttacatacataattttcggacttacattgtaaatacatatgtaatttacggacttacactgtattaaatacatgttgactattttttcacgaaaaatatgacggcatatatatgggtggtctctgttttgtttacgggtagtacatatatatgtacattcttctcgatccatatgcattgaatccatttatcagagattagaatgaaggattttaatagatttaatctaatggtcaaaaataacggatccaccaattaagtgaaaatttgttttgcttttttttctcaaaacttgtaggagattttaatagatttaatataatggtccaaaataaagggttcaccaatttaagtgaaaatcaatggttatatgtttgctttttttcttaaaatttgtagaatttgttttaatttattagaatgtcatgtgatggtttgatagcatttgtataaagtttgacggaattttagtatatataatagatatagatagatgtaataatagcccgtgcaaacatgtggtttggcactagtagtattaattcacgtttattgcatatagttccatgcatatagtttctttttcacaagtactcatatatacatgacagcactttctcctgatgtgcacgaatctcggcgcatatcgatccaatggccatgcacataagagtacatgaccttaaggactgattttacttttccaactctatttcactactagaaaacttattttcgacgtcgtaagggttaaattttcgcaggcgggtgtagacccccgtttttataacaggaatcaatcgtgtaaacggtaccatttccctggatcaagtagtttggtacacacgaattcatagctggaatatatagtgcacatacacgagtgtttaatacgaattattacatcataggcccgcccgcaggcatagtcttaaatcatcggaccgagaggtccggaatacatccaaaaacagaaatagataaggcagcggaattcaggcagcggcatgccattgccacaggcaacgactgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccctcccacacaagttaagaatttagagtctagccaagtgtaacacatgtcccggtgctcaatcaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatacactctaggcgtacacggtttctagcagtgagaggagttctggcgcacccgggaaggaaagactcacacatgcattaagttataattatgtttaaattctcacatggtagtcctactgatggcgacaccactgtagacacccgcctcgcggttctaccaatggctgccccaccgtagagcccctaccttacacatcaagaaaccactatgcatggatactgcctccgctcagctatctattccgctaggtctatacccatacgagaaatgcggttgtacgggggtcgtttcatgcttaacttcatggctcggtccttaattgaccagggacggcactagccttttccggacaccacccaagtcctccagccgccccagtcgaaaacagttgttttactttatttttctttcacaaatcatgtcatcaacatcatggcaatgtggcgctcatgtctccacatgccgcatctcaattaccttctcaaaggtaattgccccaagcatatagcatttgataaatatgagtatgcatgattcaagaatagcatttctaagcaattgtcatagttgactagggactcatacgtaaatatggttacaaagatttaaggattaacaataatcaaggcatggcataatcacaaataggatgttcatcattgcatgcaattttatttgtaaacaaaacaatttcgcaattaggatcaacatgttcaaggaatagtgatgacttgccttgctcgaggtcttgcgggtcttggccttcacctggatccgcggcttcctcgatctctatagttacgtgcgaaaattgatctgaattcggttagaattcaaataaaaatccaagtaaatccaaatggaagtcgaacgcgaaagtcgattcctttttattaattttactatccgcgaactatggcaaaccccaattttggtttaaattattttgcggttacaatattttgttgtcgtatgtttttaatttaatctaccctagcattatatccatatatattaggttagaaatttcttatcgcgagctaaatgtcggacggaatcctaaaattatcttataatattatacgacttaatttagtctatgattaaatataatacacggctaacaccctagtaattaaatccgaatcgctaccgttgatcgattatttatagagattacccagaaataatccacaataatttatgagaattcatacatttgtttaattattaattacatctaaattaataccgcgaattgatttcttatggagggtactaaaagttatctataatctataggaatttatccaattatattttccttaatcctacatttaaatgctagtattttaggtatttaattagtaagagtttatctaaccatattttcattaatcctacaattaaattctaatatttgtaaatattttaaatttccccctaaatttttcctttttctttttctctttttctctcttttccttttcttttctttctcttctttttctctcttcctctctttctttttcttttgtccttctctctccctcccggtttctctcgtccttccttctcttttccctccctcggttctccctctctctctcggctctccctcctacccgagcggcgcggcgacaaaagaaagaggggggggggggggaacagcggctcaccgacggcggcggcggcgacgacggtggcggcgacgacggcgcacggcggcacgagaacggcggcgcgggggcacgggaacggtggcgcggcggcacaggaacggcggcgcggcggcactacggcggcggcgcggcgaaaagggaggagatggaggggaatgggtgtgggggagaagagatgggttgggggttttatagggtgtgagagggggagaaagagggggcggtgaggggatgcgatggcggcgctgcagcgcgcggagcgcgaggcggcgggcacgcggcgcgaggcgacgagacggcgcgcggcgccgcagcggcgacgggacgcgtgcgacgacggggcgcggcgatgggacagcggcgcggcgcggtagcagcggtggtacgggctcgggcgggacgcgacgggtggcgacgcgacgggtggcgacgagcgggcgagcggcgacggtgactacgcgacagcggcgacgcgacgggcgggcagcggcggcgcgcggcgcgaggtgcgggtgcgggcgcggcagtggtgcgcggcgtgaggcggcgatgggacgcgcgcggcgacgggacgcgcgcggcgatgggacggcgcggcgcgacggcgatggcgacggcggtgtagggctcgtggcggcgacggcaacggcacgggcgacggcgacggcgacggctcggcagtggcgacgtgacggtgcgcggcgcgatgggacagcgacgcggtggcgacgggcgacgcgacggcgacggctcacagcagcggcgcggggcgcgaggcggcaggctcgcgtcgcggcgatggaacgggcgagcggcgcgcgggcgcgaggcgcgaggcgacgcgacgtcggtgcggcgcggcagcggcgatggtgacggcggtgcgacggcacggggctcggggcggccgggcgcgcggcgcgcggggcagaggagggggctgggctaggggagaggtgggagagaaggggaaaatgctagggaccacatcgaacaccttgcgggcaatcaatagtgcactttcctaatattcccgattttaggttattttcaaaataaatttgatttcataatttctaaatcttgtttaaatgaagtacatcccacatttgtgttatcctaactaaaatcctccttaatttaatatcactcatattctgtttatataatttattttaattagggttattccatcgtactaaaatttaattattgctaatatggttgcgatatttatttccaaacccacctaacctttattttaatttatattttaattatttatttagtcaactagatttattttatggtttgttcctagctagttattcattattcgcgattaatagactccgacatcaaaatccaatgaaacaggcgaataaagtcggcatgatgcaattggtttaaaaagtttttgaaagtccgcatttttagagttttgatttcgttggtcgaattttcagggtgttacaaacctaccccccttaaataaatctcgtcccgagattttcttaccagttgccgaatagatgcgggtactccgtcctcaagaattcttcgccttcccaggtggcttcgtcctcagtgtgattactccattgtaccttgtacatacgccacactttgctcctagtcctctaatctgcttcatccaatatccggatcgggtgttctggatatgtgagatcattgctaatgtgaatctcttccagcggagcttgttcttccggcactcgtaagcatttctttaattgggacacatggaagactgggtgcacatcggcgatatattctggtagctgtaactgatatgcgacttctcctcgcctggcaatgatctggaatggccccacatatcttggtgccagttttcctttaaccttaaacctttttgttcctctcatcggagaaacctttagataaacgtaatctccttccttaaattccaggtttcttcttcgagtgtcggcgtaactcttttgtcgtgattgtgctacttttagacgatcacggatcaagcgaaccttttcttctgcttcttgaataatgtcaggcccaaataccgcccgttctccagtctcggaccacattagcggggttcgacatcatcgaccaaacaatgcctcgttgggtgatatctttaggcttgcttgaaagctgttgttgtaggagaattcggcgtagggcaaacatctctcccagtccttgctaaaatccagagcacaagccctcagcatgtcctccaggacctggttggttctctccgtctggccatctgtctgtggatgataagcggtgctaaatgcgaggtaacttcccagggcttcatggactttctcccagaaatgtgaggtaaattgtgtgcctcgatcagatataatcttcttaggtataccatgaagacacactatcctggtcatgtacaactcggcgagttttgcactgctatagtttgtcttgacggggatgaatcttgccgtcttgttgagtcgatccacgatcacccaaatggaatcatatcctgttgcggttttgggcaatccaacaataaaatccatgcctatctcatcccatttccattcgggaatcctgagaggttgcaacaaacctgccggcctctggtgttcagccttcaccttttggcatacgtcgcaaagtgctacgtattcggccacatctctcttcatgttgggccaccagtagccctccttcaaatcctggtacattttggtacttccggggtgtaatgagtatgccgactcgtgagcttcctttaaaattaatcccctcagtccaccctgttcgggtacgtaaattctctttttataccatagaacgtcttttccgtcggttgaaaattcttttgcacgtcctgcagctaagcgttccttcacctctcggacctcctcgttgtccttctgggcttcttctatttgggttctcaaaagaggttgaatgtccagggtgtttatccgtccatgaggcactatatgtaggttcagctgagctatttcctccctaagctcagggaccatcccttccattctcagatgattgtaatggctcttacgactcagagcgtcggccacaacgtttgctttgcctgggtgatagtgaacctctaaatcatagtccttgattaattctaaccatcgtctttgcctcaagttgagatctgactgggtgaagatatactttagactcttgtggtcagtgtagatatcgcaatggtttccaattaggtaatgtctccaaatctttagcgcatgaaccacagctgcgagttctaggtcatgggtagggtagttttcctcatgtggtcgtaattgtcgcgacgcataggccacaacttttccgtcctgcatcagtactcctcctagtccttgccttgacgcatcacaatatataacaaagtctttcctgatgtcgggaagaactaaaataggtgccgaggtcagcttttctttaagctgttcaaagctttcctgacattgttctgaccatacaaacttcttttccttcttgagtagttgtgtcatcggtcgggctatcttagagaacccttcaatgaaccttcggtagtatccagccaagcctagaaaactccgaatttcagtcacagatttgggtgctttccattccgtgacagcctccactttagcagggtccactgctactccaccggctgagattacgtgacccagaaaagcgacttccttcaaccaaaattcgcacttgctgaattttttgtataacttgtgctttcggagtttctggagaaccaatcttaagtgttccgcatgttcttcttcatctttggagtagatcagaatgtcatcgatgaataccaccacaaacttatccaagtaatccatgaatactttgttcataagattcatgaagtatgccggggcattggttagaccaaacgacattactgtgaattcatacaacccatagcgtgttgaaaacgcggttttggggatatcctcggtcctaatcttcagttggtggtatcctgatcgaaggtctatcgttgaaaacaccttagctcccttaagttggtcgaagaggtcatcaatccgtggtagtggatacttgtttttgatagttacttcgttcagtgatcggtagtctacacatattctcatgctaccgtctttctttttaacaaacaacactggggctccccaaggtgacgaactggggcgtacaaatcccttctcttgcaactccctgatttgctttttaagttcttctaactcattgaccggcatccgatatggtctcttggatatgggggtagttccgggtatcaggtcgataatgaactctatgtcacgatctggtggcatcccaggtaaatcttctgggaacacatcaggaaatcgctgcactacgggcattccctttaggggtagcatggtaaatatacctccggcacgttcggttagcctaggatcttgatccatggttgctcgcatatccgatccccagggtgtggtcagggtaacttctctacgtctacagtcaattactcctgtatgctttgctaaccaatccatacccaaaatgacatcaagagtttggggtattagcaccataagattggagggaaataccacatccctaaggagaattggtacgtctatgcaagcatgactcacagttatctcgcccccaggtgagtgtactatcataggctttctaagtcccacgagggtcaagttgtgcttttgactagccttcagagatataaatgaatgcgatgcaccagaatcgaagagaactttaaccggggtggaattgatagagaacatacccattagtacgccctgatcttcctgggcctcttcagctcggacatggttcacttgtccgcgcccaaatccagtggtggtcctgttcgattgcggagtcttgaataggcctcgcccgacagtaggggtagtagtgccgcgaacagtcattgcattcgcgccagttcggacaggggttttgcgtggatgagggcagttgttagcgtagtgcccgtattccccacagttgaagcagtccacattcttcttggctccaggggcagccaaagttggtgtaggggtgcggttctgaagtgcaactggcctgttgaagttgctaggtgcagcgggacggttggtcaccacgacagggggcttccatccggacggagtggctcccttgagtcgctgaggcactgtctgaggtgggcgactcatagcaagcctcctcttgcggttgtgttccaccgtcctttgatcgttctctagcctgacgaccttgttgatcaggctctggaaactctcgtgatcctgcccgatcataggtccacgcaattcatcattcagcccttctatgaacttgtcgatcttttcttcttcatctgccaggtctccaattgcgtagcgggccaactgagtgaacttgttcagatactcctgcactgttgtattcccttgccgcagtcttctaaactcgttcttcttcatgcgcatcactgcagcaggtacgaagttctcgcgaaatgctgcagtgaactcctcccaggtgggttctccagcaccgtcttctcgggcttccttgtaggtatcccaccagtctccggctggtccttccaattggtttgccgcaaagatcactttatcggcctcacgtactcgaacaagagttagctttttctcaatgaccctcaaacaatcttcagcatccataggttcttcagctgtggcgaatgtgggtggcttggtcctcatgaactctccaaagcttgaccctccgcggttgccttagttgttcgcgatagcttgcagaagttgagtttgggtggccataactccggccagagtggttaggtcaggtgtctgagtttcgtcgttgctggttgttgcccgacgacggcttgccatctgtgtagggtgatggggtaagtatcctaattttctaactagctcctatggctttatcctattaagggagttgtgttgatatgaactttgttttgcaagcatggtggaataaactcatttataacacaacaacaatggataccataaataacatcacagagtttcacaaatgatacatgaatcatgatgcaatcgactgcatacatacgcagtccaaataaagttcatccagaagatacaacgaactaatcatcaaactactcgacaatctaggtaagggagggggtgtctcgcatactatccaaaaaccatctgatacgagagcgaagctgcaaggagtccgtcagtctagtcctccagccatccgcaagatcctggggcaggtagagggtggtcgctggcacgcgcaaacctgagtccccacggctcagaagtagtggcctctggatctggcttgggcctcttgcccggaggtcgtgtgctcttgcgagcagtgctgagggtgcgagggcctccaaggaaggtgatgcggggaacaggagcctcatcctctgaaggatcagtgatgtctggctcgatctccggctcggtgtcggtctcctctgtctccgagtcgatctggatcggagtctccaaaccggaacccagctgcggggaaggtgtagggaccagtggagtgtgcaccaactccggaacaggtggctgtgctgctgtagggtccactaggtagggtgctgactcggtagctagcatactagcctctcccaggagagcgtggaacgctggtgggtacggcggggtgaggaagaagtagcggtcacggcctgctgctgtggaagtagaagcccctgtagtgctgatcttggctgctcgaagctgctcctccaactggctgacgtgctcctgactctctctcagctgctcctcaagagtatccatcatcccgcggcgatcgttgtactggtcagacaactgctggtactggtcgccgtggacctggagctgtgccttcagtgagtctatctcactgccccaagcctggtgctcctcctccaactgaagctgctgcgctgtgaggtcggtcacctcagtctctaactctcccatacgtctctggtggtcgtcaatctccaacagagcctcctcgtagtagtcatctactgcctcagcccatcgtgacaaccgagtcactatcgggttgtagcagcagggcgtgttctgaactgtgcaaactgagttgccctcctcccggaacgggtggtgagcaaactcggtactcactaactcggctcggtggatagagctgagtcggaggaaggcctcccgggcggcatcctgcatcgcggtctctggcaggtctcggtggtgacgtgtctgaaagctgtagtccaactcggaagggactcgggggtgaatctcgacccgagcctcccaaactgggccacactgcctcactcggtatgacggaaaaccagggtatcgcagacgcctcaacatctggtgcagcacaatgacatacccctccgattggggtaagctcaactcccaggtagcgggtgaatccgaatctgccatctaattttaagaaaaacccaaagtcagttgagagtaaaacttgttttgtaaagaaaatagttaagagtaagatgaaaattgtgccgagttttgtaaacatagcgtttttatttttgaaagtattactagatgggaatttctcccttggccaacttagaaaaagggtggggcgccttttggtcttttcctacagtcgtatggctctgataccagctctgtagacccccgtttttataacaggaatcaatcgtgtaaacggtaccatttccctggatcaagtagtttggtacacacgaattcatagctggaatatcaagtgcacatacacgagtgtttaatatgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccctcccacacaagttaagaatttagagtctagccaagtgtaacacatgtcccggtgctcaatcaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatacactctaggcgtacacggtttctagcagtgagaggagttctggtacacccgggaaggaaagactcacacatgcattaagttataattatgtttaaattctcacatggtagtcctactgatggcgacaccactgtagacacctgcctcgcggttctaccaatggctgccccaccgtagagcccctaccttacacatcaagaaaccactatgcatggatactgcctccgctcagctatctattccgctaggtctatacccatacgagaaatgcggttgtacgggggtcgtttcatgcttaacttcatggctcggtccttaattgaccagggacggcactagccttttccggacaccacccaagtcctccagccgccccagtcgaaaacagttgttttactttatttttctttcacaaatcatgtcatcaacatcatggcaatgtggcgctcatgtctccacatgccgcatctcaattaccttctcaaaggtaattgccccaagcatatagcatttgataaatatgagtatgcatgattcaagaatagcatttctaagcaattgtcatagttgactagggactcatacgtaaacatggttacaaagatttaaggattaacaataatcaaggcatggcataatcacaaataggatgttcatcattgcatgcaattttatttgtaaacaaaacaatttcgcaattaggatcaacatgttcaaggaatagtgatgacttgccttactcgaggtcttgcgggtcttggccttcacctggatccgcggctccctcgatctctatagttacgtgcgaaaattgatctgaattcggttagaattcaaataaaaatccaagtaaatccaaatggaagtcgaacgcgaaagtcgattcctttttattaattttactatccgcgaactatggcaaaccccaattttggtttaaattattttgcggttacaatattttgttgtcgtatgtttttaatttaatctaccctagcattatatccatatatattaggttagaaatttcttatcgcgagctaaatgtcggacggaatcctaaaattatcttataatattatacgacttaatttagtctatgattaaatataatacacggctaacaccctagtaattaaatccgaatcgctaccgttgatcgattatttatagagattacccagaaataatccacaataatttatgagaattcatacatttgtttaattattaattacatctaaattaataccgcgaattgatttcttatggagggtactaaaagttatctataatatatatgaatttatccaattatattttccttaatcctacatttaaatgctagtattttaggtatttaattagtaagagtttatctaaccatattttcattaatcctacaattaaattctaatatttgtaaatattttaaatttccccctaaatttttcctttttctttttctctttttctctcttttccttttcttttctttctcttctttttctctcttcctctctttctttttcttttgtccttctctctccctcccggtttctctcgtccttccttctcttttccctccctcggttctccctctctctctcggctctccctcctacccgagcggcgcggcgacaaaagaaagaggggggggggggggaacagcggctcaccgacggcggcggcggcgacgacggtggcggcgacgacggcgcacggcggcacgagaacggcggcgcgggggcacgggaacggtggcgcggcggcacaggaacggcggcgcggcggcactacggcggcggcgcggcgaaaagggaggagatggaggggaatgggtgtgggggagaagagatgggttgggggttttatagggtgtgagagggggagaaagagggggcggtgaggggatgcgatggcggcgctgcagcgcgcggggcgcgaggcggcgggcacgcggcgcgaggcgacgagacggcgcgcggcgccgcagcggcgacgggacgcgtgcgaccacggggcgcggcgatgggacagcggcgcggcgcggtaccagcggtggtacgggctcgggcgggacgcgacg

SEQ ID NO: 61989 - DNA, 30835 bp, Oryza sativa
tcaccgctgttgccatcagcgccttgagccccgcccgcgccgcgcactgtcgccgttgcgccgcgttgtcccgccgccgcacgtcgccgtcgccccgagccccacgccgccgcgccgtcccgtcgtcgtttaaagccggccacccctccccgcgcctatataagcccctccccggctacccattgctccccacactacccccaccacctcccctcccttttccctctctttcccatccccggcggacgcctcgttggaagcagccgccgccgccgctgagccgacgcgccccgccgccgcgatgtacctcgtcgccgcgccgtgctccgccgtcgacctcgccgccgcgtctccgtcgaccccgccgccgaaccggtgagcctccccctcccccactgcttgccgtcgcgccgtgccgcccgccggttctagccgaggccgagagagagaggagaaagcagagagaagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtgccttttttacaatttctcggatttattcaaatttgaatctttacactagcataacttattcattttagttccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacagtagagtagatgtaataatatttgtctctaacatgtcttccactgtaacaaccacacaaactaattttatgtgatgtctcaaatgaatggatgtataggaaaatactagtacttatttaatattcgatggccatataattaaatccatggcttataggttatttaaatcaagtgtagccttatgattatgtaactaaaatataaacacacatagatgaatctttaacctgtttaggagaataataatagagctagatgtggaggaatcactaagtaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatatacagtaggcgaccaaaaccttatacgttgttgcacacatatattgtacatcccattatagttatacaattaatttatctttttcatatattaaactagggagtatataacaaacatgaatagtagataagtactaattataaatcttgacctcatatgttcatagtttaattgtaactccggattgttcattaagagataatctgtaactataatattataaacttcccgaatttaacatatagagcatggacaattattagccctcttataatttataatggcaagtaaaatatgttcataattaaagtaaagcttccatcaataaaataataatacaaataattcgctgtaattgtttgattgatcctaaatccatctaacaacagaacctctagtatataaccgtcctatttagatagatgcatacatagccataatccttccatagccatttgatagactaaaccaccgattagccaaatatatatgtatcccataaatgctatgtttgttaactcctaaataggccacgatgacaatagaaagattaagaaactttagccttagcatgattgggatccattagcaaacacgaatagtacaatttgttgcgcatatttgattgttgtttgaatattggtttttctcgcgtattatagaccatgtgtatcggctagtcgtgaggcaacgtctgcaacttccaggaggtgaaggttgatcaagattatatcaataataaggattatcctaagcaaggcaagtcatcactattccttgaacatgttaatcccaattgcgaaattattttgtttataaataaaattgcatgcaatgatgaacatcctacttgtgattatgccatgccttgattattgtttgcccttattccttcgtaaccaggtttacgtatgagtccctagtcaattatgacaaatgcttagaaatgctattctagaatcatgcatactcatatttatcaaatgctatacgcttgggcaattacctttgggaaggtaattgagatgcggcatgtggagacatgagcgccacattgccatgatgttgatgacatgatttgtgaaaggagaaataaaattaaacaatttttttcgactggggcggacggaggatttgggtggtatctggaaaaggctagtaccatccccggtcaattaaggaccgagccatgaagttaagcatgaaacgacccccgtacaaccgcacttctcgtatgggtatagacctagcggagtagatagctgagcggaggcagtatccatgcgtagtggtcttcttttaggtgtgtgatacggcaagcagtctgctggcggatgcccggttcggatggcctggtggatggcggatgcccattccggatggtcagaggctggcttggcaatactacaagaggatacccataagagaacaatcatgatggactgggttcaacgacaagaaacaacgtaggaatgtgtgtgtttttcccttcccgggagcgccagaactcctctcactgctagaaacgtatgacgcctagagtgcatgagggctaaagttcatggagcgggtactgccaatgcgaggttatcgaaaagctttgccgtgacgtgtctcatgtgttgggacgaggcttatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacttcctgagaggagggaaggtggacgtcctcagaaaaccatgacgactcaatggcgggaagctatccttgggattacaatggatggtggatagaaccgtcgttgtttaatgtgaacactggtattaaaacttgatcagtctatgctaggtcttaggcttgtgaaaagatttgcaaaacttgttttgcgcaaaggaacctgaagccattccttgaaataccctctatcatatgcatcgttgctgtggtggcttgctgagtacggttggtactcacccttgctattcatatatcttttaggagagtgttgaagagaagcccttgtcggtatgcttgcgtatccaacaagatgatcggaatgcggtgttgttctaggtctcgttccccagtcgactgcctgtggcatgttaaccgggcccttatattattttgtcttccgctgttgttctctgatagttgttggcctacctagccctaatgtaagtatttaactcttttagcatgaattcattcgtgatatgctgtgatccaactatgtatgtgtataccaactactgatccagggattggtacggataaacacagaagatttccgatttccaaaatcgggggtctacacattctcatctaattcatagagggttcatgaagcattacagttgttggagcaagcatgaagaacaagagccacatgatgttgtagctgatgaagtagatgtagggaataggctagatcgagatgacatgtttgtccattcttcatttggtatagataccataaattttgaccttaaaactctgtccgaaatgtttcgtgatattgaagacccatatcacgataagagagattttgaaaaattcagtaggttggtggcagattctgatgcacctttgtatcttgggtgcaaaccaaagcaaaccaacttatcatttgtgttggaactctgaagcttaaggaaagtaatggttggccaaacaagaatttcacaaaatcctctcgagttgttgaaggacttgttgctagaggagaacgaaaatcccacaaattgacacatgaagcaaagcgaatcttatgcccattgggtctagaggtcagaagaattcatacttgttagaacgattacatatgtattacaaatagtattacggcttctagatacgagcaagacataagtgaagatgaaggtcatcagttaaagaggagtggctccgtaaagatagtgtgatatcttccaattgctaaccgcatgaaaaaaaactgtttgtgaatcctaagcaagctaagttagtacattggcatgctgaggacagtaaaccgaggcattccagccaacttagtgtagtgaaggacaatcgataggttttaccccaaatttgcaaatgacccaagaaacattttattttagccaaagtaagaaagttgaggcgtcaatacattggtactttagagtgacttcagtgcttcaaagacgacctattcacagggagcaaacatttagaaaggacacaactacaccgagagtgctagctggatagtgctgaagagagacaccattctttccaaaaaaaaaaaagctactagtacactcaatatctatatatttttttcttcttagagaagtttctcttaaattactcatccgatttataatccgattacaccgttgtgttcgtaacaattaaatatttacaacaagaactcacatgattatattttgatgaaaaagcacaaattactttcatgatatgtctaaattacttctagatttcactaagttacttattaaacatataaaagtaaattcagtaaagcttaaaagtaatttacatatattataaaagtaacttataacaaaaagaaagtgactttaatttagaactatatctagattcattaacattaatataggcaatactaaaatgacttgcattatgaaacggggggagtaactctctatagtagaaataattatattgtgagtgagctgaaataagaaactatgtagagtgaattcgcaagtaaagtgtagagaagatttataaagtccacaaattatagaattaactaaaaacaataataaaaataatcaacttagagcattatgaatgtatagaagtaatttagtcaaatctgaaagtaacttatatatattataaaagtaacttagtatataataaaagtaatttacaaatataaatatttttttatcgtaatataatcatgtaagatcttgttgtgaagatttaattgtaacgaacataatagtgtaattgaattgtaaatcggataagtaatttgagagaaaactttataagaagaaagaaaaagacacacatgtctaagaggaaaaacagcacgcacatcagcatgtgtagcagtaattcttctcacaattgaatcgtcgctggttaaaactaaaccgagaggcttctcggtttagattttaccatttagaaagcttactagcacaccacaatcaaggttcacaaaaccgttttagatggagtttccaccacccccaccataaagcgtaataaaccatgtgggtaaccacacgactaccgtgaaaaccataaggttaccacaatttaaggttaccacatgtttaaggttaccacaaaattaaacatggattcaaaaactaaggttaccacatgtgatgatcgcgtggttttgtaaacgctggtgactcacaggatttccaaacgtaaccaatacggctcccaccgttcagtcaagagcctgcacctcaacaaaatgtcaccattcatgagcacgattacatgactacccaaatacccaacaaaacttaagccttcaatccagagaacaaataaaataggcacttgcaatctggtactaaacacatgaaaaacaatcgcagcagaacacaggccaaatatagtattatcaaaacatgtgacagaacatttgctctcacggttgtggaatcaaccacgcagaaaacccatcacgggtttaccagcatccagccagctccataaaatgacagctgatccaaaaaagaaaatcacgcgatctccatcaatgactacaagctctagcattcgttctttcaggcaagatcaccaaacatcatttctgtgaacctaaatatcaaaaactataaagaaagcatacataatgttcagataaatataatggccatgtgcgagagttctgaaagggctggccaccccccatctatacccctatacaaagccaatctgcaagcgttttcgtggtaccatggaggcaggcgatagcggctgcaccttagacttcacggcgccagccaatcctgaagtattgacatcgtaccactataagctccattttgtcttctatacaggtgaagcgatgtgggtagcgtcgtcagcatctctcagtgcacaagttgccacctcttgttgtcaagccccactgtgaactaccatgacaagaaagagatgtgttgcaatccttgtgctcctcagcaatggtcaatggtcgacagccatagccatcttgtacaaagcttgcctcaataaatatccatgtagtgctccaacatatgcttgtgcccaatacttgcaactgatgtctatgcaccatcgtttctgcattacagtgcagaaaggcacaaccaagctgctgtgggccaaggatacaacccatcaaacttccaaaacttaatgcggcttcagcaattatatcacaagctttcctgatcactggggaggaggttggagagactgcggttgggtgttgtaatgagcatatgactgagagtagagcgggttcatcatgggctgcaaaatatcatgttacctacacactccctgagaaagataaagttacaattaaacagataatgaaaaaggataaaccacctgagactgaagaccaggaccagccattccaaaatgcatctgtgatgactcatcttgtgaagagtcattgtatcccgcttgtgtaaacattccatgtgaaccatgggccatgtgatcctggataacactaaaaggttactcacagaacatacacataaagaaggcttgaaaaggcagttacttttcgtaatagttatgaccgagatagaacagacctgagagacaatgtcatttgctgcacccatatgggaataccctgggtgtgcattttggttcaaataattcccaggatatccagattggggtccttgagagtagtcaacaccatagcctccttgagaagcctatatatgaacaacttatattagaaaactcttccccagagtaaacgcaaactttaaactttacggcattgccataatttactttccaattggttgacaaatcagatttaactgaataaatgaattggcacagaaatacaagagacatttgaaacaatgggtacctgagtggaaaaatcagcaatgttgtatgccacatgagatccttggctcttgaaatcatctccaaagaagtcctagaaaacaacaaaaccaaattttgtcatcaaggatagaacaagatagtaaatggcatgcatgcatcattaattgctagtacctgagacatcccaccaatggaaaacccatcgcggaatgtttgactgagaccttggacaggcatctaattgcaaaaggcaaatattactagacaggtacttttttttgtatgacatatattaatagaaataaacaaacctgtgtcatcaatccagtctgggacattggacctccaccagaaggctgactgctcggattctccaggccaggaaagttaaaagctgaccccatgcctcccatagcttgctgagaactctgttggtgagcaaggtgcccaccaatagggccaccagtatttccacgaggtccaaagtttctgtttccaggttgaggcacaggtggaacagctccaatcggtccgtgcaatgatccccgggttggaatagcatagggttgagaatgagccccagcaaatggagggaaaggcatacgaggtaaaggatagccagatgggtgcacaccaggtttatgagccccatttggtgggccaaatggaacaaaggaatgccctgcatttcagaaaagaagaggagcgttaagagaaaagagggtaaaattagccaaaagttacttagaagcagaaccaaacaaaattaactatctacctttccccctaccacttctcttatctgccactgggtttgtgcctgcagcaccaaaactagctccttgcataacaccttgaccgccacccaggaagagtcgtcgatcattgtagatctactcaagcatatactttgttaatttaataaaacaaaaggaaccataatgtttccaacaagtatctataagagtggaagaaggcacccaccttttttggcttttgaaattgcaccatactctgctttaagttgttcaaaggtccttctaccaaacactcatgctcctaaacacatggagattatcgagtgaaaattcaaaaactcagaagagctccttactttcaatatctactattagatatgcttatccaatgaacaggaatatctctcaaatagtaccaagcatcacgtgcttatagatttacaaaatttaggctgagtttggtgcaaaaattgtataagtttcttaaaaaaaatcaataaaatcattcgcaaatgctccgtctcgttttgcatgaaacaaattagcccagccaaacgtccagctcaaacacacctttagttatataaagaagcaagaaataatactgaaacaggacaattggaatggaaccacttatccgtttgtcaaatactcaaatgtaaaagaccttgaacacatgcaggtagaaaatacacatgttccatcaacactacaagcattcaattctactgtcaggaaagataacctgttcaaaaaacacctaacaatctgggcataaaccccaaaaataagcaacctgaacagggtatgcaaagcattgttatgtactgaaggaaagcttataccttataatgtgtcaataaactattccagagtggctgcttgcttagaactttagggttcccaagaataactataccgtaccgagcacgagttaatgcgacatttaacctgcgtggatcattaagaaacccaataccctgaaaggtgaaaaaaaaaatatcatgtcagttaacacaaatttgcgaaacaaaaaggttgttcttcaagcaggaaaagctagaatatgcacagacaacacagttcaatccttgcacaaaatatacaacagtctgcaagttaaactactgcctagatgcttaacataagaatttacaaagacaggcttaccaccctcaactgtcattgccaatgagtttgaaaacataaatagaattttcactaaatagaaaaggccaggtcagagtacatctataacgccctctagaagtcaatgtgaaatactgtcaagaatattatgctgcaaaccaagtaaaacagcaaagattacctggtgctcattgcttctaacacaagacaggattatgtaatctttttctcttccctggaaggaatcaacacttgctacctgaaataagtataaatcttatatgacaaggcagctttcaccttggtaggtttaacggaacagtatacatgattggtggttaacctcaatttctttgtatagttgttggcgaagagagccattccttgacatataattcacaatatatgccctttgtccttcataaggtgtgataactccaatctacaatacattccacaaaatgtgatttctttttttataaaagaatcaagtgctgcaaaatgttactagtagatgaaaaagggatcatcactgcatacctggcttggtacaacaccactccttaaaaatgtagttacaatcttttcaacatttgcagcttcagttctattgaggtatgatgtcccactggcactgatctcttcttgtcccatctacagaaaatcagtacgagtctcttgtgtaaataagcaagaagagcttttgcagttaggaagtacagaagaacaaagatcaattggtggtggtccaagaaggtacctgcacgtagaagaacataggccgatttggaacaggccaaggaaaatcaatcccaggtgtctgtctctcgtttacagttactccattttgcagtgtgccttcatagaagcagttggacgggaagtctgaaagacaagggtgcatcctatattgtacctgtaataacagatgattatgttagaactattagctttgttcccaaggaatgttaattttcgaacgcaaaatacttggatataactcgtttcaatggttacttgggtataatttggtgaattgattgtgtaaaaacaacgacaatatcgggatgaacaacagagatttgatgattcatccccaaaaaaggcttaaagaaaaaccagaaaatgcaaagtgataagtaatgttggaacatgtactattcttaataattcaaagttttgtccaatgatatgacaacgaatattaagcaagacagtttgttcaaattagaatgcctgcactaaattgtacctgacatacacatacggggggaaaccatttttcaaagaatcctcacaaaagtaacatgatttatgagcaatctcaggataacttaaaaagaatgtatcagttaggctttaaatccaccgcttccaaagttttgacatcaatgtcacaggacaaggcatggtaagcatactcacaccatggtaataatgtggagaaacagaacaccagattcaacaattacctgtagcctgaaaggcttgactccaaggataacaagccgttcaaagagcgattgtgctaatcctgcacgagctgcctttttgcacatgatgactgggcccagttgacaatgatctccaacaagaacaacctaaagaaagagtataaatatagcataatggaaagaacaaaaaaccaccaattaattacttgttacctgctttacaccaagcaccaatggaatgagacattcaggctctgttgcctgtgtagattcatcaataagaacctgacataaaaaaaaaaagaagaaagaaactccatcacctcaataaagagcagacatcaaaattaaactgctattagaaagaaagtattacttgacggaatcggaagtttgctaaacgagggtctccagcaccaacacaagtgcaacaaatcacatcagcactttgtaatatctctctctcagtagctcgttttaatgccttgtactttttctcatcactgcttgacaattcacctataaaaatagaatataagaaaattttctaattcaaccaaacagaatggccgagagagtttaaggaccttgttcatctttgagttgctgtagcttatgcaattcactcttttcagatgtatcaaggtgccgaacctacgttttatgcataaaggaacatcagtgacatcatcaagcgtatggctatttcacaggtaaacaactagccaagaatcaagaatgtacctgataatgaagtgtcaaatgctcaacaggagatgaaacagcttccctagattttgcacatagcctgacaacctgcaatatgcaaccacagttactaactggaaatgtaaatagtaaagaatgtatgagatgtactagtaatttaacagtttcaaaacgcgtatatattcaacatggcaaaattactcctgcgaaccacaggagcatacaaaaaaagctcagtatcaacatcgatagaagccaagcatgtaatttgaaacttctatcttaaaatggttttactactcaatggactgtgtcaaacgggatagcagacaagtcaaaaatacaggaaacagttgatacttaaaataaaccataaattattgtttaccttgagaccagtagagcttatcttctctgccaactgatcaacggctacattacttggagcacatacaaggacctgaaatttcaaatcagacaaggttaacaatagcatcaaattatgccagcagagcaaatgccatgcactcttatacctgtccttggccttgttttgccatgtgatacacgatcgcagcagatgtgacagttttccctgtgccaggtggaccttgaatcaaactaattggcttctggagaacacttttaactgctaagacctgaatagatgcaccacaagatcagaatagaacattagatcaacatatagtgtttaattctacttcagtgaagctatggcataatagctgaacacctgaagttagattaaaaaaaataggttttgcacggagatgaagaaagttggtggaattaaatggggaaagattatgattggtgaagaagaggatgtagatggagaaattaaatgggagatggttgtgattggttgaggtgaaggagtaggtgaagtaactatgttttgggagaaattttgaatgctaaaggtagctatattttgggatggagggagtagataagaaacaacactaaactgatgtatcgacccatttttctagaagcacaaaaacatacctgtgaagcatttagttctggaagtcctggtgcaccaaagcgtctcggtagtgtattacgtattatttgatgctcaacttcatgtcccaaaaggtgatggtatatgtacctacgttgaagcaacagaagagtaagaatttcctcatgagacatttgaaaagattgtgattatccaacaaagaatccaaatacagactagggatattttgcgagagttcttcccaattcatcagggtcctatcaacctttaaccatatccccaaaaaaggtaccaacaaccataaacttaaaaaatagctaaaaatatacattttttacttaaacactttgttcaatcgcaaagaaatgtgtgttcatccttaagcagtaatcatagtaaaagcaatataaatatgactagaggaccagaaattctaagtatacacgatatagatgcatctaactcacccactgacacttgtctcatccacagcaaaagttttcattgccccctgcatcctatcaaagctagtactcttccagacaaaatccacactgaatccatggttcaaatcaacaggaactccctgaaatcaggaaagtttatgatggaaaatgggagcagtaaaaggttactaagaaaaacaagtgagagctatactcctcatacctgactagcacgaagttcaagtgctacctcctcttgtgccgtaagtttaatctgaaggaataatgcccttaccattagcactaaagtagaagtgaccctgttggtgttattgtagagctatcaattaacatgtttctagggcacataccacatgacccacagactgccatgcagggtgtgaagaatcaccagaatatcgaagccgcagctcatctcctgggacaagtctcaattcattgtcttcctaaaatataaaattgattccacatgttagaaaaataaaaagtgtaggtgtattaaatgatataaaaagtccatgataattacaaggagcaagggaaaaatggttttgacaagattccaggccctatgttatcagatcttgtgcttccaagttcttaatctaacctttggaaacacgaaataggctatgcgcttcttgttcagtccaatatcccaccgcacggtcaagctgtccttgctctgtgactctttcatcatctacagaaaaataacaggaggcaagaaacttcagtacatatacatatatcatagtctggttccaaggaacaaaatgttttaagaactatcagcacattcaggaaatattatcagaacatagtaccttgtcataatcagcctcaagctttatcagtggagcaaacacattttgatactggcaaaaaaaaaatgaaaacctgtgttagttacaatatagaaaaacatggaagatttgagtgttttaaaagtgttagtatagaatcaaggtgcaagatatcaaaaacaggctcaggaaataaatgcccaaatgaaccaatgaacattccaaacctggtaagcatcttcatacttcagagccacttgttggggctcatcatcgacacctggtttttcaagatcttcaagagaggcatcagggtttgttttccagagctcttccactttgttaatttgttgcgcactaatttgacgagccctcagctgctcctgttctgagggaacctggtagaacaaaagattgcaaatttgtgaaaagacaaataacaggacaacactcaatgcacaattgcacacacaacccaaaataataaatggaggaagcattaaccttgacaagccatgataagaaacacctgtcatcaataagaggacaccactgactgaggtcccaattcatatccttcaatgcattaacactcaaacagggctctctgcacagaagaacaacgacattctctgcctttgctgagataaaaccaagaaggaatacattccgacaaccacaattgtagcactcaagaattgtttcacccaacggactatccttgtgtaggcaaacttccttatgttttgctctaacctgtgtaaaatacacagcggtgtaaaaattaagtcataaaatatgaaataaactgaacgaaagcagtaacaggctaaaaataagtgacaccaataatttctaccattaaatttctatgtagtctgtaaagcctaagctggtctgcaaaaaatagcataggtaattcaggaacgcctgagaaatcccctatagaagaccctggattttttgaaccaaagttgaattctactaaccacccgcagacatgatagcaaattgccatgtagcacaattgatttcaaaagaaaagatgtaggattgcaatttatcataaatttttgtattgcaccacagataacaaaattaggaacaaataattttagtggacaaggcatcctgatgacataaatgcccttatgggacaaagcatgctatcaagttttaaacatgagtattctacactaaaatgccaataaataaaaaaaatcgtttcgctactgaaaattttcattgtatgagctggcaagctaatcctcagaatttccatccagcatgctcataaattttaccaaaaatgaggggagaactgactggttgagcaatttatcaaaacaatcaaatttgattaacctaagcagatgaaagcaattcaacaatcacaataattcatctcttcaatatagttgattgccgcatcctgaactaaatgcacttttttggcaccataggccaccaaaaaatgttatcaagctacaagagatcatcatctgcgagacaaacttgtcacctacttaggttggcggcaaactcctaccgaattcacatatgatcgatggattgatcttaaaactgaaagaaactaagctgttatgaccctaagctgttatgaccgtaattagcacgagaaaaagacagggacacgcaccaggtggttaacgatgtgggagccggacgtgttcccccgcgagttgcagaaccacttgcggcaggacggcacgttgcagcgcgcgacgcacgcggggttgtggatcccgcagtaccggcacgcgtgctcgacgaagtcgcccttgccgtagtcgtacccgtcctccccggcgccggcgccgagcggctcctcgaagctgagcgccgcgaccccggaggcgagcccgtccgccgccgcggcggacgccctcgccttggccgacgcgcgcggcgacggcgaggacgaggaggccggcggggtggtggcctcccgcggcgcgagatcggggtcctgcgaggcgtccggcggcgggggaggcgggggcggccacgacgaggacgacggcgacggcgagcccgcggagccaggcacccccggagccgacgtggggggcgcggatcgggccggctgggagagctccgggaagtccgggtagtcgaagtcgtcgccctgggtgttgaactcgaggaaggtgtaggcgtcgccggcggccgaggcgggcgggtcgggctgcgaggccgtctcgtagaggtcggcggcggcggaggaggagggcggttgcgtcgccatcggagcgggcggggcggggatgggggcgaggggaagggctccccctcctccctagggttagggttttgtggttcggggagtggggagagacgaggcgaatcgggggagggggagagacgggagagagaagaggaagaggtgaggtggtggaggagaagttgatttgattaaaaccgtctcccctctgtgggatttcggatttggactcttcgcgtccagccgtctcgtgcaggaggagtttggactttggagggtggagccgtggagaccggtttggagaggtttggagagcttttacgtacgtacctttggtacaactctaatttatgatatggacgtgactagtcacagctagataaaccagcgatcacttcatatatgagagactctatctacctatactttaaataaaattttctcttaaactatttatccgatctacgattcgattacaccattgtgttcgtaacaattaaatctttataacaagatctcacataaatatattttgatgaaaaaaatataaattacttttacaaatatctaaattacttttagatttcactaaattacctcatagacatataaaagtaaattcaataaagtctaaaagtaatttacatatattatagaagtaacttataacaaaagaaacgtaactttaatgcttgacttttttcattggacgtgactacacaactagtcatgtttttaacccaacaacgaatttacttctaatgtcgtgacaaaattacttccgttttgttttaagttacttttataatatgtaaattacttttagattgtattgaatttacttttatatgtctaagaaataatttagtcaaatctaaaagtaacttatatatatgataaaagtaacttacgtatataataaaagtaatttacaaatataaatattttttcatcgtagtataatcatgtaagatcttgttgtgaagatttaattgtaacaaatacaatggtgtaatcggattgtagatcgaataagtaatttgagaaaaaactttataagaatgaagaaaaagacatgcatgtctaagagaaataaagcatgcatgtatagcagtacttcttctcacaattgattggtcgttggttaacactaaaccgagaggcttctcggtttagattttgccttatgatatactagccctaaaacatattaaattctaattaattgaaatacatttttttatatttagatatttttttaagtaggtaggtaaaatgatatggttggatttaatttttattaaattctccatattaactacactttaaaattttcttgaaatttgttgtgcttaattgctaattttaataatacaaacatcatttcagcattaatttaaataaaaatcattctttctctatgggccattttcagcccattttcttcttcagcccgcaaccgagccgacccacttttcttaggccgcaagcgactaaagtctaactaacatccccatactcctcgtctcacttccacgtttgtgttggaccgccggcccgtgtacggccaagtgccacggtccggtgacggaggccagcccgacgctcgatcgatgttagccgtttgtttcgatggacggctcaaatcagttccaaatcaatcaaaaccctggtgcaaccctaaccctagattcattctccccctccctctccctgcctccccctgcccaacgccacctccgcctcccccaccccccaatcgccagctgcctcctcccgcccgacaccgctcccctcctcccccaccggcgccgcctctccccctccccttccctctggcgccgtttctcctcccctctccctccggcggcgccactcctcctgtccctctccctcccatctcgccggcacggcacggcgacggcagggtacagcgacgacggttgtccctccccctctccctctccccgtcggcctcaatggccgtccctccctctaggcctctttatttctgtcggtgatgacgccctctccaccctcaagatccggcggtaccctcccaacgtcggtgtcgacagcgacggcgacgtcggtggcttcctgcgagcggattcagtgccggcggcttcctgcagcggatacaacggcgacgtgtcgatccggcttcacagacgacgccgacagcttcccatggacagatccggtggcgacgacggcgttggcggcttcacggtgatgtttctatttttcttcccgttctttttctcaatcactggattgtccgattagattgtcatgtggaatcctttgtatttatagggttaatttcatccgattttgagtacaaatcaagtttgtatccaattttcgtgtggtggcggaatcggacagggcgaagattattttcgctcttttttaattttaagacggaaacgttcacaattttttaagtagtagtctagcccgattggattgtcatggaaccctttgtatttacggggttaatttcattcgattttgagtccaaatcgagtctgtattcaattttcgtgtggtggcggaatcggacagagcgaatattttttgttcgctctttttttattttaagacggataacggaaacgttttcaaaattttaagtagtagagaaaagctagtttttttaaaaaaaagaacaaacatctataatatatttataggtcccggtttttcacaaccaacacatatattgatcatctatattagtcttatagatgaatgttctttgaagaaactgacacctatttaaaaaaccggataccgacccctattagaataaactagtcagagccaacctaccaatcaaccaaccttatcctcacaatcctagccatccatccttattgccacaatcccaaccgacctaccacccgctcctcttcctccctcggtacctccaccccacaccgtcgcacgactcccgcccgacccccagcgctgcccacctcctcaccaccacccctacccctgccacatctgcctcccgccaccggacctcaacgcgtggccgcgcctcctcagcctcctcgacgtcgccttcttcctccctccctctcggcatctccctagtttagcagcggcacaggggcacaggtcgacagctcccggctcggtggctccccggcggcgcggcggctcggggcctccatgacggcgaggtggcgaggaggaggttgggcgaggagcagcaaaagcgtccgctcacccctccctctctactcctctgtgatgtgatttattttatgatttccacctcttctctctaattggatcgtctcctatcctggatgatttcgattggattaggattgggatttagtttttgggttagatttacaatggtttgggattggttgtgggtgcattgatagatgaatcggagggaggaggtccgctactaagacggacgaaaatcctgatttgtgcggttcattttctcttcctctacgttctatgtccgattggattttgtatcgatccttcttctttttttttcaccctcttgacggggttttttgttttttatcgccctttcttaccggctttttttatagatttttttctgcgtcaaattgaatcggactttccttttttgttttaatgtttttttcacctctgttattacggacaacggaaacgttttcaatttttttaagtagtagagagtagagatgtggcatagctctagttccaacttcatcctttttgaagctggagctcaacgaaacagattcagtttcatctaaaatgagagtgcagttgggtgaaacattctcacaaaattaactagagaggtggagcggagtttaggctgctctgcaactctattctaaactcagctcctagagctaaacttaggagtttgagctctaccaaacagacactaaatttagctctagaagttggatctggagtggacctgtggagcactgcctaaacctagctctaccttgctagttcttttgagagagcgctccacctagctccgctcccattttaactggagttgaaaaattagtagtagtagcttctttcgtctctactacttcccaatcaattcagatttttatttagattctgtgaatctacaaaactaaaaattagaagctaaaaaatctaagttttctagatcctcacaagctagctatcacctagttgcttctcataattttaaactcccctaaacaggtgaatgattgtagggttcgtgctgatagtcgcttttatagggcccgctcgttggccacttagagggagaactgaaataaacagtagtaattatcattatcctctcaattataagaatgtgttttggagattgaaaaagaagaagattaagaaggtacaaagaacgagatgagtcatgatttaggtggtgcttggatccagagactaaactttagtccctatcacatcgaatgtttggacactaatttggagtattaaacatagactacttacaaaactaattacataaatgagagctaattcgcgagacaaattttaagcctaattaatccataattagataatatttactgtagcatcacataggctaatcatgtattaattaggctcaatagattcttctcgcgaattagtccagagttatggaatgggttttgtcattagtttacgtttaatacttctaattagtgtccaaacatccgatgtgacagggactaaaaagttttagtcacatccaaacacccccttactaactatttcaaacttaaaaagtgtattaataggatttttttaaagcaacatttctatagaaacttgaaaatgcaccgtttaacggttcgggaagcgtgtgggcgaaaaatgagaaacttttatcttccttgtgcttgtctcaaacacagcctaaggacccatttgaaactcctcaatagcacatgattaattaaatattagctattaaaaattgataaatatatttatttgatattttcttaagagacttctatatataatgttttttaaaaacaccgtttagcattttagaaagcctagaaagagccattttggatcaattgataccaaaaaaaatgttatttattattttgaaaattaacacccattttatttaaatgaaaagcataggaattttgtagtatttcatttatatagatttttttttcaaatggccctttgatatttcaaaggactagacattgttgaatcttatggaattcatatataatgcctcattctatgtttgttttggagaaaattcaacatgaggtctaaccctatgtaaagttttctttatatttatctatcttcaaattcatttgatctaatcaaacagtcatttcctctctttttctttttcctttttatccctgtcttttgcaatcgcttgttgtacttcttattcgtgtcaaaatcatgtatttttttatatccatctactttcccaattctgcatttcagaagagagctaaatgttagtgtgattggtttggattagaacaaaatcattggtaatacccatgctctgtttgggaacactttataactttccaaaccatatcaaacatactgtctgaactccacactaagtaattagtaggtccagggaaacaaatctaacatagagtatttttttcaaagtgaaagaaaatcaaggtttctatggaaaacttcatcaaagtccaaagctaatggaatttagctcctttgtgccttgagccttgagactgagctccctgccactatattcaagtcttgaagaagatcttttattgcctccacaacaacacaatcgaatgtgagggagatctcagaaataagatagcaatgagaatcataataccataggttgagttgaggaggagaactgaggaagatgagtcctttacaagaaaaagcaatatagaggcaaaagaagacataaaaaaaaatcaatcgaatcttacctttggtagatcccctcctcactttgaagtgaatcgacatttgagatgccctacatttcgctcgaaactacctttttatttcttgctttacccaaaatactaatattgaaattaaagaatgttttcctacaattcatgttaggttaaaccagaccaactaatactagactatcatattaaagctatataaatcgaaacaaaagccatcaaaaagtaaaagttgagtaaacaaaaataggacaacatggccacaaagttaaaccaagcaaagaaccatggatgatgcatgacatcatcttctctttggcacgttcccacaggtctcaactctcaaggtgactacactaggcacaaaggcctcaatccctgatgttggtctgagtggtgtttggttggtgccctgaagtgaaaggactttgatgtcgcctagagtgggggggtaaataggcattcctaaaaattatcatatcttcatagcatattagaatgatgggaactttcaattcaaattgaaacttccggtacgggattgtaagttccggtctcaatcaaaaagtttggagaataacagaataaaacactagctatgaacttatagctcgaacaaacaaaatatatatggatcaaaaggtgacaaacaaggtatccaagcaagatataaggtcaccaactatatcaattaagcatacaaatagatcaggtaaaaccaagctcaaacataacacgagagaaggcaagaacgagcgaaccaagagaggagacgcgtgacttgtttcccaagtttggatccacggattacgtcttcgttgaggggccacaaaggccgggtctctttcatcccttttctacatgaggttgcacaaatgcactcctcgatttcactcttaatttcttcccttgcagagacgaaattgaagccttcacaaactttttgtggcacaccacaaccttcggtgctcattggcgaccttagtccccaagagtaacaaacacaatcgaaaatttacttgctatgtactccaatgctcaaagtatagagtgaagctcactagctctcaaactctcttcccaactctcttctcttctcaaatcttactcacaaagatctaccacttaggctggagattggagatgggatatttggctttggatatatctatttcatgcctaagaacaacagccactcaaggaggggatggaggcgtttatatacccgagcctatcaaaactagccgtttgaggcaaatattccatttttcggaactttcgaaatgcattttcaaaaatatccgaaaaacactagagagcaaacctgagatttctgtctttttcggaatttttcaaaatccaaaaaacacgagagagcaaaactagaatttctatcatttttggaatttccgaaaacaccaaagagtaaaacaaccataacttttttctcgggagtcccttttttatgatcttggactctatggaaagctcacttagaagactaccaactcaaccagaagcaaggtttaaaaccactcaaaggataggttaaagtttggctttctctcaaggtagcactaggataggttattttgaacactgagatatacacaagcacaacaacattgcgtccctattaatagtacgatattcttatactcaaatataaataggaaaataattataccaataggaatgcctttataccatcttcctttctttgtcttaagggataccaacgctaaaaccgtttcaccgtatcctatatacctatacaagtcatccccactaattctattttcctgctctctcgctttgccacatcactatcgatttccatccgttggatcactccacttcaaccgatcaggttgcttttagcctgcctcagttctttattcatggatggctcccaaatactcggcccagcccagcccacatgcctgccgctcccgcaccggattggctccctctcccgcatcacgctactgccacccccaccgcatgtctctcgccgtatcgcatgccctccctccccgcatcgcacttctccaccttccccgccgcatttctcgcaccccaccccatccccttcctatctcgcatcgcgctttgccaatcccgtcgcatcggcgccgcacggccctccctaggtctgtttcgcctccctcctcccagtgctagccgcatcgccttcctcgccccatcctaagagaaaccttcgccgcccactaagagcagacttatgattgccattaacgcgttaatttcattcgcctctaattaaagccatggcgatatcattgcgggcctttgcttattaccgacgaagttctccagtccatacagaagcagaagcagaagtaggttcttggttgttctccacgaactgcttggtttcatatgaatcttcattgcataggtacatattattggattggtttaaactacagtgatcgttttgtagctttattttcatgcctttgaatctttcatatctaccgaaggtatttgatggtgtggtacctactccttccttctgaatttgttatgtgcctcctgtggattttcattcaggaaagatcaatccgtatgtgcttccttttcaatttgacctatcatctctttggcaaattcatgaataagtagccttcactgtactcgaggattattgggtgcaattggattcaatcttaacaaggtctgtcgtcttacgacagcttcttttcggtggatctcccatctgtactaaacacaccctattctcctcctcgctcagtaagtatgacattttattttgccttagactctcatctcttggttttgttaggtatcatatccgtatcttctatctgaagataagggaatttgttgatttttcatgacggacctcacaactgattgtataagttccattgtattcctgtacgtttattcgaggatccagagtattcaactccgttgtgttcctgcccgtatcgaggattccaggtaatcagatttgctcagattcaatcagctttgttctaatcaaatttgctcagattcaatcagctttgttcttgcagatttaattggttattcatccacagtttatccttatggtcttgcaaatccaacatggaagaattaaacatcttacaggtatgttccatcttagaatcaaactgacgaaagtttttccctcagcactttcagtaaattttgtcatgttacaggtttgcagtgaagacacaagaagactggggaaaatacatttaacagcttgaaataattgaaattttattatattcttttccctgcttgaagtgattgttgcagtattcatctttgttcgttcaaatgcccttcatagagaatgttcttcacgtttcttaaaaatggccttcccctgcttgaaattttattatgttcttcacgtttgttctggcaaaaaaaactgtactcaaacaaaatcattgtatagaacagagaatggtcatgatgtgcatttgttaaaagcaaaatctaacaagacgcgtacagtttctaatcttacaaaccaatatttaagtaaacaaatttaattcttgggcactatatacatggcacgaactattccaatcatgcttcaactttaggtggaagctaggcacttcttatacttttgaaacttaatattccactaatgatccgcatgttgaaggaaaacttacacctatgatcggtcacaagtgtcatcttacttattttattccaagaggaaaaatactatcttatacataaaaaatcgctcaacattctagacaaaaaacttattatgtcatgtaaaaaataaaagaaaaatattgcctatgtttatggatgtgcatatactataatagtatatacatatgttcacttcatatgtcagtagtggccacacatgcagtacaatcatcttgagctaaaaattaccatgtgctcccgcaacatcacgcagggtatattctagtattctttaaagattgatgcgtgctccttgtagcttcaaatggccttgcacggtccatcagacatagtcgtcactcgcccttcaccactggatttggtccttcggtgccaagctccttgcttgccttcaccaccgcatggttcatcgcggcgagcatcacttggccttcaccgtcttgccacttcgtaccccactttccaataacttcactttgttattcttgatatcattaggtgtcatgatctctatcgagtatcagcacattttccaattcatgggacctatttttcttgttcaactcaatgtatttattagtccgaatgattcggttgtcaaccttcacttgttgaccaacagatcacatgtataaaagaatatgaataaatgatgagtattaatcaacaccataagtgtcatatactcaaatgtatgctcaaatgtaaagatcccaattaaatgaaagtgaataatttggatcaaatacttgtataacatataggatttgctcccctaaatgtatgcatacggaatatttatatgaagcaagactatgtatagatagatatgaaactttgagatcttatcttacatacaagaatagaagacgcttatcaaatatagacaatataaaataagaaaaagtacgaattaccccccccaactatcgtggccgaccgaattacccccctaaacccgaaaactagacatcgttcaccctgaactttcaataccagacaatttacccccctcgacccaatccagagcagttttgacctacatagcgtacgcgtgatagtccaatctacattttattgataaaaaatatggggcccacctatcatactcctcttccactctcccttctctctctatctctctctctcactatgaacgaggcggcggcggcggcgcgggatggacggatagaggtgggggcaagcagtgggcgggcgtggacagcggacacgtaggcggcatgcacggcgcggtggagaccctcctgcgccggagggagttcgccagagttccctcccgctccctcccgaagttcgccgctccctcctctgtgtcccgcgccaccaccaccttcgtgtcccccgccgccgccaccacctgcgcgtcccgcgtcccgcggcgccacccatcatctgtcgccgacccgtaagagagagaggaagagtgatacgacccaaataggggtgatgtcccgatcttcacggcgtaggatcaagaaccaataactagcctcaaagagacgaagataactagctgcaagtagccaagataacagtgcaatctgacgatcgaactcgaagctaaccaccatctctacacggcaacctaaatcgaggattcgcccaaccacactaagttaccaaccaacacaacctagaatcaatcgaggaaaaatcctcaaagggactaggagcaccaattgggaggcgtcgaacgccgcttctataatcccacaaggaaaccacaagaacaaaggggtagagatctctctctaaatttgttagcacgcagctaaacaaaaggggttcatattctcattgtcaaaagtcttctaaatgataaaacatgtgggacatttatactaggaacaaccctcctggatgggaatgaaaggtcttaggagtttactggacataggctaactcaaatatcatactaagtgaattcccgagaggaatcgcacatctgtttggcttctgagcagtcctcaatgatttatccattactccttattgggaagtcgaaatgacgaaccgttcgtttgttggaggtgaaactatattaatcacaggtagccaagtgacggtagtggttactgttatgattgataaaattagcaaattttggtcaatacctacaattaatacttataagacataatccaagtttatccgttctgaggcacatcaccaaccaaacagctcaaccaggcatattccatcaaaatctcagggaggcatgttgcacacggcaacaaccaaacagaccctcaaaatattttggaacaatgccttgtcagaagtttgtgggtgactactggttattctgcggactagtaatcttacacgtgcaaggcacgtttcccacattatattacactaatcatgtaaaatcacctaaagattattctaaattttccacaatatatatcacactcaacatgcaaacaaccaaagttcaagaattattgtagtgtaaattgcaatatcttaataactcttccgtagacactttctataaaaaaaaatgcaaagcagagaatgatacgaaatgtacaatgctgccatagctttgatatacactaaactcaactctatctacaacatctaatcgtgaaaaaggcctcccctatctcagtaatagaatgtcaaatggcccccaaacaatctgcaataaaaatatcatttaaatgatcaccaataaatacctcccgtcgcatcaccagtaacgaaaaccacaagccttagtattgtatacttgattaagataaatgtttacttattgatattgatattcaacagaaccttgttgaattctccagcttggtattctactttgtaatctcatgggaaaaaagcactttgctttgcagcaaagtctcaaaggggtgttgttccaagcagcaaacaacacaatttctatggtttttcctcaccgccgctcgcccgccacgcctcccgcgtcccctgcccctctgctccgcccgcgcccggagacgccgccgctccgcctgctctagccgcgcaccgcccacgcccagagccgccacttgcccgccgccgtgctcgccaaccgcttgccgctgccgctgccacgctctcccggagacaccgccgctctgcctgctctggccgcacgctgacactgcccctccgcctactccggccgcgcgctcacccatcgccgcccgccgttggcaaagagagagaagaggaaagagaggaggaggagagaaaagagaagaaaaaaatgcagctaacatgtgggccccatgatttttttttaatttttttttctgactaggatgccacgttagtgaaaccacccacatatactgccaaaggatctccgatgaatggtttgaatgaatttaggagcgaacatttctggttttaggttgagggacctcaaaaaatctcgctgttaagttgagggacctctgctgaacttattcctaaataatacgaaaagaaggcaggcgacctagcccaaatatagaaacggcccagcccaaagtcgcctccactcccactgaccacaccagggtttacgattccggtcggatttcgcgaaatttcgacgtttcgacaaggctcgaaagtagaaaccatctgagatttcgaggagtttcatccaaattcaaatttgaattgataaaaaagaaaaaaaatcaaataaaatcttataaatactatgatattcatgtaacctattgggatataaatttttttaaaaaatgaagtattgtgtgtatttatacatcatgaaagaatagaataaaaaattaaaaaaacacttacatgggccagattgcatgaaataggcccaattactgatcgaaatttcgatgatttcgatcgaaatttcaccaaaaccgaccggtttttgagaaattatcggtaaactcagggaatttgtattcaaattttggtttatgaaatttcttcagaagttaccggttttccacttgatttcgtgaaatttcgaatttcaccggtgctcgaaacggaacggaagggcatatcggtcgtaaaccctgaaccacactcatcacctcgccctccaaatcgcccacacctctggaaccccattccacccacccgcagccgcagcgaggagaggagaaacgagagagagagaaaaagaagaaaaagaaaaatgctgcgccacgccgcccgccgcctggccaccacccgcgccgccgccgccgccgccgccggccgcagcagcagggtgctctcgacggcggaggtgccggccgaggcggccaccgactccgccttcgcggaggcgtggaagaaggtggcccccaacatcgaggcccccgccacgcccatgtcgctcatgcagccccgcccccccacgccggcggccatcccctccaagctcaccgtcaacttcgtcctcccctacaagtccgagatcgccaacaaggaggtatgcgcggaccgtgtgcccccctctcctttgccctacattagctagagtttgtgtctgaacattcagtgtcaatgttcctgatgtaaatttctttggttgagaaaatctttccttctcaagttctatgaataaaactgcatattagtatagcctactattcacttatattttactatgctgcataagaagcttttttttttttaccgtgcaccagttatactccctccggtccaaaatcttgtaacctaggactggatgagatacatcttagtgcaatgaatccacaagtttataaaaaaattagtaacatctacacaaccaaattagtttcattaaatataacacggaatatattttgataatatattcgttttatattggaaatgttgttatatttttctaaaaacttggtcaaactttaaaaactaagtgtaactaaagaaaaatcaaagtggcttgtgacttattaacatgaaacggagagagtagattttaggaaggcagcaccatacctgcttgggagcgtggagttggaagaggcgcacgggggggggggggggg

SEQ ID NO: 61990 - DNA, 16928 bp, Oryza sativa
  unsure (1)..(16928): unsure at all n locations
acgagctgttggtccccttcatcgcatttcaaaaacagacagctgtatctgacgacgatcgccggcgaccggtcaagaagacagttgaggataaggcggcggccggtcgcggacgcagaggaggacggagcggcgccggggaagggagcaggcggaggaggacggagcggtgccgggggagggagcaggaggaggagggacgggcggccgtggcggcgccgcggcggagccgagcgggagcagacgccgttttctccgtcgaagtgggatggattggtccggccgattttggcggaccgtttcgtcccggatctgggaggaatattcctctccagggaccatcccatcccactcacctctcaaccaaacacccctaaaagtgggttcatcccatcccatcccatcccatcctctcaaccaaacactacctaagatcttgttatctactggctcagatatcctcacatgcatcggctgtaccaaaagctaagcctctgctgcatgcatggtgtgatcttgatttttaattagttcttcctccatttcatattatttcatattataagtcgttttacttttcctagttatgactaactttcttgaaaatatgttagtatttccaacacaaaacaaacatattatgaaaatatattcaatgttagatttaatagtactaattttatattttagatgttgaacttttctataaacttgatcaaacaagtttgattagaaaaaaaagataaacatcttattatatgaaacagagggaggagtaattagatctatcttaatttccttctttcacaacccatcggagctttggaaggcaagcgaaagctttagctggctctattgttggcgattgaaatggcaggttaattatgctccatctgccatatcatgtggtgctggctagtgccctttcattttgctacagtgacacagtacgaattcagtagcttttccatggttcatcatcggaaaacgacgagggaacagctatgtttatagcatcatatttaataatatcattttgtaatataaattacctacatttttacatacttactgtactgcaaattatacatgagagagatcaatcaaatagggaaaaaaatttagcaatcccgaaacaacaattacggctatgagtttgtagtatctttttggatgtgtatatgagagtagttgatgtggttgacgatgtaccaccagttgaagagctaattgctactagtatccttttcgcacactactctatggctgtgtttagattggtccaaagttcggaatttggttgaaattggagacgatatgactgaaaagttgtgtatgtattaaagatttgatgtgatggaaagttggaaatttggaaaaaaaaaactttggaaataaacacaccctataacttgaacacgaatttaaattattattttctcacgccatacttggcggacagttcgatcttctgtgattggccagaagtattacttttatttttttataacaaaacgatttaaagattaaaaagttcccctcgtgcaccatgacccggcatctcgactgttggccggcacatgaaatatgaatgcatcatgtgcgactgtgcagtgcagctgccttttgccttgtggcgtccccattgcgtgggtcacctaatcagaatgaacacgtctttttgactctcttttttaccttctagaaaaaaaaaggccagaaaattcgttgatcttttcctcatcaaaatgccaccagccgatttaatactcataactatatactaatgaaataatgagtatttggcgtaaacatagggtttcttgaaacattttaccccaaaacctgagattctctaagataaatcataaaacctgggattttagtttacatgtttctcaaaacttggtttcgtaaaatttactaaaatatatgacgaagttgatttatttaccatgatgtttgaacaacgttactaatagtaaatatgttctacgtttactgaggcagtagtagtttccaaaatatgccgtaagaactagtgaatcggataaaccagtactcctcgggtagccccatttgactgtgattgttatcttacgtgaggtccgtgtagattattgtttgaagcacccgtaagaaggttccaaaaactgctgcaggtggcgcctcatgtgattaggacgttcgacaacgctatggtccatgatgtagctgagcgttgcacaaatgtgtagagtcactgtggttttttctctcatgttcgtgttatatattttgtctgttctaaaatctaaaatatatctattaatttataatccaattagatatatcctatattatgaatctagacaagggcattaaaaatttagacaacctcctgtttagattcgtactaccaagaatcctctatgggtccttgtgtacgtagattcatagtgttatgatatatccaattcggttctatgttgctatattttggaatggagtgagtatttatgtatattgtatcagttcaaaataactttattttttaccatcttatttgctccaaaacaacgactttatacatgaagcaatcattgcattagagtttatgaaaatgtgagggacaaatgaattgagactagataaaataagacacaattgcaatgagatttaataaaatggagtgtattctagttttttttttttttgcttttgtattagtatgtgtgagatgagtaaaaaataaagttagttttggatggaggtagtaattgcttctagccaaggttaacatggtatgtataagttcagcacaatcatccagaaagaatctatgggtctgtttggggagcttaagattgtagttcattttcaggattccacaactatagttttttttagaacttgaacgaaaagctacattgtttctaggaatttctgattgtgaaaaatgctctcctaaatagaccctatataccacaactagttaggaatatttgacgtctacactgctataaatagagacatcgatataaaatattctttgattggatgaaacaacttatataaaaaagtttgccaataacatatcccttccaaaaaaaatcaacttctaataataaacctatattagcatttgtttaaattcatcatcagaagttggtttttgagtatgcacttaacccaactctatttagggtgtgtttagttcacgccaaaattagaagtttggttgaaattggaacgatgtgacggaaaagttggaagtttgtgtgtgtaggaaagttttgatgtgatggaaaagttgaaagtttgaagaaaaagtttggaactaagtaagggcttaaggcttttcttgaaacatactctaatagcgattttataatatttcatacaactatttccaaactacaaaaaaccatcaaaaatgtctccaatcatagaagaggccagtaaagaatcacatagtaaacctcaaccagatttttcacctaaggggaattacacacgcacgtgcagccacttcgctcctactccctctgtcccacaatataagagattttgaatttttgtttgtaacgtttgatcactcgtcttattcaatttttttttacaaatataaaaaacgaaaagttgtgcttaaagtactgtagataataaagtaagtcacaaataaaataaataataatttcaaaatgtgtttgaataagacgagtggttaaacgttgcttgcaataactcaaaatcccttatattatgggacggagggagtatatacttatggatgacctatgggtttttttttcacaatcttacctatccctccaaaataaatagaaattcagtccacctcattttaaaccctgctttcaaattttgtaggctaaaacattgatccttttccccgtaaaaaaaatatattgaccccttaaccataaggctatactacgggccaatttgatagagttccaactcctatttaactataggagttgggtctaagttgaattttggagcatcctaagctcagggcctgttgtgtacagctctagctccatcactcctggagctggagctcagccaaatagttttagctccacctaaaatgggagcagagctgggtggagctttctcacaaaatgaactagagtgccacaactccacttcagacccaactcttgaagctaaatttagaatttggagctctactaaacaggccttcagctccatctctctagttcatttttgtgagagcgcatcatccgactccactcttattttagatggagctgaaactatttggttagtccgagctggagcaaaacataagccacagaagatccctcctacctctccaaaccaaaccaaaaataattctcgcccgctagcaagtgggccccacatctaatcatacatgatccatccgttcccctactcctattaaagaggagggggtaaagccctggctttcctcccccaacaactcggccaaattcaaagcaaagccgccattactgctcctcttccattccactggggacgtacgagctccgcgcatcccttccattccattactgaccttggctgctgcggctgcagtgcagagggggtttggtggtgcggttgatttgagcaataaattctctaggggggagggaggtatcggtcatggctgccgctgctgcaaggaggggctcatcgctgctctctcgctgcctgctgtccaggcccgccgccgccgcctcgcctgctgtcccctctgcgctccgcagggcaggtatattgattgattcatcatcccctggaccccttgttaattccaccgtacttttttttggttgtacagaatcttggttggtactagaagtaggtattcgtggccaagttcatgtgttctaggaaaaaaataaaaaaagttcatgtgttatttgtgtttcttggtgggtaaaattattttttccccaatgttgttggggggtgtcttggaattatttttcccacctttggttgatgccacaccgttgtagggcggcttctgtttgtctctttttgggtggtggtggggttttggatcttggagggattggccggacctgactgatctgaattccagggttggtgtgttgttgtcactagtgccactgtttaattattggttcatgacagggcttaattattgggtgcttaaaaacattatctcttgctgtatgggtgactgctctgatggcaagattcaatttggtactagaactcaaccatgtttgtatgaaaaaaaaatggtattgttgtagtagcttgtaatgattcttgaatttgctttttcacccagaaattcagcctctagagttgatcttttagatcaggttgtgtcctcatcttttgggaaaatatccttcattcaacgttgctgtcctccactactttctgtgtagtatacctatttgtcagctaatctggttgtagtgagaaatccctgccttatcttgacccggaaaatatggggtttctaggatttttggcgtcagatatgagtcatgagcatgagcggcagattggacctttcctcttttcttcggtgggctgtgatattttctttccttgacatgataggataccagtttttcttcagtccttatcagtgccatagaaaatcttaggtttttggttccaaaccgttcttgtttgctaatgtcaccatatatacagcgaaaccgatgtgaattgcctcgactatgaaatgacaagcagataccataaaaattcaaaacactattctttatctgaaattactgattagtactagtttactagttgccgggcagcacagtaacactcctggacattattgagtggtcattcagtcaaaaagaaagggacaagttgtaatcggctttcttatctgcgctacactgaggcacaattttaaactcttatttttcccatcatccttcaggccggtcaagatataaactagtttgtacctataagaaacatgaaataaatttagttccctagaattacagacagacggggtaaacacatgtaggacagtattggcgatgtattatacttttcagtcctgtgtgcttgtttttcaggttattttcctggggacaaatttatcacttacgcaaattttttcttgaaacgccagttttgaaaaataatgtttaagtatgtttaaatgctcctttcttccaccatgtgtggaggcatttgatctagggaccatatattatttttgtaccatttttgaggggcatttactgtcccattcagacttcattgaatacatgatcttaggaaatggatttactccgtaccactgctactactgtagtactcgtactattcctgactatgcattttctgcttgcagatgggacacaaggattgttgccgggaatccttcagaggttcagcactgcagcagtagcagaggagcccatatcacccccagtccaagtgaactacactcagctcctcattgatggaaaattcgttgattcagcatctggtacacttcttcagctcagcccttcctatgaaactatttcaactcaactagtagtaatgagattggattcataaggctagtttggtgggcttcagctgttctataggcattgaacaccacaaggcccatgaactgagaaaaatagattggttttaaatttctttttgtgacagtaagttgagctcataattcaaattgtgcattgcaatttcattaggcaaaactttcccaactctggaccctcgtaccggggagctgattgcccatgtggctgaaggcgatgcggaggatattaaccgtgcggttcatgcggcccgcaaggctttcgatgaagggccatggccaaagatgactgcctatgtaaacacttactgacacttctgttgctagctgctactgttgtattgttctgaagtcatgctcatagaagtacacaatttattttcttctacaggagagatcccggattctgttgcggtttgctgacttgattgagaagcacaacgatgaaattgctgcattggagacatgggacaacggcaagccgtatgcgcaagctgccaacattgaagtgccaatggtggcacggctgatgcggtactatgctggtgagtaagcttccttctgacatcaacagcaatgatcaacaaggtgcctatgcaggtggctaatattgttccactcgtgctgaaatgtttgcaggttgggctgacaagatccatgggcttgtcgtgccggctgacggcccacaccatgtacaggtgctgcacgagcccattggtgtcgcaggtcagatcatcccatggaactttccgcttctgatgtttgcgtggaaagttggccctgctttggcttgtggaaacactgttgtgctcaagacggctgagcaaactcctctgtctgctctatttgcttctaagctgttgcatgaggttggtgcagtgatcattttcgtaatttttgttcaatgagaggaatccatttttaattgctccatgctatttggacatttattatgattactgagaatggcctgttgttggcttgtgtagttttgggattgcaaaatattataattagttctaaagcaaccattttgcaaaatatggttactgagaattgcattttacagaatttcttgtcctgcagtctagtgatcaagaagcaactgcaagttcagatcttcccgaaaggaagggatagaaacaacccattctagtgtcaataatccttttaggtctaatatccaagacctagagtgaaatgattcaaatttcattgcatgatctgtttgtttagttctttgtcaatgcagccatcaattctggcttgcttcagtgcaaagaaagagtgcatttttgactaagtctgaccagctgaagcattctttatattttctagtctacagtgaacaatgttctatatcagctacacattattgaatcagaattgatcatcttaaatgattaaataggctggactcccagacggtgttgttaacgtggtatctggttttggacctactgctggtgctgctcttgctagtcacatggatgtcgataaggtaaacttgtggttttcttgtaattcctgtattttacagataatggccagaaaacagtgcaatatttagatttatagtattaaaatatttaaattcagttgcattctaagattttactttcactttcaatatagattgcattcactggatcgaccgatactggaaaagtcgtccttgagttggctgcaaggagcaaccttaagtcagtgacactggagctaggaggcaagtctcctttcatcatcatggatgatgctgatgttgaccatgctgttgagcttgcgcattttgcactgttctttaaccaggtaccacatgataaattatgtcaaagcaggcacaacaactttgttcattagtttgaaatctctaaatgatttttcttgacttaaaatttcaagggacaatgttgctgtgctgggtctcgtacatttgtgcatgagcgtatctatgatgagttcgtggagaaggccaaggctcgtgctctcaagcgtgtggttggtgatccattcaagaatggtgttgaacagggccctcaggtacatagtactgactagcacattcagccttcatactgcctgtccttcagttatccatcacatggccatgcattgatgtggtataatcatgcaggctttacattaattaccttcaatcgtattgtcaagtatccagtcatcataacacattcaggttttggactgatgataaccttgcaaattttgttttaatacttctagattgatgacgagcaattcaacaagatcttgcgctacatcaagtatggtgttgacagtggagccaaccttgtgactggtggcgacagattaggtgacaaaggttactacatccagccaacaattttctcggatgtacaggtaattaagcttaggataacgtcaaagaatgtcagcacagattgtccttctcctttgttgcctcatcttcttaacacttattgtatggtgattgcttcaggataacatgaggattgctcaagaagagatatttggccctgtgcagtccattctgaagttcaagtgagtaaacactccatttcacatgcatcctgtcccaaactcttagcagtaaccaaattaatcaagaactgaaccgaagactatatatattttttaagataaaggaagcttttattgatctcagacaattacatcaagttgatacaaccatactaagaacatttctggcctctacataactaggatgcacataactgacaaaaccataacgcaatttatgctatgtcgacagtgatctgaacgaggtcatcaagagggcaaatgcaagccagtacgggctggctgctggggtcttcaccaacaacctgaacacggccaacaccctgacccgcgcgctcagggtcgggaccgtgtgggtgaactgcttcgacgtcttcgacgccgcgatcccgttcggcggatacaagcagagcggcatcgggagggagaagggcatcgacagcctgaagaactacctgcaggtcaaggccgtcgtcacgccgatcaagaacgccgcgtggttgtaaacacatagatgtttggacatttcagaactggggaagaaataggtataatcttatggacggatgcgaaaatggcgataaattatggcgataagattatgatgatgatgatgaagaagaagaagaggaggaggaagaacagctgaaataagcttgtcctagcatggggctggcattgtctctaataaaccttgtggttggtgctcatgttactgatggagtatattgtagaagcagatttatgttcattatgaaatatatatcgcttgtttgggataattctaccgtttgtgctgctctcacaattttctcacaagctacttatgaagctacttttcagcgattggacattttttggtgcattcaaaacaagaaaaatcagtaaaacatgattaatctgaatcaagtattagttattataaaattaaaaattgatttatttgattattttaagaacttctctatatatagttttttatgaatcatattgtttagctattctaacagctaatacataatgagaaaatagatgtttccagaagcggtttagagtgctccctggttgttgaagaaagtaacgttgggtcatgaaagcggcggtaaggttgttcaccaaagttaatacagggcctgttcactttgttgccaaaaaaaacttaccaaattttgatattatttggcagtaaactagatgtagctattttttttttacaactttaccaaaatttggtaaggttaaaaatagcatcgaagtgaataggccatgtagcgaagcggcgtatatcgcctgtcgtcattgttcaaggtcacaactaaaaaagcactaaaaggtccgactgtgcttttgtatctcgaccatgagaacacgctgggtcaataaatagtaaaagtcttttgactggtcatggcacgtcatcaatgcacgattgattgctataaattcctctcaattacttcaagttcccgcagagagatcgctgtttacacgagggatgtctcctttctctcatccactttttatttaagggattagataaaaaacaatcggaaacttttaaatataactataatataattatattataatctctatataatttaggtataaagttgcatatattattttagtacttatattggctatgtatattcgattggatatttgggatgtagaggccaagtttattctattttttaaaaattattataatacttatacaatatagtgtagtgtggttatagcatagttatagtgaaattatattacaactatacattaggttagatttaaaaaaaatcactcaaaaaaccatatgacagtttttttaatgatatcttaatacttgtgtattcttggcacggcattcagcgccagctgacgtggcgttgaggtgtctaagttcagcgccatatgatttggcgttgagcagaagggtcagatttgaaataagttttggcagcggttcatttgtaaaaatagtttttgcaaagggtcaaattgtcaaaatttgtgcagatctgcgctggcgacggcgaggatggaaggcagtggggctcaacggcaccgtgggtggtgccgaggtgcggggtccgccgtgcgaaggccccggggctggtgctgctcctttgccggcgtcccgcagagccccggcctccgtcctatcccttcttccacctcgtcggccatggcgtcttccctggcactgggaggagtgggtggggtgcggccgggaggaagctgccgcccaattccccctcgatctcgtcgtttcacagctcgccgacctcgtcgaagctggccgggcttggcggcctcatcgacccccgctgcatcctctcccccgcccgcatctcgcccatcaatctcgacgactttgtgtccccgctcccgccgccgccggtgatgcccgcagcggagacagtggtggtcccggcggagacggcggcagtggtggcgccgttggtggtggtctcgaaggaggcggattcggcgggcgacgaggcgctggatctgaggcttttcctgcaggggagggatgggaggtgcgtggtgatggagctcgacttcggggtgctctgcgacaacatcaccttcttcgtcgccatggcgccgcacccgtcctccccgccgccgcctctgttgtgcgtcggcggccttcttccctcggacagatctgggagaggagagaggaggggatgggagggcaggggtggcgccgccacttccttcctctggcgtcgcccagtcgccgaacccggtcgtcgccgccggtcaccgccgccgtcaccggtgggggtgtcgagagggaggagaggaatgaggaagggatgtggagagaagaggagttgatttgaagagaagaagaggagagggtgtggagagaaggaaaaggtggtaggtgggtgattttaaatgtgaccgaatgttttttttgtgagagctgggttttcaacagcggttctgttttttttggccgccaggaaaaattcgaccgctagcaaagattatctattttcgctggtggcgcacctaagtgaccgaaagcaaaaatagacatattttcgctggcggtcgtattagacgggcggtgccctccaccccctcgttacgtatttgccagtggttatcacatttttcgaccagcaaaaattataagacaacgccatgaaaaatcatttttctattagtgctacttaaaaaatggactttcgcaagcagccagaacccatttttgtaggcagccagaacccgtgtttgtgaaaatcaacacctttccaaacgggtaggttgccgctccagttgccgccgccaatcttgttgtccccggtcaggtttggtggacctgtcactacagtgtgcaccggtgcgtggcgggatccgtccagtccgggcctaccgccaccagtccacggattgagtgagtctgtcgttccagtgggtgacagtggcaaatccgaccagtccaaggccgccgctgttgctcccaagcccacgcgagggagtcgttgctagatccaaccgccgtggacctgaggaagccgctgctgttgaccccatgcccgtgcgagggagcctcatctgattcggccaccgcgagcctcgacgaagctgccgccgccgcttcagttccgcatgaaggagccattgtcgccgccgccaccttgtccacctcttgaagtgctcgccagcgtggccgccttcactggtctgtgaaagtggaggagaggaggtggagtggggtgaggggaggagaggatgagggaggagaggggagatagagaggggagatgataagggttagatttttaagggagagtggagtgggcggctagctctttgggcttgtagcaggcggtccacttaacaagtccacttgcgaaaataggtttattttcacagacgagcctattaagaggcccatctgaaaattgatttttcatacaaatctttttttttcattgcggataatgttatacggtcagtctggagactaaaagggggcttgtccataaaaatcgattatgtaatagtgccgtgacactccctatactatatatcatgtttaaattttggtcgtaaatattaaatatgagagttttttcaatcgcaagatcaggaaggaatttattgttggcctctatgatcctatttggagaagtttctagctgctgcagctattttcagaaactgtaactgttcgaaacataatctagattatgagagaatctatggctatagaattcaaaaaataaattagaagttgggttttgcagcttctctagaccctcacagtctgactagcagctagctgtttctgaatctgagactagcaactaccagctaactgcatctcgtgatctttaagtttttcaaactagtcctatgtatttctcgtgttggttagacagttcacttattgttggtagctagtgatctggaacttatgtaagatggtaccatttttctcacgttggtttagacagtgcacttattgttgcgcatagtgggctggtgcttacgtaagatgagacttaggtggaggttggataagagacttaactttagtctctgacactaatttagagtattaaatatagactaattacataaatgaaagctaatttgtgagataaattttttaaacctaattaatctataattagataatgtttactgtagcatcacataggctaatcatgtattaattatgctcaatagattcgtcccgtgaattagtccaagattatggatgtgttttattaatagtctacgtttaatatttataattagtattcaaacatccgatgtggtagggacttaaaatttttagtcccatttaaataggtcttataaaaaaaaggatattctgaacttatatagcgagcgcgaatgcgaagacggacgcacacaaacgccccaaaccaaataaccaattcgcgagcctcttacggacgaacggtacggtgtagctagtgtcgtcggtagccgatcgatcgatggcagctgcttcgccggagctccgtcacgtggccatgctgccgttcatggcgaagggccacgccatgccgctcctccacctcacgcgcctcctccttgcccgcggcctcgcctccaaggtcaccttcttcaccaccccgcgcgacgcgcccttcatccgcgccagcctcgccggagccggagccgccgccgtcgtcgagctccccttccccaccgacgacggcctcaacgacggcgcggcgccgccgcagagcatggacgacgagctggcgtccccgtcccagctcgccgacgtggtcgccgcgtccgccgcgctccggccggcgttcgcggccgcgttcgcccggctcgagccgaggcccgacgtgctcgtccacgacggcttcctcccgtgggccgagctcgccgccgccgacgccggcggcgtgccgcggctcgtctcctacggcatgagcgccttcgccacgtacgtcgccggcgcggtcacggcacacaagccgcacgcgcgcgtcggctcgccgtccgagccgttcgaggtcgacggcttgcccgggctccggctcacccgagccgacctgaacccgcccatcgacgagccggagccgaccggcccgctttgggacctcgcgtgcgagaccaaggcaagcatggactccagcgagggcattatcgtcaattccttcgtggagctcgagccgctatgcttcgacggttggagccggatgtcccctgtgaagctatggccggtcggtcctctgtgtcttgcatccgaactgggccggaatatggaccgggatgtatcggattggctcgactcgcggctcgccatggaccgaccggtgctgtatgtcgcatttggttcacaggctgacctaagtcggactcaactagaggagatagcgctcgggttagatcagtctggtctagatttcttatgggtggtcaggtccaaatggtttgattcagaggaccatttcgagaataggtttggggacaaggggaaggtataccaaggtttcatcgatcaagtcggggttctaagccataagtctatcaaagggtttttcagccactgcgggtggaattcggtgttggagagcatctctatgggtgtgccaatacttgcattcccaatggcagctgagcagaaactgaatgcaaaatttgtggttgatatgctaagagttgggctcagggtttggccacagaaaagagaagatgacatggaaaatggattggttgcaagggaagaagtgcaggtgatggcaagggagttgatatttggagaggaaggaaaatgggcatctactagagtaagtgaactcgcagtgctttctaagaaggccatggagattggtgggtcatcgtataaaaaactagaggagatggtccatgagatcagtgagctaactcgtgataagagtatgtaactatggttatcggtgtttgctagtatttcggttttactaaatgtcacatttttcacttaatttcaatagactttttttcttgtgtgattgctttatcttctatacgcgtaatcatgccttatatctctcatatatacttttctatatatacaacaaattgtgttgatttatgatccaaatttatttgtacatgaataaaggtcagcttcggatgaaacgaagcgttgtgcacccgggtacggatcgttattcttttagggtttcaccttcatatatacttcttttaagccgtcgttcggcgttgtaacctcatcccggtacagtgaagatattttgctagctggcacccgtgggttttttctcctgctctgggagggttttccacgttaaatctcgtgtcttctatgattgatttattgtttttttattgtttcctaacaagttgaaaactgtgattgcaatgtaattgtaattacaaaataagttttgaaatttacaatttaattataatgcaaatgtagtaaatttacaatataaaaacgtttttatttttttaaaatatgatgttataaatataattactcgactactattttgtgaatttataaatttgtgctcgggcttaattttcacccataaaataaatggatattacatactccatctatcaaaaatgataatctaatactccctccgtatttttaatgtataacgccattgacttttcgaccaacatttgaccattcgttttaatcaaaatttttgtgtaaatatgaaaatatttatgtcatgcttaaaggacatttgatgacgaatcaagtcattataaaataaatgataattacataaattttttgaataagacgaatggtcaaatatgacaaaaaaaagtcaatggcgtcatgcatattggtagtatgtacgtagcctatataaattcatgttcatgtatatataagttgttttttttactccgacttttatggcggatgctacaccgaccgttctcttggctctgtgttcgaatcctgcgctgtgatgtcaccgttatcatacatacatgcatattctcttctttagcaaaggttgcgttcttgcagctttaaaagaaaatgctttaattaatcctttctccatattttaatgtatgacgccattaaatttttaaccaatgtttgaaaactcgtttaattccaattttgtagtgtcatataaacccacaacttttgtggataaacccactgttgatgattcgtcaagtcataaaaagattgattaagataacagtcattttcgacttaattataatatgagcggggcagtagtaacttactattcttgcatactaaatgtttgggtacgagatgcnagntctacctntnaccatg

SEQ ID NO: 61991 - DNA, 26639 bp, Oryza sativa
tttataaaacctttttaactttgtttatttcttctcagttattatttgtgctctgaaaattccactaaaatttatttacgcattttaggcttttaggaaatatacaaaaatcctccaagccttatttgacttttaaatttgcacattttaattgttggaagctttcacatggattttaattattctatgcacaatttcgaggatgtattttagagtcgttttgggacgcgacaggttctcccatccgagctcaccctgaggtcccctcgggccaccatgtactgcgaggctgttcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggcgtcccccggctgggctccgttcggctagccacgggcgacggcacagagctgcctaacccgtggaacatcgaacaccttcgtcgcttctacccctaagggggatcaggtgtcaggtttcgggctcgggccaaccccgcacccccctcgggcgtgcagggttggccgggggctaccacatatgcatattcttttttctcttatatctgtatttcaataaaagcattttcaatttcctaaaggctgtatctgtgctgttattttcttttgaagaatcttgacttgaaataggtcactcgtgctcaatcttgccctcgggggctcgggtcggctaaaatcgccaaaaggggcccagaaccaagccatgccccggggcgtggtgaactccgggggggaatcggcaaaaacccacaatcgggtcacccataaccctcggtcaccacgctcccggcctggccagtctcgacacgtggatctccccaggcactagccccgacccgcgccttttgaggactgggacctgggcacgagcccttagtcaagctaagacacaaaaggaccacggcacagatcatcctcatcgcatacacatagcaaaataaaattgacacagaaatttctttattttgattgcagattaagtgaatctatacaaaaaggaggcccgaaggccttcgaagaagaaagaagaaactatttaaaattggcgggggcctgggggctcactccgatgcacccggatcgccagcctcgtcgccactgtcgcccactccgccgtcatcgtcctcctcgtcggagttgagggagaacgcgagctgaggggccgaaccctcgaagctgtggacgatgtggtcggcggcgtcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcctctcgagctcctcggggagccgttggagagtcccggccatctccgagaggcgctgggcgaggcccccctggttggtggcgtacttcgcagtccgcccgccccagagacccgcctgccgcccggcgcggtctaaacgggacacggcgtcccgaagcatgccgggccctacctcgcctgccaagcggagggcctcgacctccctggcggacgagtctggcgcgccctgcagatccgcgatggtgtgttcggcagctgcgaggcgggcggttaagtcgctttcgcccgcggccgccccgccgctgcgtgccctcgcgtccagctccttcacccgcgcctagagctcagcggcccgctggttcagtgcggccctctcggcgcgggcaccttccagattacggcgcgcctgctcctcccgcgctgcctcgcggagggacaggctgtccgccagccgctgcgccgcggcctcggcctcctcgagagctcgctcccgctcggtgagcgcgtcctcgcggaggcggagtccggactcctcttcggcgcaggcggcctcgtgcgccgccagcgttgcctcccggatggcaacggcggcctcgcggtccgccaggtccctctccacgacgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagcttcttccccagctccgcctcctagctcccgtattgaaggcggagggtgtcctgcgtctcgttcatcacggtagtggcgatgagggcagccccccgctcctcctccacctccttggcaatctcccccagcaccttccgacgggcttcgagctctgaggcatgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaggcctgcagaaggggctctgcgctcagtggggcaacggaagacgtggggaagagccgcctcggagaggatgccgcgcggctcggtccgccgatggacgtgccggactcggggatgtcccccggacctggtttgtcctgagcgtcgcacgagggagtgggcccaagcgatgcgcccgcggcctcgtcgcgagctgcctcggaagtcgtcatcgcctcggcctggcgaagtcttgcctcctcccgagcggtttcttcagcttggcgagctcggacggccacctgggtagcttcctcggcttcccgaaggcgatccgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgtaggcgatccgcggcttctcgccggtcagattcccgcctccgggcctctgcggtcgccggatcctcggcctcagactggccggacttggaatggcgggagggacgcgacgggatctcgctgaaacagaagaaagaccagaagacaaacaaaatgggtgagtgaaaactcgcgttgagagaatgaatacagccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcacggcaccctccgggcgcctgctgctggcacgcgccgccccgccccctcggggaggagatgggggaggggttccttcctgcttcctcttcccccgggcatcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttggggaatgagtgatgcctccacggagctgagattcagcacccgttggaccactatcttgaagtcctcaggagcccagtcccatctgaccctctggtgggtcctcatgtagtcttcggacccggtgtactcccaggcgccccgggcgcgccgctggagcggcgcaatccggcgacgaaggtagtcgccgtacaccatggcccctatgagcccctgggatcgcaggcccgccaggcggtcgaggacggcgtcatagccatctcccagatctaccggcgtccgccagctggaggcctgcgccgggggctggctcggaagtcggaggcgcgcttcgtcagcgaggggggtgtagaaccagttgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcagattccggcatgaagcggcgcggcagcccggcctgcctctcgctcacgatgcgggaaggcggcagcacgctaccatcgagcagagcggagccccgtgccatgacgccggaagaagagatgtttgagagcgagcgcgtgtggcgagggtagggcacaggaaacaaggagttagggcgcaagcggtgaagacaaggagaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtggatatgcggctgtggcagtcgagatggaacatatcgtgcgcgcgttgattacgctcgccgaccgaagcgccatcaccatatctcaaggtaaaacgaaccggctcgtcccgattcgtgtgctactcgagtaatgtggcagtcttgaagagaccgctcattattggcagccgagttaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggcttgggcaggagcaatcacccacgaggcctgaccccctcgggggggggggggtcgggcccgagggtgatgtggccgcctccctctttgtctccccgaggggtcggaccgctcccgtttcggccccgaggactgaggcgccccgaccccttgtggattttgcgccgcgtgtatgggttaggtgagcgcagagcggggctcacctaaccgcatttattgcggtttggacgagcgcgtcacgctgcatgtaacgcagtgcagcgtgctcgtttatccggtctgtgactggtcacagaccgatcagatcgtgggttacgtggcgacaggcggtctgacgcacgcctcgccccatcccgtcaggatgagagcctccaagcactcgtccctagccggagccggcgtgttacctcctggagatggcacgttggtcccggtcagatatatgccaggcttcatcctaaccattacaagcaagatattgtatgaagaagggcgaacatgcagattgataaactgacgcgtggtggacaagaatgaccgatttgtgaccggtctgacactggtcatgtcgtcggcagacagccatgttcccacgtcgcacctgcttccggcgaaagtagaggtaggtatgggccgtcccatcagaagatcattcggacggcaaccatacaaatctccgtccatttatgaagagaaggcaaatcaagttggagaaaagagaggataagtccccacacaaaagagagagatggtgcatgtggtatccccttgagatataaaaggaggaccttgcccacttagagagagaggaaaaagggatggagaacgatccgagactgggattcggaaccagaaagggagagagttagagttctctggctctccagctctttgtagcttcttcatacacagatccaccaaaacacaggagtagggtattacgcttctcagcggcccgaacctgtatacatcgcccgtgtcttgtgtgttttcattctcgcgaactttccacagaccgagagcttagaacctcacccagggcccccggccgaaccggcaaaggggggcctacgcggtctcccggtgaggagccacacgttccgtcaatatatatatatatatatatatatatatatatatatatatatatatatgcctattcctatataattagaaccgactactcggcaggggtggatctagaaaatagagtagctagggtcactactcaaatatggtggtgtgtcaatacagtaatccttgtttctagagtgtgttagcaaagtgattagtaagaaatcatgggtgtcagctgacacctgcttacactatagatccgtctctgttactcagcatgcattgagtcacatcatccataataaaaggaaatgcctctatggtcacaataaactctaaaacatttgatttttctgtatcttctctccaaagccctaatacgtgtccttgaacggcagctgttggtgccactgcatgcgtgagccgttcggtgaggccaaggcagagcagctttgttcgtggcatcgatttctgtttcccaaagacaaattatacacacatctagatgagaagaacttgcatgacgatctacaaatttgtgcaagaattattttaccatggatgaaaaatacgtaaatattagaaaatgatctaatattaagtataattagaagggggtgagcttttaaagccaaatcgtctagccaatcaccttatgaagctagccggaagaccatgggctgttctcatttttccatggatgcgtgaatgtcatcttacatacgtgccgtgggggagatcggtagcatgtgcatggcgaggagcaatgtcttgtcactcgtgtggctggactcgtcgaacaagaacgtagtcgagaacacgacgggaaggagcgacacgggtgaagagagggagaggggctgactgacgtgaggacctactaatttattactccctccgtattataatgtatgacgccatattttttaacaagcgtttgaccactcgtcttatttaaaatttttatacaaatataaaaatacttatgccatgcttaaagaatatttgatgataaatcaagtcacaataaaataaattataattacataaattttttgaataagacaaaatgtcaaacgcttgttaaaaagtcaacggcgtcatatattaaaatatggagggagtattattattatatctggctgtcatgtaggtcctattgagtttttttttctatttttgtttttttcttttagtgtcacgtaaacatcacatgggttgggaggggaataccaaatccagcatgtgagattgacgttacgtagaacaaaaccattgagggattagatttatactgattttgatatctgggtgacgttatgtgtttggatttacggttgagagacaccaataaaattggacccatacttaaggggcataaagtggacttctctcgttgggagttggtggtctagcggtttgtggtaaaaattggaaataagtctattttgcctccctcgtgtcttgtccattgtagaatcgtatctctcggctctctcaagttcaaaaactagtgcaaattaactttgatggttttgatagcagtattgctgatgttgcaggttgacttagccctgatacgctgacgtggcaacccaatctttaaaggatttgaaaatagaagtgggtcccacatgtaagtgacaaggagtaaaaaataaaaaacggtgggggtccatacttctcctttttgaacagcgacgcgcgtagtagtgttgagtatagatggccaactgggctacccggcacaacacggcccaagcccagtcgtgcctgggccgaggtaattagtcaggccggcacggcccgatcgacacgccgggccgtgccgtgccagcccacgggcggcatacacagcgcaagcacggcccaatacgactcgggtcgtgccgggccagctcgaaggcacgatcccccatcgtgcttttccacagaaaaagtctatttttcattcctcaactctgtgggctatgttcaaatggttggagaataagtctatccgtattcctatcttctttgggccttgctttatacagttatctgagtctattttgcatccctatattttttttttgttcgatcttgccgtgccgggttggcccaccgtgctgagggtacaatctaggcacgatccggctgtcggaccggaccggcatgggcactaccctagtcgggccgtaccatacttgggtcgggccaaaatggtgtgtcttaggccgggccgcgggccttagtccatatggccatccatagtgttgagcacctcgtcgcgaactgcttctgtaacgcaccgttcttgtggtttgcctctcctgtccgtcagcaccatcaccttcggggacagcgacctcaccaccgtcaggaagctacccagctattaaggagaagaagtgttttgtcttcgtgaagaactgaatcaatataataagcgagtctttttttcttatttatgtggaaatcaattgctgtagcatgctttcgtggagattgatgtaacgcacatcgacatgatcaaactgaacgtgtaggttgatctgatgctgtttagctatatccaaacggtaccctttgctgttgattatctgtcgcttaatttgttataagttagataatggttttttttaaaaaaaaacaggaaaatattattagaaacatagaacatgagttattttacaattgataggagagaagtcacattgcatacttctggcatgacaatggccctgtttgaatccaagcgataatttttagccctctctcaaatagcccaaatagccccaaaagatccaaaagggtgagctatttgaggactatttggaaatagcccacccaaaaaaactatcccacccaaggggtgctaattggagctattttgggtggggcccacagcttttatctctcccacagtcgcacgggatcagaaaaaaggtcgcgcatcctctctctccgcacgaccgcgcgcgcaggcgcgtagcattttcgccgccacctccttcactcctcgccgccgcctcctccactcctcgccggcccccaccagcgccaccgcctccccccaccagcgccgccgccgccccacctccagtgccgcctcctccccccaccagcgcgcctccccccaccggctccccgctgctagatttgttttcttctccatggaaccggccacaccaagacacatgcacaacagatccagtggaaaaagagagtaaagggggtagttatgattgggaaagtgtactaaaggttaaatagctcttgcatccaaacagctcaagggctatttcattggagggctattccttgagctaaaaaatagctctcaaaataactctcggctacttctccaaacagggccaatgtctccaaacagggccaatgtctagtatatgatttttaatgtacacatgtaacgacgtggagggcgggtctcacatatcggtgaccacgtgcctctaactttatactccctccattccataatataaggcacaactacattttggatgttccataatataaggcatgcatgcatacaattaattaatacttcttcttcattaaattattactttttaaaatcctccactctcaagatctctaattctattggatgcatgtattacatttattagggtgattcaaactaagagatgataataattgtttattggtctttaggttaagggtggttctgccttatattttaaaatggatggagtattagaatagtactgaagccattattataacatgagggggccagaacaacgggctaagtaatagaaaaaaaatagtttaagtacaaaaaggtttggcttcaaacccctattgataataaagtactctatttgtaatattacgatgtgtcccattctgtactatttttttatattttaggacacggtagtatattatatgttttgactattgttatcaattgaataatttttaggtttatcatgttacccctagcaaaagaatacataagaaaattaaaaaaataacataacatttgttgatcaaatttaacttacggttactaactatatcgtaaatattgttgattttatttgatcggcttaaaactaacaaattaaggcctacataagttggtaaacaaagaaattacaatttggctagcaaaactgtcgttctagcaaaatttctacctcgtaaccattattataggatcgagtgacctgcagaccggccgagttttggtcaaccgaccctagtaggtcaaatagaccatcaaacgtatattcgattatttgatttccgctgatgtaatctaccattcacccttctctggtaggctttgttacctgtgttcgatcttataattatttcacaaaattagagtgaacctgtctactgtcggagtttggagcagtcgaaaccttcacaatttggtgtgtttacatactgttacacatgcaccctgagcaaacaccaggctaaaatggcgtagactccaaataccaaagcatggctgtcatactcatacgtgatttactagtacaggatgggacctaatgtactaatgcctgagataatcatgtcgatgcctgagataataatcatgtggttaattaattagctggtacttaaaaaaataattttgttggaggagaccaggcctctgctcgccacccctgtggctccggcattgcatcagagcatctcaatcgtccgtcaacaataaagccccggccattgtacaacgcaagagatagtatttttcagcgagctctttccctccaataagtctatttcaatttgattataagtaccgatacatgtgtgtcaagatttattaacatctatgtaaatatgggtaatactcgaaagtcctataatatgaaacggaggaagtatattcttacaatgtaaataatttctaagtatttatgcttatcctgctgaccatatatatatatatagaaaacattatatactatgacatattgctatctaagccttattgattacaattttatctgtaatctttttcgtttaatgcagaccatatctccaataatgaattcgcagcgatgtccattatgagctgtaatctttttcgtttaatacagatcgcattattccacatatgagtagcagcaatgtccatttataaaagatcaacgcttcggccaacgacattagcctagagagtacacccaatcattttagcttgcaatcgctctcagaatttccacattaaactagctaggatgaagttacaattcggtgttctattgttgtcccttgcccttgtggtgcagtgctcaggtatgtatttttttttccatttcctactccaaaacggaaatattagggaatgacctaatatgtatattaaggaatgacctaatatcaaataattagaaaggatgaggcttcgaatctaggtcgtctagcccaccaccttatggagctagccggaagacccctgagcatttctcccatttcctgttccgttgaaccgaatgaagtttgaaggattttttatggattctaaattttagatttttttttgtatgtattgtttagaacgaaagatatgattacagcaagtcatatcaaaaagcatttgcattcatccatagttccatcccttaaaaaggaacatgaagtttcacagaggaccctattaattgtttttcaaacaaccaagtgttagaagtaggcttctttctgggtgtgtttagttcacgctaaaattagaaatttggttgaaattggaatgatgtgatggtaaagttagaagtttgtgtgtgtagaaaagttttgatgtgatggaaaagttggaagtttgaagaaaaagtttgaaactaaacaagtgctctgttaaatttttttattttctgttgtagatatggcgaggaaggtgataatggcagatgaagaaccctcatcgacgaacccccaagattcgtcgtgcggatctatcgtcaatccagggccgtgttttccatcgtcgtgcaaaacttactgtaaaatccaggttcccccaacgctgatggcaactgtacgcctgacggatgcaagtgcacctactgcttgccgccttcacctccaacaaaacaaggacgatagatgaattcagtccaaaaaggaataattcttgtgtggctcgtttggtttgtatgattaattcaagggaatttggtaggacaaaaaggcctccaaatctagtataactaggattcaaccccgggcatgttgtggggctggtagggtttactagctattttaatatccacaaatatatcaaagggatcgaattttcggaatatttcagaacttcacatttttaagatttggataaatttcatataaaaaattgaagattaaaaatttaggtgaaatagtttcatgttgggaggttcaaaattttttaatttcccaaaaatttcaaaccaaataataaacgctggacacaagaagggctcgtgctcgtagtcgtgggaggcaaggatccaccacggctcctccgcctcctgcagctagaccatctctctcgctagaagtagggtagttaggagcttagggcagttaggggcttagggctacagtctgctctattcaaagattattttttgcaaaatcacaaaagccacctcatgggatatgatgcatgagtagtttagtaccatcttacctattttaggagagggagacctccttataagagaggatgtgctctactagccacttgaggcatgtaaggtggagagaagagggggaacacgcgcttgcttgcctcgcttggcatggcggcgcgcgttctgccaaaaaattggtttctcactcttgcgcacatgccagcctctttttgctgcgggaaattcaaatttgataattcggtgcgtgaaacggcgtggagtcccaaaattggttcctcactcgtgaaacggcgtggagtccggataagttacgcgcgacttatccggttcgaataatctggtgcatgaaacggcgtggagtccgaataagttacgcgtgacttatccggttcggttatgcggagcgaagttttgttttgctgcgagaaattcagatttgtttgttttggaaatactcggaataatccggtgcgtgaaatggcgtagagtctggataagttgcgcacgacttatccagttcggttagatcgtgcaggcgtcctgatcaagcgtcataacatctctatataagttaagccgccgcctacacgcaacacacgcgaaatcaatctagggtttgcctcctcctctgcaccgcgctgtcgctcgtagtctactctatcccattcgccggtgtgcagcggcgatcggaagaaaaggtctccggaaccttcgctttcgacgtcctgcaccaggagaaaacggtaataaggtttttgggaagcgctttacaccactgctccctgttcgaccacaacgactcgtcttccttttcgctcgtgtgctgcgcgctaccgtcaaagcccggaaccacgagtacttcctgctgggcaaccgttcttccagtaccctcggtacgtgtttagcatattacgcatattcgataagtttacatatgtagatcttatgatgcgtttatgctagtttaaatatgcaatgttatgatttatttatggaataaattaaatcattatatgttcataaattaaacataaatatctattgaaattaaaaattaaaacataatggaaaaaaaattgtaaattgtaacgttgagctctagagttagagttaggaagattccgataacgccctggctcttcacacgaggattttcaccggtggacaaaccagccatcgctgtcatcttcatgctcgtgtcaacgcgcctgctgaacttattctaatagacctagtttgattcaaagtttaaattttggttaaaattggagatgatgtgactggaaagttatgtgtatgacaggttaatgtgatgaaaaaggatcgaagtttggatccaaattttagatctaaacacagcccaacttaattcagaccaacttttttcagccgccgcggcggcatggccatctcgatccggcaatgtgtccgtgtacacgaagtgcagcaaatctcatccttagttctgctgctgcaaacctttttttttttgccgaagaaaattctgctgctgctaacaattaatcagccatttgattatggtatagcacattattaagtagatagataaagtatgaaccaaattaagttttagtgtttagaacttaaaccaagagagaatctatgctatatatgccactgagtttgtcccagtttaatgattttcaattccattgacattgtcttttctataatataccggtaaatttattaattattttacaatatagcatttggctaaaccttgtttccaaaaatacctaaaatacccttgtaaacatacaaagttaacaattgatttttcctatcatgtgtttcaaaacaatcatgatttcattagcctttttacacaatgtaaaattttgtgtacatgtttcgagacttttgcatttctatttttcttataaaatataatttatctgttatatgttacatggaataattttgtgttgatgtttttaacgtaattcatcttttatatgctacacaaaatatttttgtgccattattttttttccataagcaatttctagatatatcatataccacacaaaaatatgtttttttaaaaaataaatataccaaaagatttgaaacttatatacaaactttcatgttgtgcgacgatgctacataaaaaaaatcatatctttaaaagtttctatcagaataaatcaattgttaaccatgtatggagtatcttaaaaaaatccagatcaataacatattatagaaaaattgataattttgtttgtatattatagaaatggacaatgttaatggtaatttgttaaactgaaaaaactaagtggtatagaatggtaaatcgttgaacagaaataaataaactaagtaatatagactaatggattctctcttaaatctttgcaaagtactagagcatatttctgtcgtcaagcaaagctagacttgattgaagttaggaatctggcatctcctgcactgagagctaggaagcaaagcaaagcactaagcatatgagcaggcttcagcgtgtccaggcaaaaaaagggagcacgtacggctatttacgtacgcatgggcgatcatctataaattaacaacggccgagatatagactatagtattcaaactgcatgcatcgatagacatatattcatttcaatcctttcttgtgctctaggcgtgtcatcgacatgaggccgctgagagattatcaagatggctctgctcaatacaggtaattcaaacaacgtatttgaccaaactgtaggtactaacactacacgtacgtctttccctaatatgcattattcaaacaattattcgatgaaacaagtgttatttacaatagcagctagccgcccaaatctatttatatatactaacgaaatgtctgtgcattacaacagattttcataaaatatatgaaaatatcgaacaagatgggtaaatatttctcaagaaaacatatatattttgtcgctgagcataacactgtacatagtagatttgttgcagcaagtttagaagctctttgccttgccaatgattatagtggttcaatcatatgtgtatactttgattgcctcaaggtggtgaaaaaaatgtcattatagtattactgcattccaaaagaaactgatgttgaatctaggtagttgaatttgggaggcatacaggctacaaaatcagtcactgacaacaagagcccataagtcaatgatggaagtagtatagacatcataacggtctccacgtcgtaatccatctagacctacgccgcgctaatattacctacattaacgattttcacgttgttatccatctgagacttaccctatctactactcccttcgtttaagcttataagtagttttgactttggtcaaacttaaactatgtcaagactaagagagtgtttaagattaaagcagtgtcggagccaataattttgagcctgggcaaacctaataagagaaaaactatatatagaaaattgtactatttatcatatatgtaagttaagttaattagtgcccagcgataatttatcaatgagatgatggctgtttatcgtcagtgagttagactatagggctgcaactctttgctttggcctcatggttacaaacgtaatgattttgtccttgctttgcttgtttgttggcaaaacatataattaacatccactagaaccaggaagcaaggtaattaggttcaaattaagtagtaaatgatgtttatgccatggagcaatgtgttgttgtgtggtacggagcccgggcacctcccggtacaagccgaggcgccctactccaccacggaagtaaaggattaagaagatcgaaaaaatacgcaaaacaagtgaaccattaggatacaattaactaaccagtgggtccaattatcaagcaataaagttatagctttctaataaaatctcgtacagtatatattaatgttgcagttgtctgaaatgtctaaataaagttgcagtaaattgatgattactacaaatggtcagttaaactagattataagagaatggaggtactagattatttacttaatgataattaaactgctaactaggtagtaatatgtgggtttatgcattgcatgctcagcagctcattggctactcgtgttcaagaagcgtggaacaagtgggagatccagtgcctagtgatggcgagcttctccctgcaggtgttcctcctcctgtcggcaccatttcgcaggcgccacggctccaggctgctgaatggctcgctatgggtggcgtacctgatggccgactacgtggcgacctatgtcctaggccgtctgtcattcctgttggccgcagccggtgacacgcggcatcagttggcgctgttctgggcgccgttcctgctgctccacttgggtgggcaggagacgatcacggccttctccatggaggacaacacgctgtggatgcggcggctgctggacctggcagcccaggtgacgatgtccgtgtacgtggtgggcaagcagtggaaaggggatagattgctggtggctcccatggtgctcgtgttcgtgttgggagcagtcaagtacggcgagagaatatgggcgctcaggtcagccgccgcacgggcacccggaagtagttccattgctagccttgctgctcgcacctacagcaatattgctagtttcattactagccttgctgatgtgctgccggaatcagggcgtggtgtgatggcccattatagaagcatggttagtattagttcacaagacaaggtaagtatcgagagcatcctgaaggaggcctccatggagttccaagcaagcttggactttttcatggacgtgagcccttcaaatgtaagcggttcctactcgaggtaccataggatcaagaatgcgttggtggagatcaagtcttcaaagaatggatacgggatggcatacaagctggctgagatgcaggtctctttgatctatgactacctgtacaccaaattcggcacagttcgattccaaaccttcccaatatcaaaatcaaaatcaaatccaaccatggcggcggcgctccaatggcttgtctctcttggcctaacctctgtggctcttgtgttgttcgctagggccatggccggtaacactactagtagtaagttcaaatatagtagacctgatgttctcatatcttacatactgctcgtgggcgccattgcaatggagatatcctccatcttcattgcactcaccacatcatgctgggcaggcatcgctgtggtcaagcatcttcatctccatgtaggggagtggtcagggaagctggcacaatacaacatggttgatgcatgcgtccaggagagggagagacgacgacagacagcagctagtggcgccgtagggaagctaatccgctggatcctggcaccatgcgacagcgagacaccacaaccacacgtcgttgtctctcttgaggtaaagaagctgcttctgaacaaagtgcttgaaatagcgaccgatgtagacaacaaccgctgggacttcagtaggttccaaggccagtgggctctgtgggtggccaacagagtcaacggcggagacagtgatcctgctgctctaggcccagctcacagggcactttcggctagcaagatccaagagctggatttcgtgtccaccgttgttgcttggcacttggttacgaccatatgcttgctgcccggcgatggccctggcgagctcacaaaccctagcaaggacttgtccagttacatcatgtaccttgtggctaagcatgggatgatggttgatagcaatggacacatcgtgattgctagaagccgaatggaggtgcaggcatcttcgcaaatgcttgattttctcgatgagcttcacgaagatggcttcatccaggaactccgtgatggtgataggcaatataactctccggatatgatcgtacgtcatcggagtagacctgcacttaccacagctcgcaaggtctgtgtggagttgctcaatatcccagaagcaagagatcgatgggagctgattgctgcggtgtggacggagattctatgctacatggcacttaattgtggagctaccttccatgtcaagcatctcaccactggtggagagttcctcacacaagccaagatgctcctcttcgttatacgattgccttttcttatgaagagtcctctggaaggtataataatgcctccatttatgtgagttgttatacatatagaaacactactaggaaaagcattatcgcaagcggccgaaaacggtcttcgcgggcggggcggccgtccgcctgtaagaaaacgactgtgaagatcgccgatcttcgcaggcggggcggccgtccgcctacgaagataattttcgcaggtggacgttggctagtccggtccgcctgcgaaaatatgaagctgccacctgcaaaaaaaaaaatccgcctgtgaagataggtagaaatttttgaaatttaataataatttgcccgtaaatttaataataatttacccgttaatagaaattcttgcaggtagattattatgtacatatattggaagattatcaaacatttggtactaagaaatttacatatattgcataactcaaaagtgttaccaaaatatatatattataatatttttttatattgtgacttcaaatataccatctagttacattatggcatagcagtgttccactcccaaagattcttgaattcgtcacttgtcgctagagcaccctccagagtttaatggctaaatgaaactgaaaacataccacaaagttgagtcaacgtttaatgaaaaatgaccatagcatataaccatcagatgccacacgtacaaatgcctatttactgaattttgaaagaacaaatcaatgttccccctccagctccaatccaacagaaaggagaatgcagcagtctgtacgtagcgataacggtggtgatgttgcagcgcgaggcaaggaggtccaatgtccagaatgtcaatttgagctgaatagggacctgcattgtgtctatgcatgctgaactgcaacattggtgagagaaatgaagatgaaccaaggtaggtgctgcatttttggcacagtggagattttcaaattacctggaagttcaatacatgcgcaaaattctcttaagattcaggaagcttgcctagcagcacaactcaagcgagctggatgagttttacgaaaagctaaaaaatctagataacaatgtcaattgcaaatggaagagtgaaatgccgttgcacaactcaatggattgcctggaatccgaattacaatttacaaaccatgtgggagcaggcactaacctggggccttctgcactggcaaatccaacgtcattgcccctccacaaccgctgaactcctagttgtgacctccgtgccgtcgttccatcgagcaagcattttatcgatcaccttcagtgcctgcataacgcggcggcgatgcggctggcggcggtggagcggccgatggtgtagctggatcgattttggcgcggtggagcggccggcgcgagctcgaaggttggcggcgcgcggaggacgacggtcggcagcggcggaggacgacggtcggagggcgatggtcgcaggcgggcgaggccggatgacggcggaggcgtgtggcggcgaaaaaatttggcggcctgacggcgccaaaatttctagggttcccgcctggacttagaaattttggcgccgtgggtgggcccttatatagggaaacgatcttcgcaggcgggcgatccgcctgcaaagatgatcttcgtaggcgggccgtccgcctgcgaagatcgtttttattatcttcgtaggcggacggtctgcctgcgaagattgttacagaggtgaatatatttatttcaaaatattttttaatttatttttgtaatttgaaaatgtctacagtagttgtaataaaaatgataattgtacatacaaatatacaaaccttaatattattacttttcaaatgtaaatcttacttaaatgtttgaaacattaatatgactactttaaattttttaaaaaattttcaaacaatggtaagtgcacataaaaaattgctactaaattttgaaacctcttttaaaaaaactattaaaatataaaaaactgtaaattttaccctacaaatggtaattgcacataaaaattagtacaaactaatatgcaaaatattgagtacaattgttcatcaatttgcaatatgagcacacatatccccttacatatcaccattacataactaataatttcgtagatgcttacatgccactcaacaatcattaccctttaacatttttgcccacactgtccgtgcgcatgtaaggcttcacggtcttctgagtagatgtctcgatatggagacaaaaacctcggccaatgatacatccattcccgactttccatatctctaaaaaaaatgaacataaaatatttgcactattaataccaaatttgcagggtttattgaaaaaaacatatcgctattcaaaactaactgaaggttaattgtaaattaataaaaaaagtttattttattttttttacacagacatgccaaattaatatattaggaaaagctaacaaaatcttatcatcgacatattacaaactaatataattattttttgattgcaccaaataaatagacattgaaaattttattctctctcatatatatatatatgacaagaagggctgggcattcggtttaaaccgaggattcggttcggttcggctcggttacatggagttcggttttcgaaagaacaagaaccaattggttttcgtaaatactggaaaccgctaaattcgggttcggtttttttggttcggttttcggtttttaccaacaaaaccgatctctacacagctcagtaaaaaacacatccagaagaccagaacaatattttaccatagtacatagaaacaaacaaagtaaaaacatagtacatactacatagtcctgatgctgcaatttaccatacaaacgaacattcaccacacatccatagccataaacattcacaaaaatggtgccggctgcatgctgcttagggctccttgcttcacccaatagtgctggctgccatgccatgtgtgctgcttgctttgctgctgcctggagtggagaagaagaaatactcagctgctagtatatatactcaatcatttggttaggaggagaattatatataccttgcatactgctgcttctttcaactaagaaataaactaacaattttaggccttggtagcattagtgtcctctgtaatgtcttggccaacaagttctatgcataagaagaaacacagttaatataaataataaactaacataagaagtaaactaattgcatcttaaaatgtttcaccttcttcaagcttggacaaatctttggcattttcttcaacactaatagagttgcaaccacgaagccagtcatttgcacaaattaggcgctcaaccattgttggtgttagtgagctcctaaagtcatctagtgttcttccacctgcactaaaggctgactcagaagcgacggatgagatggggattgctaggagatcacgggccatacgagatagcaatggaagcctagttgagttgtccttccaatacttaaggatgtcaaatccttttgtatcctcctcattgtcttctgaaaagtacttgtctagttcagatttggcaatgctccttgaagctccattgttgctcatttgttgtgcaactatagacctcatgagcctcttgcttgttgatagtgatccctgaatatcattaggtgctgctaccggctcattaggagtatatatttctttgtattcatgaaatagggaatgaaaggaattgaccactgttgtccacaattgctctcctatttcatcaccaaacatgaccatagttgccatcttaatgtaactattaagtttataccttggatccaatgctacacagaagaaaacaattaaattcagattttgaacccccggccctatctctccccaatatttttggtacttcagtagcattctcttacccatctctgcacacaacaaatcctcactgttgcaccactgtctcagcaaaacaactacaccagcaatttcatggaagaatgtgtgagatgttggacgacttgttgctgaaacacgaagagtcagttcatagaaatgttcaagaaattcagccatcttcctagctttatcccaatctgatttttcaggaactcctggcccatcatgaccttctaaatctagcttgtaatatgggtcttcatcactgtacctttcaaatgccttctcatattgctgggcaatattaagcatatggtaggttgagttccacatagtgcaaacatctagtgtcaaaaatgctttggtttgtacttttgccaactcagcacatttcttaaattttgccaacctagctggtccggccttgacaaacttaatagcagcacgaacacggcaaatggatttattgatttcttttaaaccatcagccactatcaagttgataatatgtgcaacacatctcatatgaaggaactccccttcagcaatgcatccttttgattcattcaataccctcttcatgtatttaattgcattattgttagcactagcattgtcaaccgttattgacaaaactatatcaattctccactcagataagcaattgtctaaagatttcccaatatcctcccctctatgcccctttactaggaagaagcctatgatttttttatggagcttccaatcattgtcaataaaatgtgcagtgacacacatgtagttttggttggtgttagcagtccatgtgtctgttgtgaggctaaccctctcacaattttccttcaaaaatttcttaagcttcaatctttgcacatcatacactttgacacatgctctagtggtagttcttctagatggcaaagtaaaccgtggacatgctttagccaaaaacttcctaagacctggacgttcacttaagacaaaaggttgttcatcttcaattatcatttcagcaaaactattcctcaagtcttcaatatcaaatttccatgtggaacaagtaccaacactactaccaccacttccaggagtaatttgcaaagtgcgttggttatcaattactggcttgttaggattctttttgcagattttcaagtgatttttcaaagatgatgtaccatttgtcctagggtcacaacgaaacaacttttgacagtatttacacttagctctctcctctccattggaaatttttaccttgctgaagctgccccatacatcagatcttggaacaatagcctttcttttcttttcctcttcctccgtggctgcatgttcattctccgtggctgcttgctcctgctcctcttcatccttgtgctcctctaaccatgcagcaacttccctctccactatctcttcagtgtcctccatctaaaaaaaatatttacaaattacaatccaaaattgagccagcagcaggcaacagcagaggcagcttacattggaggactcctcggttgttgctgccgtcgtataggcaacaccagaggcagcgcataggatgggggacagagggaggacgacgcggcgagccggcgaggatgggggacagagggaggacggcgcagtgaggatagggggggtgtcggcggcgtcgcgcgagatggcggggtgtcggcggcgacggcatgggatgcgtgagactgtgagagagagggcggcgaggggagagggcgcggcggcggcgaggggatgcgtgagagagggcggcgaggggagagggcgcggcggcggcgtgggatgcgtgagagagggcggcgatgccggcgaggggagagggcggaggggatgcgtgagagagagggcggcacggcggcgtgggatgcgtgagagagagagggcggcgacgccggcgaggggagaggacggagccgcggaggggatgcgtgagagagagggcggcggcggcggcgtgggatgcttcacagcttcaggggagattgggagaaggcagcggtaggttagggttagggttagagagaggcaaggcccatgggccggctgggcggctggcggtagggttgtggcgcccggttcggtttttttgggcgaacggttttcatacaactaaaaccgaagccgatccgaattatgcggtttatgctaatctttgaaccgaaaccgaaccgaattaccgaaaaaccgaaaaattcagttcggttcaatgcggttcggatcggtttttggttttcggtgtttttttgcccagccctagacaagatctagatctatatctagaactaggaggtggatgtgatagcaaaataaaaaaaatgagaatttatgttaccacattaaaccactacaacaagagacatcaagtattacacatacatctaacatcaacatatcaaaagaaagtaaattaaaaaacatggaccttttccttcacaattttgcatgcataaatccatcacaaattgaggtctaaaagttcaaaacctcccccccatatttaagtcactttaggagagagaaactttggggagaatgaacagggctcctcgaggaggaagaagactatataggggcatctttgcaagcgggccatataagcggcggctgcgaaaatcgatcttcgcaggcgcacgtcgcctgccgcctgcgaagatagatcttcgcaagcgtcgcttatatggtccgcctgcaaagattgatcttcgcaggcggaccgccccctccaccctgggtatcgtcttcgccggtgggattttggcttcgaagaccatacccgctgtaacaccctgaaaattcgaccaacgaaatcaaaactctaaaaatgcggactttcaaaaactttttaaaccaattgcatcatgccgactttattcgcctgtttcattggattttgatgtcggagtctattaatcgcgaataatgaataactagctaggaacaaaccataaaataaatctagttgactaaataaataattaaaatataaattaaaataaaggttaggtgggtttggaaataaatatcgcaaccatattagcaataattaaattttagtacgatggaataaccctaattaaaataaattatataaacagaatatgagtgatattaaattaaggaggattttagttaggataacacaaatgtgggatgtacttcatttatacaagatttagaaattatgaaatcaaatttattttgaaaataacctaaaatcgggaatattaggaaagtgcactattgattgcccgcaaggtgttcgatgtggtccctagcattttccccttctctcctacctctcccctagcccagccccctcctctgccccgcgcgccgcgcgcccggccgccccgagccccgtgccgtcgcaccgccgtcaccatcgccgctgccgcgccgcaccgacgtcgcgtcgcctcgcgcctcgcgcccgcgcgccgctcgcccgttctatcgccgcgacgcgagcctgccgcctcgcgccccgcgccgctgctgtgagccgtcgccgcgcgcgtcccatcgccgcctcgcgccgcgcaccactgccgcgcccgcacccgcacctcgcgccgcgcgccgccgctgcccgcccgtcgcgtcgccgctgtcgcgcagtcaccgtcgccgctcgcccgctcgtcgccacccgtcgcgtcgccacccgtcgcgtcccgcccgagcccgtaccaccgctgctaccgcgc

SEQ ID NO: 61992 - DNA, 5005 bp, Oryza sativa
tattcgactctccaatttgagcctttccaccttgcaaaattctatctaaaattaagctccaccatgtttgtttacttttgatggagtggtttcttgggttttattagagtttttccttgttttgcgtgccagcatgtagttcccgtcgtttcgaaagtccgcggtcgccaggaaaaaagttcggaagatcaaagtgaagaatcaaggcaagtcacacaatcccattgagcatattgagcctattttataaatgttttaccgtttgcaaataagtatgcatgttttgctaattacatgggatccgggtattatctatctgctcgcttgtgccatgtttacttgatatttgtcctttgtcaaccgggggtaataaatcgactagctcatgttacttatgtaacctagctagaactatatgcttagccatgcttaattaccactagctcagttgatgggataattacagtattagacctttttagtatcagaatgagctgcgtgctcgagacacctggcaatgcttcatggtcgtaattatccaactaaaatgtgactgaatagtgggctgtgggtgcatggttttgctagtcgcacccatggcaattaaggaccggttcgcgggaaaccctagaagaatttatcgtgcttaccacaagccagcgtgggcaacggctgggcttgtagtgtagctttcctctagccgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttaggggcggtcgaccagattcaccgtaattagtcctaccttaataaatcgacccaatgcactgtagtttaggtggattggttgggcctgttcaatgtggtgtagcgttgatcagtggagatttaatgttactttaattactcaacagttttacagttttgctcaataaaatgctttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacgaagttagaagaccaaggctcagatcccaattgagttttgcctgtggagtggagctgaagccccgctaggatcgccttttccgctgctgctgcttttgtttcggtgtgaggactaagtgcctcttctgtaagtatttacgctttatttacgtttggaactttatattacttgtcgttttgtgtaccctggctggtcctggacagggatttaatatacaaaatagtctggaaatttgggctaaatttctggacgtgacaatgaacctggaggctgttttataggagttaatgtttgtagtgggtatcaactatataggaagaaatgatttgaggggcgtcgcgtgagggcgactggacaagtgtcaaagtataaatgaactgtccgttgatctttccttctcagcttaatcgtttaggttaaattggttaatatatgcatgcaactctgatcaggtggagctgggtttagcatgcttgccaaggtgggcgcttcaatcgccttaatttgttaaaacttgaatgtgtagctagtttgcaacttggatgtggatttaagtgccatttggacatataaccattcatggagtgtgtactgctatatatgttgttttgttcccttttgctagacctattgaattttgtggatcatgtttacatttagctgaaaaaggatggattgagggttattaagctagctagaaatagtttattaagctagctagttaagggttatcaaaccatcacaaaatacaaaatgcatggggaattttggtggtttggtcagtgtagtccacggacggaaccgacctacacaccaaaattttcaatgcattttgttttctataattctttgataattaaggacatttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatatatcctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctgcccaatgtgttccttgttaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgcttttttttaaatttgcatgattgattcagtggttatatacctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgctgtctatgtgaatttccctctgctgttgctgtttatgtgaatttccaccctgctgttgctgtttatgagaatttccaccctgctgttgctgtttatgtgaatctccccctgctgttgctgcccctgtggcatatatacccctactgctgttatatggccctgctactgctcttattgctgctattatatggccatgctgttgctactgctctaatttcctgcacttgctcttttctttatggataagaacagatgaactacacttgttctattttatggataagaacagatgaactacacttgttttattttcttcatgcaaatgattgtaattgatgcatatttctcagcaaaactgaggccatatctttcatagtataccccatattacattggatctaatgctatttagtctaatggtacgaaatttataatctttttcgcgaaagttaaaccatgtcaacgcccggcgcaaacccgccctccccaacacctgcgaggatcaaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggattgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcatttcaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaacagtttagggaatcaagcgaggcacatcgcgtactgcaacaacggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaattgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgtgcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatataggaaacggaaagtctccaaggaagagagggacgctcgtttgaaggccgaactta

SEQ ID NO: 61993 - DNA, 36863 bp, Oryza sativa
tagtcccggttgtttataccaaccgggagtaaaaataattggggtctgtcttgaaccccatgacttattgaaccgggattaaaaatgatctaacaccaaccgggactaaagatcaaaaagtacccctcaacttttaaaccgggactaaagatgctttttagtcccggtttttattagaaccgggactattgtggaatttggctgaccgaccaaagatggtttctccaccagtattggttgacttctagttctgcgacataccttcagttcaggagcgcctgagaggagaggcgatgacgatcagtcgatcacaggaatcaaaatcaggcgggcggcaggcagccaggcaccaccgcacccaccatgggccaccagccaccaggcaggcaagcagccatgccgcctccttaggcgggtcggcgatggcaatcagctgattaggcgcactggcgctagagcctagaggtggcaactgcggcatggcgcactctcggctttcgcggtcgcggattagggcattggcgattcggcgacgaaccgacacggctcgatcttgggtctcgcgagtcatggtgtggacgacagacaaagcgacgcgcctctggctcctgctgatgatcgatcgcacgcgcgactgggttactaggctacggctgggctaggagaaaggaggggggggtactccatcctctttagccgatgtcgtatgtcgacatctgcgcgacgacgaggatgacctggagccatcagcggcgcggattggggctgcggtggtgcggagcgtcggcgatgtatggagcaggcaggatgagacgacggcagggggcggcggtcgaggggggcgcgggtataggggaaggctctatgagggaggagggggagtcggtggcggcgggtgacggattggggtggcgccgtttttttttgttgcggaggaatcgtgtgcgcttttttttcggaagaggagttcgtcgctctcaacgtgtcgatgtacgtcgcatgtctaccttggcttcaccatcaccacgtagtagagataactgtgccatgtgtaattgtattgtaaacatatgaaatttccggtgtattaaattagagcccacagctgttcattattttctgatgaaattacacccgtactgggccgagtcgcgcatcccccgagtcccgagtcgcggtcgcgcatcgcctctacgcgagggtgcaaagacagaaggagggatgactgaggcagcggcggtggcagtggtgccggctgcctcctctctcgcgactagggcgccaggcggaggtttgggcggcgccggctggaggtttggacggctgagggctcacggcggcacttggcagtgggagcggctccccacagccacggaggcgcacggcggcgccgcatagaagatctggtgcaaggtaacccaaaccctagactctctccctcaaaccctagacatctcaaatctggttcattttttgggattgattgcctggatgctggttaaaatttccgatatctgtgtctattattgcttgattttttctgtatacttcaaccacattatcactgtacttgccaacttagatttctagaaagatttggtcagcaaaatttagtaccaacttagattggatacttgtactatcgatccatagatatagtttacatgagatgtacaccaaaccaacttgtgaaacaacaaagaaaaccaactgtaacatcgaggaaaaaaatactattcaacacctttgagacgacagagggtgaggtgcacacctttaataaggcaatgcacctcatgtgtaagcctgccagtggggcgggtttgatttggtgaaatgggctggatgctgatttggatggtagtggttggattaattttgaattggagcgggttggcctgtgaagaattgtggtttggactggagtggatgcgggatggcctgtgaggacaatccatggactcagcccatgggttagccagtgcacctgtgcactgcgtgccgccacgcgcggcgcagagcgctgtcaccgccgagcgccaccaccgctgagcaccgttcaccgccaccgccgagcgccgtcaccgccgttcgccgccaccatcgccggactcactccccggtctgcgaggaggcagccgagaggaaggtcgttttaggcctcgtcaagaagagggatcgggcaggcacagtcgcttggcatcccgctctccaccctcgacgaccacctgcgcatcgacctcgccatcgacagcgctgaggttttgaccttttctttcacttctttttgattaattcagttccatgctgattgtttgtcctgcaatcccttctacctttgctaacttccctcgcgagaaaaaaaaagttgtagctttatggagaaagtaggacaaaaaaaaagaaaacttatatggttgtggctaaggaacttaaattggcagctcatgcaggaggtcacgttccagattatgaaggagagaacagtcttagttgtcagttcttgattatgctgttagtggcatgaacttcagtggtagtcaaccatgcaaaaaatttgcccccattgtactcctggatggttggaggacaatctgtcttttttttttttgtcatgcagattagctagtagcattcgagagggtctatctttgtcattttctttttctgctgtgtagatttgcatctgaaaagtggataatttagcaatatgtctctctgttgtaaaggggtggataggaactagtaccaagtaaataatttaatatgatgctttaattgtaatgataaatccagcaagattataccatgatttgcaaatattaatcattcccatctgtaatatatgtcattagtaaaaggaaacttaggcgtatgttggtccaaagtgtcatatattgataactagagctttatgttggatctgaatgactatctcctaaatcattgccaggtctggtagtatgagtgttaatttcatatatgcaaagaaccatattgccagaagcaaaattgttcccgccaacactccgaccacataaaaattcatgaagtatttttgtggaacagtaaacttctgcagattggaaaagatcaattcgagattatcagaaaaatacagaagttgaatatgagatgaactacaccattagggatcctcaattttctggaatggtatcttagcatggatgaaatattttatcatcagctcttcagttttttttaggatcaaacatgaaattttccacgggttgtttcctaactgttgctacctatttctaacttcacaatcaactagtggacaagattcacaaaatatggtttatgagatggctggttcctgattttctagttgatgataacattaatccacaatatttacactgtgctttttgaagaccatctatcatgataagcttttgctcaaaatgttccctcacttttgctattttacatgtttgagatttgtgaagacaattcatggctagagctattagcagatgaagtttcagaattatgcatagacatgcttacatttactacttgtgctaaaaactagtgaaatgataagcacaatgcaaccatgacaatatcatgtagtacagtataaacagagataagtgtgaaaagtaataagattagtgataatcaacagagttaatagaccaaatggtgtagatgaacttgcataataatccaaatatccagtaatagctttgataatccaataatcaacagagatttgaattatttatatttttattagcaactttcaaactgtaagtgttgattttagtcgaattgtgatgctatgagatataatctattatattattaaaggaatagaaaaaggagcctccacgttcgctctcatagcctagaaattctcacattagtcggagaaaaagaaaaacagagtccatatagaaatacaatttagaaatagctaaattcggaattaaaaaataaggaatattaaaagaggagactagagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcgaaattaaaaataaggaatattagaagaggagattagagtccatatagaaatacaattaggaaataactgaaattcggaattaaaaataaggaatataagaagtagagtatagaatccatatagaaatacaattaggaaataatagaaattcggaattaaaaataaggaatattagaagtagagtatagagtccatatagaaatacaatttggaaataattgaaattcggaattaaaaataaggaatattagaattagagtatagagtccatatagaaatacaatttagaaataatagaaatttagaattaaaaataaggaatattaaaagtagagtatagagtttatatagaaatataattaggaaatagttgaaattcggaattaaaaataaggaatattaggagtagagtatagagtccatataggaatttaaaactaactaaaattcggaataaacataataaaattaaaagtagagtttagagtccgtataaaaatacaatttacaaataactaaaatttgaaattaagaaaaacatgggaagaagagtttaaagtcaatataggaatacaatttagaagtaactaaaattcaaaattaaaaattaaagaatattgaaagatgagtttagagtccacatagaaatataattagaaataataaaaatttagaaataaaaataaataatattggaaaaagagcctagagtctatatagaaatacaatttacagaaaattcgaaattaaaaaaaaattaaagacgagtctagagtccatataggaatatatataatttacaaataactaaaatttgatattaaaaataattaataaataacacgtatataaaatacaatatcaatattacacattggtagtattggtagttttgtaatgttattgtgaaatttaaagttatgttgtcaatttaatatattttagtaatataatgagaaaacatatatgctactatatgagataaaatataatgatgttagccgcacaatctgcgcgggccaccatgctagttgctttattatgtcataatccgagcaaattttgtgggctcacggtgttataaaatttttgaacatgaagtaggaacacccaacaagaaattcgttataaaatttttgaacatgaagtaggaacacccaaaaagaaattcctggagttgccattgcggcgtcgccttccatggagagcgagggctggcctgccctccagcctctgctgtgcttcgcctggatcgccgccacactccccatcattgccgctgcgctgccaatccccacggccgttggaggtcacctccttcgccggctgctctcggccttctcctcccgcggcaagaccgtgaggccctcccccgcctcatcctctggttcctcctcttctaaggcggtaagatcggttcaaggtgccgcaacacctatttgctgcttcgccttttctgttctcattggactatcgcatggagttcgtatgattccttggtaaacgtaacttggttagaccttcttaagttaaacggaacttgttcaaagcaaatataagtttgggttgtttaagtccaaagtagctagctactgttttgtagtgtttagttgatgcaaatctgaaatactatcgattgatcttgagaagatgataacattttgaagaaattcgttcttaatcgttggggaaccactcccgagttctggacttaaaacaaattttttaattggtgtttgtcgacatgatacagtcagtttttctgtcaacttgaacattcagttatgctaacttagctatacaaaaaatacataccaagccagttttgtgagtagaaactaacattatatagtaggatcgaattgattcctcatcggtttttcttgagcaattgttcatccaattgatgatcaattgcacatgagaacactcaccaaatctgtagttcatctcatattcaacttatgtataattctgataatctcaaattgatcttttccaatctgcagaagttcactgttccacaaaaatacttcatgcatttttatgtggtcggagtgctggcgacaacaattttgcttctggcaatatggttctatgcatatatgaaattgacaccattattgcttgagtcatcaagttattccacaattttcagtcatcttgtaggctcaaattcattctcttttggtcgtgttcgctcgcgcaccatgggacacaagtatcgtgtctggcgaacagtatttgcacttctattgatggaagttcaagtgctgagacgactatatgagactgaacatgtgttccactacagtcctgctcggatgcatattgtaggatatttgacaggtctattgtaagctccatcttgttttatatcttttatgttctagatctccatggcacatttgttgtgaaaaatagcccacttgagtagttatcatgtcctttactttattctgttgttatgttacatgattatgcttaaaggtttataaataattcttgtatgcagtttctgcagctcatacatgtaggttgtccacaaaatatacacccgtctaatgagttaatttactgcatgatttttcattgacctgaactaataaaaagaaataccacttcgttagaaaatagcccaagtgatgctgataactacactgttcaattcttgacattttatttgctttcttctgccacagtgcttatattaggaagaggatatgcattcatgctaccgatgataattttttcatattattgttgttgtacttttgttttcatgtataacattttcagattgacttatagtttggtttttcttcatgccagctactatgtagctgcaccattatctctcgctagctcttgtattcctgaagcagcagagtattttcaaggtcaagtacctgagttcgtagtaaagggtcgtgcgagaatgccagatctagtaattgattcatcatctctactacagcctcttctaaagttggggtggacccagtggataggtgctgttatattcatttggggttccctccatcagatccgttgccatgcaattcttgtaagtatctgctctctaatgtccctagatatactagcaagtttttttttacatatatcggcagcatcagaaatcttcctaaggaagaaaaagaaaagaatgaaataaatccacccatatgctgtaagttggaactgtcaaactgcaactgcaaccataacttgttagtgtaaagctgaaggtatggcttgctggaactgttctattttttgagagggtggagcccatcaggcttaaggaaccccatttacacaaattgcttggtcaatcaacatcaggaatcttccatgaaatgccaatcatatttaatgggttatgcatgtttttctgtttctgtatgtcagaaactgtggtattattcatcgttgtcttggaaacttctaggctgcggttaatattttgaatttcatggtttattttttattgcttttacagggatcgttgcgtgaacacaaagattatgatgaatatgtaattccttgtggtgactgctttaatcgggtctcttgtcctcattaccttgctgaactagtgagtgtttttcctatgtcctcattttcagtatgtggcatatactgttttgcaaaatatggcaggtcttgttactctgcttatttaacaacgtcaagttagattaggcctatcaatattttcttgggtttgtcaataaaaatcatcttgggaaagtttggacggattccaattggtggaagcactggactgagtgtctgagtagcttctggtccagcttcaactcctggctggaataggttgggggagaagcagagaacttgtatgttgcttttgctgggatttagagtttttacacggaagctgaattccagtgcagacttctcatcaaatttgttctgttacccatttcatcaccgtagttctctgagtgcagtaccatctgagagtgaatatgtccttttagtatcacccgtactgacatatgcgaacattctttgcatggcttaaagatgataaaactggataatatcttttgagttttcatattatctcacttgtgtgaagtaactagatgattctaacatgacagcacatatgtttccgtgtagcagaattggtgctttttgacttgacagttgatgcagtagggcactgagctactaaaagagctcctgtggttttaaattattatggcattaacatttacagttactttggcttgtaggtaatatattttggcatgttggttgctagtggtgcagaagacattccagtgtggttcctgttcatatttgtggtacgccgtacagtaactttttgaacaaagatactcagaatccaactaacgtgcaattatcatctacatttagtttcttttgtttttgttccagtagattgaactatcttttttcttttttcatttttgcagatcacgaacctgtcatttgcagcagtagaaacttacaattggtatcttcaaaagtttgaagactatcctcgctctcgctatgctatcattccatttgtatgctagtgtctacgaaatggctacattatgtaaagcttatgtatttgcacacaattacgacatgtaacttagcttgatgtaaatgtgataacaatcatacaacgtactaccgtagaggctggaagtttaatatcagagcacctatgtacgttgccagtagtaatctttgtgcttctacagatttaaattacatgccaattatgtcatcgatgaaacatgtttggcattttaaacttaaatgttctgcaactcaaagtgatctagggtatgttgtgctcgtcctttgtataaggaaaaaagtgccgtcatgtttagagacccaaatacctgatctggtctggaaaacggaagacttctggatttatcagagcgataccatttgaactttaagctttaggcagatgagttgctataattttctcaaccaaccacaagtttaatacagtgacaaggtcatcatcctctaaagtagcacgccgtcaaagcaaattaacagaaggatagcctactaaaagaagaagctgagctgatgaaagtgagcaagaggtgccagccaccaaccctcacacctggccggtatatgggggtgagaggcgtttagttagaaagcacatccactgatccgcgagaggggacatgctccttgtcttttctcggctaatcctccctcgtggacatgtattcaatcacattgccgactcggatcttcttttgaagggagagcgctacgcgtcggacatacggcgtgagacgaaaaatcggacgcatccatgagccgtctgatccgcacacacgctatcagccacccgacgtcatcaagcattcatacatgcaaaactattttaaactattattttaaaaaatatttatccaaatcatgattcgattgcactattaaattcgttgcaattaaatctttaaaataagaccacacatggatatattccgatgaaaaaaatagcttattattgattttttttttaaatgttgcatgttattccaccaagtatattggaattttttcactagttagatcgaaaatgtttcaatcgtttaaatcgagcattgtttcaccttatatgaaaacaatgttttagaaaatagcgaaagaatgtttcaagtcaccacaacatttgatccatataaagtaaaacattataagtacactaggtgaaatattttttgtggaacaaagaatgaaatgaattatcttaatagagagattccataatatgtggttgatttattgcaaaagaatttttcaattcgctgcaacattagatctatacatagtgaaacattgtaagtacactaggtgaaacatttttagtggaacattgtaaatacttattgaaacacttaaccaatacatatgcaacatttacaaataaactagtgaaacacaataaactacttactgaaacatacaaatagcaccatgagatacattaaagaaaagatatatacattgtgacaataataaatatgtgcaacataatagaattttagctgaaacatctgattctcacatatgaaacattaagtttaattggttgaaacatatgtgtgtgtttttattataatatagttatgtgagatcttgttgtaaagatttaattataacgaatacaatggtgtaatcggattgtagattggatgagtaatctagaagaaaaatcgttttcaaatttgctaaaagggtgttatgtacatgcaaataacctcgtgtcatctctcctttatgcatattaatgctcagaaaggaagcatatgtaacagatagaggatctgacaaaggctgtatgcggcaaaatcataataagaggtgtccgatttttttctcaagatcgaacgatcggattgaagcattttccttcttttaagtgttgtttactacagctcttactagtataatccttgttcttttgcacggctaaaacactagctcagactactcaacgacagacaccatcagagctgaactttccctggttcaggtgttgggatatggaattagaatctatccgtggaactcagaaaaagaaatttgcaattgccactgttttatcagcgagttgctagtgcttgttcgtttgctcgctgcactatttactttataggagcgtggtgacgttgcaggagttggtgccggaaatccgttaactgaaactaatgagataaactcagaactgatagtgaaatgccgatacagtagagtaggcgcctgaaaactgacgaacataaggcataattggaatccgacgtttctcaaggttcgttcgtcaaaattttcagcttcgatttccaacgtcactgaattggatgccaccgtgtgtatagcctaaacatctcatttttaatgagagaagagatcaaattcggcatcgatcaattcgatggtttcttgatggtcctacgatgagaagttgagaacgatgtgtgtgtgatgtgagagccagtccaacctctgccgttttggacggctttgccacgggcagcggacaataagcgaaaacgcgacccaaaccttctttcggcagctgcctctcgtcgtcgttttcccgctcattttctgcatttcggctgggacttggagtcgttttcttctacccatgaggacacgcgaggtctccgctcggagtgtgtgacagtgtgagactcatccaagagcaacaatggtgtgatttctcttacgctttgtacatccacaagttgacatttattgttttttttcgctctccatatttcttcacgattcaatcaatctgccatggtgaggtcatggactaactcaccaaccatgagtccatgacctcaccgccattattcagtttctgtgtattgggcttcttgtttaagaatttgagatgcgtccttgatgctttgtgatgaatagtggaaacttggatctaggaatgcttaattattttcagattattcacctgattatttgcacaatgttggaaaaaataacattttggggacaaaaaaacattcttctattgtatacttagaccacttattttaaattatttattaatgttgtcgaatgacaactgtgtccgtcgaagaacgtggttcgctcttggtggaaataaagcagaaaattaatatttttattgaaattgttgggatcctcccattacatgccctatggggcctatttttaggcttagtacatgcccctgcacgctagggttactaagtagagagaaatttatatggctacccttatgatagtaacatttatgagggtaattatagacaatatgaccttgggcccttatatgggccactaaatgggcctcatagggccattcggcctgcttggttattgaggctacagcttcgggggcgaaagggctcggccctgtggtgaaggcctcaggcttcgcctagcgcttcaccctgaagtccttgtctttgcgatcctcggatctctaccgcatgtggtacgccttggtggttgtggatggcgtttcggtgacatggtcgaaggtcctcatggcatgcctgcaacaagcccttcacgggtaaggatgagtagtgagcttcggtcgagaccgtgtaaagccccgggtatggcatgaggcgccccctttcggccaatattcccgtcgaaacctatctacttttgagaaaaaaaaagtcataagtgaaaaaatctatttccttttgtcgacgtttgatgtcgcgattccggtatttgcatagtatggggatcgttggtactaggatatacacgagactggggtaaaagagatggagacagcgatttttatacaggttcgggcccctgcattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagtccgcatccggcgagatcagagacaacgctatatctctcctgacggtatccgtaggcaccgtaggggactagctatgcctatctctgaagtcgatatctggcgtcttgtcttggcgtatgttggcttgtatgttgtggcttctgttgttccgtgtcccctctcctcctagggagccttatatttatacccataggtgtccccttgtccaagtagaactagggaaaccaatatagatacaatccgagtagtccttgtcgtttccatgtagaactctattcatccttccttatgcagaactcttcctatatccgaaagttgtttccgtataagatatggtatgtggtgagtcctgccgagatttagtcaactactattaggtatgtggtatccataaccctgacacctttccatttatgggctctttggtggtccatttttgccttgggagctaacggttcgcattcggccttttactgtgtcatttgcccctttttattgtgcggcccacgggctatcttcgcgcagatagccgttggttcaagggatgcatgccacacatcgcacatccatcggtttggcactcaacggtcgcgagggcggaggagtataaatccaacctccccctttcccccggaggcttacctcagttttttaccgcagcacttttctcctcaattcctgcttcttgcgctcacgcgttccaggaagacagctattcacccagttcccctttcacctttgtagcttcgccacttctcaagccgaaatggctcctaggaagactgcttcggccgcgacaaccgggcccgatctcggagcgatgccggatgacttgtccagcttcttgggcaagttgtttgtcaaggagggtgatctgggcgaacttgtcgcctctggggcagtcgtcgaagggcaagctttccttagcgcgagaaaaatataattatgaatagtgtacattgttattagaagatggttgttccactaaaatgctacatgagacaattttcactgtgcgcgtgatcgacagtttagcaccgttgttatgagaagacagttccactaaaatgagacgtggcatttttcactgtgctcgcgatcgacagtttagcaccgtcacgtacccctatttgaggggtggctcggctctttctcctccatatagctaattcagccttagacacatggtctgaccgcagtgtattgtcctgtctgaccggccacacaatggcggtcagactggcctttgcggtaaatgtcctcccaacggtgacacaccttctcagacaaacagagatggcttgttttccttcaactatctgccatgcatgtatgtctctaggatcatagaaatcaaaaggatgctcaccggagaggaaggaatcggccacggcggcatttagccggagttggagaagacgaaggcaatctccatctccggtggacgaatattgggaaatcttgaggtattttggagaggacctcgaggggaagctggtggcgcgacgactcatcttggcgtggtccagatccacggcgctcggtgcatgcactggagctcccgtgggcatggcggcgttcccgtcgttgcagtggatgaaatgaggtggtgtcaaaagggaacttgttcggcatgaagggtagaatatggaatgggaaagagttggtgatggagatggctcgacgacgggtggctgcctccttcttcttcacggccggcaacgaagaagagatggaagtgggaagctagagctacatatatctcttggtttttcagcttagagatggagaatgaagtgtggcgacgtgatctggaggagtagagcgaaaagtctaatgggcgatcgatcgcctcgaacgatcacccccctcctccacatggtttcctttttaggcaccgcattactttcctattttagtaaatttatgcgcctaaagtttgtacacctcaagtttacatatctaaagtttatacacctaaagtttagagacccaaagtttataagtcaaaagtttatatatccgattcaaatttaaatttgaattcaaatattttttatatatagtattttctatacatccaaagtttatagacccaaagtttataagtcaaaagtttatatacccaattcaaatttgaatttgaattcaaatatttttttatatagtatttctatacacctaaagtttagagacccaaagtttataagtcaaaagtttatatatccgattcaaagttgaatttgaattcaaatatttttttatatatagtattttctacacatctaaagtctatagacccaaagtttataagtcaaaagtttatataaccgattcaaatttgaatttgaattcaaatattttttatatatagtgtttctacacataaatttttctaactttgttttttatttttttaaatttatggtgtagtaataagagaagaaggggaggaggaagggggagaggagcgaaaagtctaatgggcgatcgatcgccccgagcgatcacccccctcctccacgtggttttccttttttggcaccgcattactttcctattttagtaaatttatgcacctaaagtttgtacacctcaaatttacacatctaaagtttatacacctaaagtttagagacccaaagtttatatatccgattcaaatttgaatttgaattcaaatattttttatatatagtattttatatacatctaaagtttatagacccaaagtttattattcaaaagtttatatacccaattcaaatttgaatttgaattcaaatattttttataatagaaaaaatgcccatgcgttgcaacgggtgaaggttattttaactttattattgttatacgatttagttaaggtgaaattcattgtgagaattcgcttggatatatatattttcccacgaaattatgagctataattaggagtccgatcatcttgtcgacggtgagtaaccgtagaccggatatagagggtattggggtacgctggtacgaggatctacgtagtacgacatcaaggaaacaagagagaaagattataatggtttaggccccttagtaggtaatagccctaatctagttgatatgggattatatggaaataaccacagattacaaagggaatagtagaactcggtggtaccgacgagattgtagtcgagttaattagactagaccacccggcgacttggctcctatagtcttcggcttcgtaggctgtggtcgtcgtgtagcctatgagattcgatcccttaggtccccgcggggggtcccttttatatcgcaggtcaggcggtctccaagtaggactcggaggcatcggaccctgcacaatatagtaacgacccagtcctatacgggtaggaacctttccattgacagactttgtgatggacttccttagcgtattcagaggacgtccgtatatgcaccgacataccgtattgccgtatagcatacgtccaagggtagagggtataccttatccgtaaccctgacaatagcccccgacttctacttaaatgaactcatgtaaccaatcgcgacttctgatgtcggaattgttgtcgttctcaactggtcgatctcggtgtgaggaccgtagagacaaagagtgttcgacaacaccatgcgaagtccaacggttatgagtaaatttaaattaaagtccaagaaaccgcctgacgcaacggacccagaaatttccggtggccatctctctcctttccttggaattcgcaccgtcggtagtgcgcctatttaagggagttttgggaatccattttggagtccggctgttgcgagaaactttcaagccttcaggagctcttcgtcttctccgcttctgcacaaaccctagcttgttcctctcagccccttctccggtgatcttcgacggggatggagctcgacaagtccacttctaccagcgcgtcgctgaagaagttgcaggaggaaggcgctctccccggtcgcaggaccatggagagggaaccaggaggtattgaacctaaacctgtcctgggccgcatggttgcagttgaggactatattctctgtggtttccttcctcctccctctgagtttcttcttttggtcttgaatttctacggtctttctctgctccatttgaaccccagctctatcgccttcctcagtatcttttctcatctttgtgaggcctatattggggttgacggagctcgtggctcctcaccgggagaccgcgcaggcccccctttgccagttcggccgggggcttagggtgaaatctcaagctctcgctctctctgtatgtggaaatatcgtatgcccgccagaaaacacgagacaccgacgatctatacaggttcgggccgctgagaagcgtaataccctactcctgtgttttggtggatctgcgtatgaatgagctacaagtgtgagctgacttctcccccgttctaagctcatcatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaaacttggcaacgtgcatgtttgcccttcttcacacaacatcttgcctgtaatggttaagatgaagcctggcatatatcgaccgggtctaacgtgtcatctctaagggataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaggggtagagccgtttcttgacctctttcgcttctactatgagttgcgttggatggaatccaacagggtgtcaggatgcgttggttttcgacttagggatggcctgaagtcgcgctatatccccttccagtgcccctcttctcgtagtaaatggcgggtgaggtggttagaaaattcggatccggtcttggttgttcccgaggagcaaccgaacaatatttcgtcttggactgccaagcccgccttgaccccctcccttcagtctttcatcgatgtcatcgatgacctccgagtgcgagggttgtcggggtatgaagtcgctgctgacttcatcggtagacggatccagccgctctaggctcgagcccatctagcctttgactactcagggccggaggatgcgacccgggtttctcctcagggtatttttctcgtattctgggttccattccttaagtatatgttccccctgacttatcaattttggttctcgatctataggtttgaacagcgaaactgtagagcgccgcgttggtcaagtgatgatcagcggccctacaacggcgagcaacgtccctgttgctctttgcgagaagggggcagccgaacgcgaagccaccatcaatgtaagtgtactcagcggcccttttgcatttttctttcgggatcgcattgtgacttcatgaagcgtatgctctccctctgactgatattatcgggccactcgtggaccatcaggcggcggcgtggctgaaggagaacgtcgccaaggaggtgtctgatgttgctgctgctgctgccacaacgagtggcggcaacatcccgagaagggggaggaaattctcctccgtgatcggaaatcgtcggaaaacgcccaccccctcgataagctctcctggtcgttcatcgcgtagtcggaaagcttccacctcacatcatgcccgttatactccaggcctcggatgcgtctccccgcctccgcgacggcagcggcttgtgacgcttggcgagaagtaagtggatgaacttgaggttttgtcgcttcgttgagctcttgcagcctgtctcaattgcagcctttcacagggcggcgcgggcgaaggcggcataagacggatctggagggacttccagcgcgtctcctgccgtgtcctcgactgatgtcgtggtcgtgcccaggagccgcgaggcgacgcccagcggcccagtcagcgatctcgcggctggtcggggtccgccggctgtcgtcctcacctaggaggagctccaggtcaagatggggcgcctcctcgaggctggtgctcgcggcattagccacgagatcgtagaggcgagggcggcggcggcgtcgtcggcgaacgagcgcgccgaccggctgacgcatgatttggcggaggtttgcaaggacctccagaagatgagggaattggtggccggcaacgagcgacaacggcaggggctcgagcaccgtatgtcggagctcgagaacaacttgttggaaatctgtggctcgctgcgggtcacctacactggtctgcaccagctcgccggggagtgcggtgtcaagaccaccatccctgcgaatcccaatgaattctcgctgatgacttcgcttgcggaactggcgacggcgatggaggcgatcccctccaagcacgcggccaggatcgaagaggagatgtctaacgggatttataccggggcgtgccatgtccttgcgtgtgtgaggctggcgcatcctgaactcgatcttcggaagatcctggatcagggggtggctagcgacgcgcgcaaggatgtgatggaggaagtcagagacctgggggagtctgtcctccccctttttgaagagtaggaccgccgcttgtttgtaccccttaaccaatcgtgctttgtaaaacttttcgttggttccaactgcttttgtgtgtgcaattgttgccttagttttctttggcattttgattccaggtactttgtctgttgtttgtagagatgtcggtgtcgagaatgtccagcagcgcgggcagcctgaattgcttgaggttgcttcgacacttgagctcgagccgtacatgccgcgggatggcatagaccaggatctgcccaaggagacggacgtggtgtcgacttctttaggttggctcttgtcggttccctttcctttacctcgtctgtcttgattgggttgacttagatgtttgcatgttgagcagacctcgagagtgtgcttgctgatcacgaccgtcgcatccagtattggaggacgaagtttgaggtcgccgaacttgagaggactatattggaggtgaagagggatcgggctgtggaggcgctccgaggtcgcgaggtatggttcaactcgtacctcaggagttgttgcataaccatggccgttgtctgcagagagctccgagtacctcgcggggatcccgaggagtcagcggctggctacatctcgtggctgaacggggcttgcgctcagcttgaaggcatcggcgggtgtatcgacgaggccctaaaacaggaatgtcgtccatcgagtcgatacgccggagggcacatactggcgtgtatacgagatcatcgtccgcagttgcacctcgagttccttcacgaagggttttcccgttctcggaggaaccctacggagatagacaacctagcgaagttgatggctccgctagctgagaaaatcttccattcaatggattggcattggccttcttggtagtgcctatatatctgtgacaaacatcttaagaaaaaagtaatgtattctggaattctttgcgatctgtaagaaatgcttgtgaaatagaaaggaaatctatctaactaagctttcttatgctgggtacggtgtgcacgagtgtcttctcacttcacgacttcgatcagtcacttgagttatacactctccctagcccccagccttgtcgtcggagaactcttctcggaagataaggctcttggactctcgaccatccttagttgaataagcactgatccttgcccccggccgtgaagttggaaaaatccatttccgattacacggcttggttaatacgcatggcgagaacacttacacgaccagatcttacatggtctttcgtctctgaaggatccgacaaggccttatcagctctgggcgtccccagccgaagttcccttaggttctttggaggccttgtcaagatggcgtaaagggacatgaggataggtttcaacgctaggtgtcgtctgggtaagggatcatcgggaaggggcactgtgattgaaatctgtgccttaaaacagactttattgaagttgtaagatgtcttacaaatgtggacactattgacttatacataaaatttatgcaattggtcaatgttccatgaatttgctagctcacgaccatcgccgtccgcaatcttgaatgagcctggccgcaagacttgtgtgatcgtgtacggtccttcccatttgggtgagagtttgtttcgccctgcctggctttgaactcgtcggaggacgtaatcgccgatcgaaagtatgcgtgctcggatgcgcttctcgtgacatcggcgtagggcctgttggtagctagctgctctgacggcgacccgttcttgatgttcttcgagtaggttcatgtcgtcgtttcgctgttcctcctgatcctcgtcggagtacttctgtagtcgtgtactctgatgacataacttggtagggagcatggccttcgagccgtacacgaggaagaagggtttctctttgttggacgttgtcggtgtggtgcgcacgacccatagtaccgaggggagctcttcgacccacttcttgtcatgtgacatgagcctatcgtagacacgggtcttgatcccttgtagtactataccgttagccctctctagccctctcgacctgtccgttactctgagggtgagaaaccgaagcgaagcatatcttgactcctagtccgatgcagttgtcttggaaatcagcgctgatgaattgggagccgttatccgttatgatgcggtgaggcaatccatatcggcaaaatatccccttaatgaacttgatggcgttgtcggccttgatttcccccgtgggtgttgcctcgatccatttagtgaatttgtcgatcggcacggacaggaatgtgttgcttcgatccatttggtgaatttgtcgatcgccacgaacaggaatttgtagccgccctgtcctcatgggaatggaccgagtatgtcgagcccccagcacgagaacggccaagtgagagggatggtttgtagtgcttgcgttggtagctttgtgtgtttgctatgaaattgacaagcttcacactgttgtaccatatcgcaagcgtctttgagggcggttggctagaaaaatccttgtcgaaaggcttttccgaccaatgtacgaccggcggcatgtgacctgcagaccccttcgtggatgtcgacgaggaagtgtttgccgtcgtcagacgaaacatattttagaagtactccgtttggcgccttcttgtatagatcgttcccgatcatacagtagatttttgcttgacgggttattttctcgacttctgcgtcgtcctcgggcaactcattgctgcttatgaatttaatgagtggggtccaccagtcatccctggtctcgatgtcggcaacggcacaatctgcctctgtagcccccgagccgatgtcgggggtgactgggctatcttcgtcatttgcctctttcactgatggttttgtcaggatatctagaaaggtgccgggttcgagtagctctcgtctggacgcacgccgtgctagatttgatgggacctcgatcccatcaaatcttttttccagcttcttgacttctgcaagatatttggatagctcagggctagagcatttgtaatctttgtgcacctggtttgcgactagttcggagtcccctttcacgatcaatcgcttgactccaagtgcagctgcagctctcatcccagcgagtagtccttcgtactcggctgtgttgttggtcgccctgaagttgaggtgaattgcatgcttgaactgatctcccgaaggtgatgtcaagatgaaccccgcacctgctccttggctgttgagcgcgccatcgaatgccattgtccatgtttcgttgtcggtctggctatctaacctgttttcaggcatagttcaatcggctacgaaatcggcaagaacctgggacttgatggctgttcgtgtataaagtggatgtcaaactggcttagctcgactacccatttcgtaatgcggccgacaacgtctttgtttctcacgacctcgccaagagggaaggcggagacaaatgtgactctgtgggcttggaagtagtggcgtagctttcttgacgtcatgattactgcggagagcagtttttggatctgtgggtaccttgtctttgcgtcgtgtagagcttcgttgacgtaatagattggtctctgcaccttttctctttcgacaacaatgacagtactcacagagtagggcgtagtggcaatatagaggaacaattcttcattaggttggggagcaacaagtacaaggggatttgacaagtagcgcttgagtgcgatgaacgcctcttcagcttcctgtgtccatacaaatttgtcttgcttttttagtagtgcgaagaagggctgtcctcgttctcccatcctagcgacgaacctacttagcgccgccatgcatccggttagcttctgtacgtccttgagccttgtgggcgacttcatgttctcgattgccttgatcttctcgggatttgcttctattcctctgccagagacgaggaatccgagcaaattgcccgacggtaccccgaacgtgcacttctcaggattgagcatgaggcgatatcgtctgaggttgtcgaaggtttcccgtagatcgtcaaccaatgagtcgcctgtcttggttttgacaacaatgtcatcgacgtaggcctcaacattgttacccagctgatcgctaagtgccccttggaccgtatgctggagtccaaatggtattttgacgtaacagaatacaccgaacggtgtgatgaatgttgtcttctcgtcctcttttgccatgctgatttggtggtagccggagtaagcatcaaggaagcttaacagcttgcaaccagttgttgagtccaccagttggtctattcgaggaagaggaaagtgatccttggggcacgccttgttgaggttggtgaagtcgacgcacatcctccacttctcgttggcctttcgcaccatgactgggttggctagccactctggatggagtacctctctgatgaaaccagccttaagaagtttatcgagctcttctcgtatggcctgtttccgatctgatgtaaatctccgcagtttttgctttactggcttggcatcgggtcgcaccatacgtttgtgctcaatgacctccctggggacccccggcatgtcggacagctgccaagcgaatacgtccacattgtcgcggaggaaggtgatgagcgcgagttcctatttctcgttcagtgatgccccgatcttgaccgtcttgtcggggttgacactggagagtgggacgattttgattgcgccgtctggtttcggcgtcttagtcgttttgatcactttcttgggtggctcggctgtggcgggtgggctgggagtgtactcgaccatgtcgaggcttcgcttgtcgcattggaccgccagcttcgcattcccttggatagtgattgttccctttggccagggcatcttgagtacctgatacgcgtagtgagatgcggccatgaacttcgtgagtgccgttctttcgatgacggcgttgtatgctgtgtcgaactcagtaacatcatatgttatctgctccgttcggaagttgctcgcttggccgaaagtcaccggaagcatgatcttgcccaatggcttggacgaagattgaggggtgattccatggaagggttgatcggtaggtgtcaactcgcctcatggaaatcccattgcgtccaaagtgttggcgaagaagattgatggagctgccgccatcgacgaggactcgcgctaccttgatattccgaatagtgggtttgaccacgatcggatatcgtcatggtataacagcagccttggggtggtcttcatctgagaactcgatcttctgttcagaccacttcatcttgggtgcagccccctgccatgtcgaacaaacctcacgctctacttttttgtattctcgctttgaagagtatgttgtggaacctccgaagatgtgtgagacatgaagatcagaatctgggtacgcggagtccgagtcctgagtggttgcctcagttgccttctcgactacacgtactcgcttacccttctctaaagccagcttcctttccgatgattttttgaagatgaggcattcctccagagaatgtctgtccgacttgtgtatggggcaccatattctctttgtatcactgccctgtgggtctgggtgtttgggcgggcgttcgtattcagatgcaaggacttctgtttaagctttcctcttcccattcttgccgcttttcttcttgcttgattcgggcgcgtccttggctagcttcttctctcctcccgcctttggtttgtcgtttttgcgtctcaatgcgtcgtctgcatgggcacatcgatcgacaacctcgaataaccttcgagtagtagtgattcaccttgttgccaactcctgggtagtatagcgatctctgacaccggttttgaaagcgcggatcacagaagcatcggtgatatcggggatcgtatttctccactcattaaagtgccgaacatagtccctcaaagattcaccctgattctgtgttaacacgtgtaaatcgtcttcgatcgcgtgacgcttgtaagttccctggaagttcgcgacgaattgttgccataaatctgcccatgaagagatcgagtaaggtgggaggtgcatcagccacgaatgcgcagaacctttcaacgccgtcggcagataatttactaacgcgttgtcgtctgtcccaacggcgtatagtaccgtggagtagacctggaggaattcttcagggtcagaacttccatcgtacttctctattgctccgggtcggaatctctcgggccatcggacatcacgtagagaacggttgaaagccctacacccagcgctgggggcagtgggttgtcggcgatcgtgtgtcctccgtggacgtctatcggatgatgaagacggagatgatgatgacgatgacgacgatggctcactaggctccggtgtgcgattccaagggcgacgttcaggttctcgagagttctgtcgtcgtccaccattgttgtcctgcgccgatctccattatcatcaccgtcatgctgatgccctcgaccaacatcgtctggtgtccgatgttcgtgatcgtcgcggtcgcggcggttgtgacgattacggtggtgttggtctccgttcgagcgtcctcctcgatcttcgccctcgcgacgtcgtgaagaaacacgatgtcgggaacgattctcgttgtcttgcgcgcgtcgtgcttctcggcggccatttagatggtcgtggagatcgccggtgccgcgaggtggaggagtagctcgtctcggcgacgtccgctgctccggtggttcgccgtcggtaccgtcagccatgggtcgttcaggttgtgctctggtagcagcttcctcgaacgcgttactgagattggccaccgattcccgtagtcgttttgtccaacgtgcgagatcatcgttaagcacaggttgtaaggagcttctctcagtattgcgttgacggtgccgagatgctgggccggcgtacccgtctggttctccgcctctgcgttagcctgtgcggatgtgctagtcccaccgatggcaaacacgtcgcgtggtgtactggaagatgacgagccacaatcttcgagtaagtgaaggaccgatggctcgtggggattgatgtcgattactccaacgaatcaatccgaggtcaacgtcactccttgttccttgcctgtatcctcgagagaggttcctgactgccggaccttaggaggcgtcgtcttcatggcgcggagaaagaccttgcagcttgagaagtcatgattcttcgtcttgtgaataggacaatagacatcatgagttggagaagtacgctggattccacgctctttgcaagcacggatttcagtttgtacgttgagaaaaacccagcaagcttgcaagttgtgcttcctggacttgtggataggacaccaggacttggcgacctcggaagctgtcctcgtcggctcgcagtccttgtcggaaggacaaggctcggccgcgctaggaatcttctcgggctcgcatgacgtcgatgttccgttctccgccacggcgggaggatccttcgacatgggaccgtccgggtttataaccacggcgttctcgtttccggttattgatgaaccagccgagattggcaccgtggtgtaaaccgggaagacgatttcgccgacttgagtctacaccagcattgttgaagcagggattccttggatggggccggtgttgactctgttgtcgacgaagctcgatgtcatagtagtagaaccttgagcaccaagtccctctacctggtgcgccactgtcgacggtgagtaaccgtagaccggatatagagggtattggggtacgctggtacgaggatctacgtagtacaacatcaaggaaacaagagacaaagattatactggttcagaccccttagcaggtaatagccctaatccagttgatatgggattatatggaaataaccacagattacaaagggaatagtagaactcggtggtaccgacgagatcgtagtcgagttaattagactagaccacccggcgacttggctcctatagtcttcggcttcgtaggctgtggttgtcgtgtaggctatgagattcgatccttatatccccgcggggggtcccttttatatcgcaggtcacgcagtctccaagtaggactcggaggcatcagaccctgcacgatatagtaacgacccaatctatacgggtaggaacctttccattggcagacttcgtgatggacttccttagcgtattcagaggacgtccgtatatgcaccgatataccgtattgccgtatagcatacgtccaagggtagagggtatatcttatccgtaaccttgacacatctgaagttagcatgtaattttttttaaagaaattccttatacgactggtaatgtatttaaaaaacgaacgaacttaattcaaaattataatatgttgtacgtactgcaagtactaaatttgtaatcaaaattatttgtctttgttaggttgcataattttttttcatatatttactttgttatgattttatagttatttagttatttttaattttggatccatcctaacaatatggaatatccatataattttagctttggcctgtttcaattttgaacgttgttttaaccttttgagtaggtgcaaagccgcatgcatgcaaagtcagcccaacgtgtgaacatgcaaagtcagttgaacgtgtgagtggcttgaactgacatgcagtcgaaggcttgcatgtgcatgcatgccgcgtccctagaggacccggtcacacaccgacacacgaacgagtgaacgacgccgaaaattcgaacgggactcccatgcaggcgacgatgaacacgcacatgacattgaaacaaacaacgagacgggtaggaatcgaaaacggtaacttaccaaaaattttagcaaaagcatcttcaatttttataatagtatttttatacgcataaagtttagagaaacagagtttataagtcaaaagtttatatatccgattcaaatttaaatttgaatttaaatattttttatatatagtattttctatacatctaaattctatagacccaaagtttataagtcaaaagtttatatacccaattcaaatttgaatttaaatttaaatattttttatatagtatttctacacataattttttctaactttgtttttttattttttaaaaaattatggtgtagtaggaagaggagaaggggaggaggaagggggagaggagcgtgttatgggggatagcgatcacccgcccattagcgacacccggagtagagggcgagaaaagaggagtttgaagccgttgacacgttgtggccacgcgttgagcgcgtccgagagcggtcggcgccggttttctttttctctctcgcgttaagcggtgaggaatgaagatggacagggactgggctagctggggaggctgccaagtgggtccaaaccgtggtaacctaggctagagagaaagggaagggtagaaacatgggtagactagattttggatgattttccaggtttatttctcttcccatctttgttaattcatatattaatttgtggtgcagataaattcatgtagattttactggagttaggtgattatacctagatttcatttttttttgcacttaaaaattatgtgcagtttgctctcagaaaaatggagaagatgggctcagcagaattttgtttgaattgttagaaggtctaaacagaagaaataaattctggaaaattatagttactcttgataattaacctagtatttgaataaattatttcccttatacacttcccacttccatgcagtttaatgcatattttggtgagttaagattttagccaattaaggtttataattagtctattattagactcgtttgactgatttatttgaggtattagcttaagtgataaattctgaccaaaatttcagtgtgttgtacacattggatagtattcatgtgaatttttccaagatttaattatgtataaatatttttttagtaattgatctagtctatcctttatatgtattttcatctcgaaatgcatttgagcatttatagattttatatttgaacacttctttacctaaggtgatattattaaacttagtttcatacccaacatgcacacaaggactcaaacctaaccatgatctatatgcatatgcatgcttacactttgttactcaaattccattttggtttggaaaggaaaagttttaactagccccaaaattccctatatgcaaaagttgggttgacctacctaggtttaaaatgaaaattttaagctcgcaaaaataaaaaatttatcttccaacaattttgacaaggaattttaaaccctagaatttaggtatgttacagtcctgcaacgggcctactattcgatctgttcacctcgaaggcagatgattattatcagtggtgtatttatgagtattattacttgtaacaaaactaaaaggatactccctccatcccaaaatttgtatgacagtgacgttttttcatataacgtttgaccattcatcatattaaaaaattgatataaatatcatttattttattgtggtttgttttattatcaaagaaattataatcttaatttacacttttgcatatttatactaaactttaaataaaacgaatgggcaaacgttatgcgaaaagtcaacggtgtcatttttttgttgggaaggagggagtatatagtattagtggtaggatctctttgatctaaaaaaaaaatagtgtatgaactcgcccagttggagtacagcccactgcccacaagttcatttcatgaaagttataaaagtcaaccaaattcagcagtgtttaatctttcggtttagtcatttatatcaaggtggccgaaataccaaaatttctaaaatttcggtccaaaattatatgaatttttaaataaaatttgattaaatttgaaaaaaatattacctaattcatgaaaaaaatttaaaaatttcggccgaaataatatcatatccgaaattttgaaccctgaaatgcaggccttctggaggggtagatagttgacctttatgccgacgactctgcaagctgcaacgaccgcttctacctgcaatatgattgatgctatatagtttcttccccggctgcacttcttcatttcttcctcctcttcctccgacatgcacttgtgaagcgactcgaggaatccaataagtgaggctagctccatttcataacagctcatcgggcgtccgtgcaggtactcaaatttcttgccagtaatatttccatcatctatttctgttttacttttgcaaagcatgatggagtagaaagtccaacatggtatgtgcttggagctttacgaaacactcggtcttgaagttgaactgatatgattgttgaaacttaaaaggaactgatgctattcaaagactagataaatccattcatgttccagtcttaagtattatgcacagcccaacaacaatcttctccaaccttcttaccgctaacagactagtttcttaatcacaattcagaactgccagttcaaaatcgaaggcaggagcaaaacctgaaatcccttacttcacatcaggaaccttttatatctatactcctttaaaaagagtagtgatggtggtgattggtgaatctgccaccacccccaccaccaactcaggacccttttggagtaaggtgatgccaaagggtccacacatcaaccacctccaccactttgttgtgaaggaaaaatgatattgtgaggccatagggctcatgttatttaccgatatatctagaatttaagaaatgatgtataaaaaataatgataatagtatgttttttttttggtaaatctcaaagaggacaaggagtgcatgttttcatataagaagaagaagaagagagttggtctagtttttgaatgataatagtatgttaataatcattttcatcaattaaaatcccgtgcaaaatgctagttagcattaagaatgcatatggacgaaagagactacccattggcatggccaacactcagcaaagaactttttatcaaggttttcaattttttttaaccaaagagatctgtaaatttttgctatacacaccccaaaaaataaaaataaaataaaattttctccgggtatctacttcatgtttgattcacgctaaaattggaagtttgattgaaattgaaacgatacgatggaaaagttgaaagtttgtgtgtgtaggaaagttctaatgtgatgaaaaagttaaaagtttaaagaaaaagttggtatctaaaccaggactttttctcatcccagatatcaactgtttactgcatttagaccatttactatgtgtactatttccctgtttcctaatgtaccctacttttgatgctcaaccaaatactagttccttgtagctcagcagtccagagtattagtatgcttgcgagtaactatcgaaggaaggagtaatagttttccatcctccaaactgtcacccactcaccctccaagtattatcttttgattcaggattccagcagattcaagttccgctatccctttttctatgatgatcaatcagattgtgcacctccctttgcgtatccttgattcttttccttcatgcagttccgccagtgcagttggcgttttgggaccgttctcacaccttttccaaaaagcaataaatttggtttgaaaaatatggaaaatatttgccatgtaaatataatgataggcacaacatagaaaaaggtatccctctaaccaaaaaacccaatcctagctacgaacctggacacgcatatgtttgtctttttagacggagtagtacgtacctaataaaatagaggtaaactgggcgaggaatgccttctttcttgcatatctaaggaatttagtagatctgtactgccataaataatatttaacgtgtatattttggtaataacatgctaagggcctgtttagactttagatcccactcaaaattttacaccctatcacatcaagcgtttgaatacatatataaagtattaaatatagacttaaaaaaaattaatggtacagattgcgactactttgcaaggcgaatcttttaagcctaattgttccatgaattgacaatgtggtgctatagtaaacatgtgctaatgactaattaattaggcttaataaattcatctcgcgatttactaatggatactgtaattagtttttttattagtgcccgaacacctcgtgtgacaccctatataatacccgaactttacatccctgtatctaatctacccctaagattagctctgtcatgtcgcatatgtatctttaaattaacattgaattgttatggtcagtagcggagctagtggcggagctagccaggagctacgcctagggctcatttatattatcttgttctaatgttctactaatccacacagattttagaaatttaaataaaatttacatggagtcatgaacccaggcctagggcttgagccctggctgccctaggcctggttattgttaatccggtaggccataattaggagtaaactggagattatcaaacatgacttgctccaaaaggtgttccatctgtttaattaggtggtgtttggatccataagtcctatggacttattttagtcctaggactaatcactttagtctatggctgtttggctatatggactaaaagggactaaagtacattaaatgcgctgtacaatgaccatattgccccataaaaccatgcaaagtggactgcaccatgccccttgctgcagcatgccgtttgctgccgctgctaccactttgcaagccaaaacattgttgttgcacgactgcacaaccaaatgcaagccaaatcaatgtttcaccccaacatcacaagcattaacccatcataatttggacaaatacacaccttcagcaagccgaatcacaagcaataacccatcatcattttcattatcaatatcacaaccaaatcacagaaattcaaagaagctcatacacatctcaagttgtcgaaatacatcacagaagtttcaatgttacaaattacaagcactcatggttcaattaacaagttcaaccaaatacaattcacaataaatttgaaccatatattacattcctttcaaagaccacaatccatcggcaacccagtcccgaaattggttcatcacatgcgagtccaaatcatttgttggttcgctagatggagaagaggttccacccaatggatcataattttcatcttggtcataattatcgaactctgcatcagccatttgactgtctctaatgaaattatgaagtgctatgcatgcatgaataattctgctttgctttttctgcgagtagctaggtaaattaaacaaaatcatccacttgttcttcaagaccccaaacgacctctctatcacattgcaacacgaagaatggttgtaattaaagtgctcccttcttcccctaggcaatgtgctttcgttgtacttttggaaatgatatgttatacccttgtatggtgtaagataacccggcctatttgggtatcccgagtctacgagataaaactttcctggaggtggctttggtaacttgccactaaatctagtttgagcatcattgaataccctcatatcatgaaccgaaccaagccagctagcaagcacgaaaataaatctcatatcaaagtcacagacgcacataacattctgactcttctccttatgtctattcctatgttaaacagcagctgaatttggcaccacaacttggatatgagtaccatctattgctccaatgcaattatccaaatatggtatgtactgtggagaaagcaattttttatggactgttgagaaaagaggatcttttggcctaatgatatcttttgcaagtcttagtagagcggtcaaaactgctttgaacttagtatgtactgttctaagagacctaacaaatcggtcttgggcttgcctaattgattggggagcacctactatccacaaaaaaagacccaaagactccatggaatccattttgtttgtggacttcaactcatatgattccacaagcaccgaatgtaacctctcaaaaactggcatgtgcatcctaaacatgttgtaacaagcagttctattggctaatgttctcataacccaatcatgtccagactcaggtgctactcttcttagagccttattagagtaaagttccaagtaatacgtaccaatcatgccagcaagcatacatgctcttctcctgttcatttctcttttcttcaaaatagaaatgataagatcaatctcctcatcactgctgtcttcctcacagctatctttatcagcattgccctcaccatcctacatgactgacatatgcatagaaaggaagcacatcataaatataatatgaacaaacttcaacaagaaaagaagggaaggtagttaaatagatccacacatcacatgttgattacatcacatcacatcaaagtagtagatagttcaacacaaaagtagttcagaactaatgcagctaagacccaactaatgcagataagacccatctaatgcagctaagacaccataatgcagctaagaaagacaccatatgcagcaatggcagagtgcctctagtgcagctaagaaaggcatcatctaatacaaattcttatgctggcaccatctcttcaaccacataaatcttgcttcattagtgctaatattctcaaacataactctgttatgtttggaagcaaacaactgtgtggcacaaaagtattccacattgtcttctgctgcaccacactctactgccaacttctgacagtgtgtcaaggactcagccatttcttctttcttctgctcctttaacttcttgctgttaacaagttcagtaattagggtattggacttatcacttttagaggtgaaagaattgagcagccccctcatgagcttcaccactgggctcttgcttttttttccaagacttgaagctgtggacacatcacagctgctactccctctcttcctgctgttagtgctcatggggctattctcaaaaccatcccctacagctctttcccctctagctgtctcccttgcatcccctgcttcctcttcttcttcctcttcatcttcatcttcaaaaccagggatatatgctgtggaaccatcaactgcaactccttgaaacatctctataagaaaatctaagtactcagggttgccatggcgaaatttcttggcatcccccttctcctgtattgacacttaatcaatatcacagatatctccaaaatcatgtaaactagatcaatttttgacaactgcgtaccttaattttttttcccaccaaacatttgatgcaattatttctccactagcacttctaccagctccagtttgttggttcagccacacccaagcaacgtaataattctttagatgggtgaatctattctttatctgtttggttgaatgccttaggttagccctttggaaatatttggccttcaaattctggtaccctctagttgtccatgctccattaggacaatgcccatcccttatttcctcacatgctatttcacacaatgtgtaagttttttcttctgtccaaattgccttgtcatatgtattctaggaaagaaaaacatgatttaaccctaaattaaccacatgaacagcaaatgacatattacaaatgcttagcccacggcatgcatagcaatttaaatatcatgagcaacaattgacatatttcgaaagcaataaa

SEQ ID NO: 61994 - DNA, 10658 bp, Oryza sativa
acatgaatataccccgagtcacaatacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccaatccatatctaataaaagacatttacacattccaatattaaattcaaactttcaccttatgcaaggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccgatgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaataagtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaagacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttgggacccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaagtgtgcgcctttattcttgcagaaataattaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctgtttttcagagggcatggctagcaaatcctgaggctagccaatatttagcatttatttttttctggaattaactcattagtgacgggtcggaacaaaaatccgtcaaaggtaaccttacctgtgacggactagcaagtaaggcccgtcagaggtgacctacctgtgacgggcctttacttttggggccgtcacaggtagatcacctgtgacagcttctaactacggagaccacaacctctgacggcctttatttaaagggccgtcagagatgagtcacctgtgacgggtcctaactcgccctaggctagcggagaccaacacctctgacggccttctagtaacttgcccgtcagagatgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtaaccagtttccataatttgcggcacaagcaacgatcaatttcctacttcctgcaagaagattgaagttgatgtgtttgcacttcacaacattcttttatccagtcatatccaatacatctatccccaccaattaactactccctccgtcccaaaatatttgatgccgttgacttttctagaaatgtttaaccgttcgtcttattcaaaaaaaattaagtaattattaatttttttctatcatatttgatttattgttaaatatacttttacacatttcacaaaagtttttaaataagacgaacgatcaaacatgtataaaaaagtcaacggtgtcaaacatttatatttagggaaggagggagtattttcctatcctcagttagccacgttaccttttattttcatccattggatcgaggtgcttaacacagcagattgcttattttaggacttactttctttactagcaatatacccgtgctaacgctacggagccattatatttttgaaaaaaaaactatgaaaaattggagaaatggacatttggccacgttcaaaaagtggtttcgctgaaataccatcccgaaaacacgctttgttaaaatgccaatatggaacgcgcgctcaccgccactttgccattttggcagttttgtgtattttcaaaaccatttttgttggaacatccggtgatgagacagaaatgccctcaccggcgtcttcgacagagctgaaggacctcaggtacttgtacggccccggcgagagccccttgtcgtcggtgacgacctgccacctagcgtccacgaccgcccagcaccaccgcatccacaccctgtacgccttgacaccggccgacggcaagcagcgccgccttgacaccagccgccctcccgccgctcgtcgtcgcctcctccaggctcctcctcttcctccgcgaagtccacctccatccccatagccatggccttcggcagcggcggcagcagaagcgcacaggtgagggacatggcggacgggccaaggaggactacgttacagccatggaggctgtcgtcgcggcgaccccctcgacgcggcccatgcgagcgtcggcctcgtcgcggagccggcgtcgaccacgtgggcgggcgcgtggctccagcgcctccctcagctgtgccgccagctcgccggcgctccggccgtgcccccaccctcctcctccctgtggctgcacctgcgccccacgttctgctgtcgacctacaaaaagagcgcgtagcaactccttcaccgcccacctcgccccccatgcggccacggaaggtattggacgctgatggccgcagagaatgcagcagtggcagcaatggcgggcatactttctcaggggactgaaggtgctggacgctgacggtgtcgaagctggaggtctggacgtgtcccatgatgtgactcgtccatagatggtggtggttggcaatgaagaaatccagaacaacaagaacgggatgagcaatgacatggtcctgatagagggagaaacgacaacgacgagctctggtggtgaacatgaccggatgagtgcatcaaaacacattcctggacgagaggattcgttttccttgaactcgcggaaagaacaaaagatggagaaaaaacgactaatattgttcatcatcttccctagccaacacaagaaacagaataggagggaagatgggcgatggtgctctagtgaccacggcggtgagtaaggtggccggacgtgtcccacgatgtaactcgtccatagatggtggcggttggcaacaaagagaacaagaacaatgggaacgggccggcaacaatatggtcccgatagagagagaaacgggaaaggcgagctcttgtactaaacacggccatgtgagtacgtcaaaacgtgttcccagacgaggagattccgcttttcttgaatgcgcaagagggagggaacgcaggggagaggagggatgccaaggagaagatgtcacgggagaggaagaggacgtgcggtgagggagagatgtggggtgctgtgagggaggagggaggcaggagaggagggccgtcaggagaagaggggctgcgggtagggggagcgtgtggagatcagggcaccggtagggggagagaggcggaagcggagaggggaggcgaagggggaggggggtgacggacgaaaggggtggcgaaagccttacgtattttttaattagttatagatttgattgacatatgggcctctcatattttgttttaatcttttttagttttcaattttgctcttttattttttttatcaaactgccacttaagcgccacgttagtaccatatgggacgaaacctagtcaaaggagccacgtagatatcacatcagcaaaatctggaaacaatattgctaagggaccttgtttgcagtggttttttagatgcactgtatctggttttatggttgttaagggatacaaaatgaacctattccacatctcacggtcgacacacagtattcaacccctgtacatcccaactggacatatatgcccatagcagcccagcccaaattcccaaatgcacacgaccctgttgtctcgccaattgttgttggctggcccccaaaagttgaggaccaccgatcctagagcatgttttagaagataaataagaagagagaagagcagcggcctatagatttatagcaagttgtagtacggactccaagacgcagtgtgtgtatgacaggtgggaccaggtattaatagtatagtatataactattatatgaataagctattagattggttatagttgaattggaggtagtagttggctatactattaaacttgctcttaaacttgctcttagtgtgctgtcatgctgtgcataactagcgatgctccaacaacacccacgctaattgacactcaccacagtccacaggatgtctcgccgccgtctgcagctgctgcttcctctcgccgccgtcgtgctcgtccacgccgccgccgccggctgccgagcgttccagatcgaggaggccaccgtcgacgacatccagctcggcttcaggaacggcagcctcacctccaggcggctcgtcctcttctacctcgaccgcatcgcgcgcctcaacccgctcctccacgccgtcatcgaggtcaaccccgacgcgctcgcgcaggcggcgcgcgccgacgccgagcgccggccgccgtcgtcccgccgcggtggcccgctccgtacggcgtccccgtcttgctcaaggacaacatcgcgacgcgcgaccggctcaacacgacggccgggtcgctggcgctgctgggctccgtcgccaggcgggacgccggcgtggtgcggcggctccggcgtgccggcgcggtggtgctcggcaaggccaacctcgacgagtgggccaacttccgcaccatccaaggcaccggcggctggagcgcgcgtggtggccagggccgggtaagctcgtcggtcttggtttcttccatcacaaagtcaacgttcaactttggagcaatgagcttgtatattctatgccaatttgttgcagacttattttttcttagtaaatttcttaaacccccacctattatggtccaaattatataaaactacacggattttggtacatggcacataacgctaagtattatggtagtaaagtttcataaaaactaccctgcagtggcgtatagctagctaggtggcactgtggtccatgtaccacctaaaaatttgatcgatattaaaactataatatatgtgctagtcaacataataaaaattatatagtgcaccacccatttaattgacctattacatatagatggaccacctttactttaaatcctagctacgccactgacacactgttagctattttgacatactccgatattaaaattttgaaaagcgaatgtcgcatttatagatggataaaatcctcgtaggtttgagatgcagctgtagaactcaaaagtgtgatatattaaagtcaaaatgatcagtagtgtgattttagaaaactttagaaccataatatctaagattatgtgtcacatgaccaaatcgccttggttttatataatttggactataatatgtagagttttatgaaatttactcttagaaaaataaccattgatgccattggctgattactacattagtgtcaaaatgaccatagctgtaaatttttctttagcttatcaaaacatagcttactctaaaacatgagttatttgacatatccttagggcatcacccatgtatattgcctaagttggtaataaggtgggcccctttaacagtaggtaatagttgtttcaattgtcacaatgtatactagtaggagatggtagtaaggtgggccacattgcaacaaaaaaaatattgtgagaatgagagagatggctggtggaatggagagaagagagattgtaatatttgtttaatcatacaaccgggtagtagtgctactaccgaatattactactacccaccttgatacctatctccacaatgttgaaccaggtaatagggcctcctactacccactttttaccacattgtggatgccgtaagaaacttatcacttattaccttggtattttgcggacaagaaagcaaatttttgtcgctgcaaaacaattcaaaattcgagctcttatgccagtacattactaaatatttggcatgcatatgcagaatccatatgttctatcagcggctcagtgcggttcaagcacaggatcagccattgcagctgcagccaacatggcggcagcaacacttgggactgagactgatggatccatactctgcccatcatcgttgaattcagtggttgggatcaaaccaaccgttggattgacaagccgggctggtgttgttcctatctcccctaggcaagacactatcgggtaatctagacatactccttcgttgccaaatacttgtcgccagatattattcatatttaaaattggatcgtttatcttttttacgaaaattttatcaaatatctaaattaagatactacgttagtaaagtgcgttacatctttcatttaaatattattagtgatcaaaattgcaactgtggtggtcaacggtgacaactatggagatgtatatacataccaatggacgtgttgatttaatttttactgtcacaaactcacaatccagttgtgttcttgtgtatgcacgagatccaaagtactctattttaatttcttataatgtaccaattggacaattgacttggtaaactcaatcctatcaagtcaatgtcaaagctattagacgaaaattttcaaatagcatatctgatgttcacccttaaaaggtactttgactaacttgagaaatgccatcagacatgagcttggtttgaaaattgccatcccaaatatcttgtatagaaaaatgtcatttgacatgttcaaaaatatgaaaaatatattgacatggaatttagatcaagctgtcaatttttttccatcgtgaggtccattaacatcaaactagttagaaaatgtagtaaatgatagttttgcccttctttctttcccaacatagggaaaattcgaaattattttgctctagaataatctagttttatggctttgctataaaccactctagttttgtgtttctttatcaaaagacattccaaccattattttattatatcctcttccactagagagataaaactttacaaaaatgattttaaaattggacaagcttgcaagattaaaatttaaacacatttgatgaatttgaacatattttacaaaatttcaaacttgttgcaaataacggaaataaaaaaaacttgtagcgaataatggtaataaaaaaaattcagagatggacattcagatatttactacaagaaaaattgttttttatatgtactatttgatttagggtctaaaatttgatttatttgcctgatattatgaaactattttctagttgcctgatattattttcctaaataaaattcagaggtggactttcaaatatttactacaagccaaaaaaatgtttttatatatctactatatgatttagagcctagagttaattttatttgcttgatagaggattgctatggttggaaaagtttaagaaaacgaaaaaagggcatgggcaatatatcattttataatctttggatggaaaatgtgatggcaatgaaaagtggattattccttgtttgccacttgcaaattcatcactggcaaattcgcaagatcccttatttgcccatgagaatgagagcgcgcggtataactagttatgtatttaatggcataaaggatcttcgtgatggtattgcctattctgttgtggtggcaatgaacaaattaagtccatatacttcacttgttttgttggcaccaggggtcaaatgtatacccatgatttaacttggataatgacatggctttataagacaaggttttttctctttgtatatcttgctattattaatcttcaaattgtttatggtcatttagatcattttaccagttaacaaataattaatatcactgacctctgtttacaacctaactgcattcatcacgacagagtccttgtatgaagaaaagaatagtttggaagctggatgctctcaattttgaaaattgaaaaattaaaaaaataacaagaatataaatttaatagcattaaatagttataggaaaactgaatctactgctctaaaatatgttaatcagacacaacaaatcgatggaaaatgatcatactgtaaaatcatcaaattcctagtatgaatcttatcattttaaaatgcaggccaatttgtcggacagtagcagatgcagtccaagtactagatgctattgtcagttatgacagccgtgatgcgaaagccacaagggcagcatccaagtatatcccacctggtggatatgtgcagtttttgaaacctgatggattaaaaggcaagagaataggcatcccaaatggatttttcaacttcccaagtgggacagtgcagcagattgtttaccagcaacttctcgacacagtgaggtatgtatttaccagaattttcacgaaattatatacattggtataggatataagaaaaattgagatttcaatttgcgtttcacagaaataaaaattactcatctggtttaaaaattaatgatgtaagaccctacaattatatgaaacggagattctatatgtgaatcttggttgaacatcgacttgtggcggcagcagcaagagatgagaaaacagataattgggaatgagaattgtagattgaatctccttgctttattcatccgaatgcagcctctaaataggcttacaattggtaggcggtgactagggatcggtcgcccgattcaaatctctaaaaatcaggcgttgacgtcagcatgacgtcagcgtcacacatatgtgtaaaaccactttaaactaatttttctcttaaattatttatcccgattgcaccattaaattcgttgcaattaaatctttaaaacaagatcacacatggatatattccgacgaaaaaatagcttattattgatttttttaaaaaatattgcacgatgttccaccaggtatatcggaattgtttcattaagtagatcgaaaatgttttagtcgttaaaatcgggtgttgtttcaccttatataaaaacaatgtttcagcaaatagcgaaagaatgtttcagttcactgcaacattagatccatacatagtgaaacactataagtacgctaggtgaaacatttttttgtggaacaaaaaatgaaacgaatt

SEQ ID NO: 61995 - DNA, 14402 bp, Oryza sativa
  unsure (1)..(14402): unsure at all n locations
cagttctatgcaacactagatctatacatagtgaaacattgtgactgcattagataaaatattttttgtcgaaaaaaaataaaccaaattcccttaatagatggtttccaaaatatgtgggtaatttgttgtaatagagttgtgtgtggacacgtggcgggccagggggagcgcgtgcgtgcatgggggcgggggagcgcccgatttctgctccccgcccgatcgtccgacgggaatcattttcccaattggtaaccaaattgctaagaaatagctaaaaaactgataaggaaaacagctaacaaactttatctaatttgcaagcggatagaactgttggcgtccggcacggccgatcagacacgacgtgctgcgctccctgcggccgcatcctgctgagccggcgtgcctctgcgacgatatgttatcccgaccatgacaattatttggaaacaaattgaaacatctagctttttattgtcatttaaagcaggtgtaattttgtgaaatttaatctaatgtttattggactttttggagcatcggtattctaaattatagcagatatgaaccagtttaggtaatatgccttgcactttacgtgtggcaatatggaaaagccaatgtccttgatatctgacatttacatcctttttttgaaggaaacaaggggcagttgtgattgagaacctggacatagcaaacctgactgttatacaagatgtccttaacaatgggcagcagattgtgttaccagcagagttcaagtcaagccttaacacttatctgtcagacttatcctactcccctgttcgttcacttgcggaaataattgctttcaacgatgcacatcctattgaggtctgctctagttcataaccttttttttctgtgtgtattctttcgcagttccacagttttacatgccttcatattacgagaaaaggttatattgtatatttttcttcaaatctgaagaaaccatccgttatttgttatcagatgatacacagaatctagtacttgttgaagttgatcctttcatcaaaacatacgtaaaaccatttatatattctttccatcagcacaaaaggtactgttagattttgttaggagaaatatttaagacgacatatgattagaaaattttctgttctgaagaggcactataaaatgtttctaaaatgacaaacaaaaaaaaacatagacttcaaacattctaaagtgcgtagctgatactccctccgttttatatttataaatcacttcgatttttttctagtcaaattttactccctccgggctgataatattagtcgttttagacaaggataaagtcaaactttaaaatctttgactacaaataatttttaaaatatttatcttaaaaatataaaaaccatatgtgtagattagtcttaaaaagtacttcaataaaatcatatatttgttgatatttctatatatattataatagaaaatagttgttaaagttaatttttggagaccgtgcccttgtctaaaacgacaagtattatcaacccggagggagtattaagtttgaccaaatttatagacaaatttaattagcaatatttaaaacaccaaattagtttcattacatctagcattgaatatattttgataatatatttgttttgggtttgtcaaagttaaaaaagtttgattaagaaaaaagtcaaaaacgacttaattataatatgagcggggcagtagttacttactattcttgcatactaaactttttgtgcatcacggtatatttatgttgttgcaggttatgaagtcaatattacttttattactatagttgattgcatttcatcttctttttttcaagattatgaatcttggtatgtaaactaaccagcttaaaatttcgaaaatgttaaaacagatcgctaaatcatattgccaaatatgtgtgtataacaggagagactaaaggattttgggcagctcatcttcctggtagctgagaacactactggcatcggcgcactcgagagagccataatccatcaactaaacaagctttcagctgacggactggagaagctaatgaaggatgagcagctggatgcaattatcacgcccaatgactcagtttccaccgttctcgccattggcggcatgccggcaatcaccgtaccagctggatacggtaagaggggagtccccttcggaatttgctttggtggattgaagggctatgagccgaggctaattgagatggcttatgcatttgagcaagctaccaaggtcagaaaagcccctaagttcttgcgtggaacattttagcaagatggcagacacgtctttaactagtaaagccaataattcactgggctgatcgtttatccactgctggggaacccatctttagtcccggtttataccttttttcgtataatccgggactaaatatatccatttttaataccggttggtaattaacaccaaccgttactaaagatgccacggtaacaccaaccagtagtaaagatggtagcatctgccatgtggcatcaggtggtaccatctgtagtaccgtggcatcatggcttggtatcagaaaggtccctaagtaattcttgcatggaacattttagcaagatgatagacatgtttttaactagtaaagcaaaataattcagtgagctgatcgtttatcgcaactactattattgagcttgggaatgcaatttaaaacattggtgagtgggctggggaacattttagcaagatgatagacatgtttttaattaactagtaaatgtaccatcgccgaccgatcgaggagaggcggctactgccttcgtgtcacctcgaagaggacggccgctgccgtcgcatccccggggagaggccggccggcttgacttagagaggtgacgaggtgaggatgcattgccgttgcatagccgaaaagatggaggagataaggttagaaagagacaaaggcagaggtattttggtctgggaaaaaaaattgagcaaaagcatttctatcaacaaaaagaacgaaaatggtattttgatgaacgcatctcagtttaggatggtattatagcgaaccaatttgaagcgatggtatttcagcgaaaccattcttttgtgatggtaatttctcgttcgcgtgggtgggtttggctttgtgttggtgggggtaccgggatagggttagaccgcgcgtgtcggaatatcaggaattcttttagttatctcaaaatcatcaaaatataggatacgtacgggatacgtatcggagcgtatccgataggtattcgtattcatcgccatatcagatacggatacgttaaatgtgagacgtatccaggtaatatatgtagggactaccaatatcatacacaggcgagtgctcattcgatcactactactgaaaaacacttctgtacaggttaggaactaaccatatgtgtcatatatcccagccggcactcagcatgcagcacccatgacctaggtcatcggtgtcaattattcaacactaactataatacatatatatatatgccggttttagtaaaaatcgacacctatatggaattataggtgctggttcttaaagcaattgtcatgtggctgccttatggcactggttctttagaacaaccagcacctatatgtaccatatagttaccaattgttcaccggcaaggacacatggtaagactatagatgtcggtttgtaataaaaaccgacatcaatatgccggtttgtagcaaacggttcaattcaataagcaagagtgaaacggagtgagaaataatgaaaactattcttgtagaaatcaacatccaacaacaccaacaaattaaaagtaaaaccttccctcctttagctagtccaaaaaatacaagaggtgtatactaagctgttcttttcttgatcagctcaagagaaacactacaaggattatgttgatacatgacattatccgtttgtcatagacgccctaagaaacgtcacaggtaactatccgtgagagtccagaaatacatcatagaatccccgtcataaaccttcttcatggaaaaaaactgtcacggatgcgctggatcggtgacgactgtgaccgtcatggaatagctattcgtttggttttcaggcagcatcagtgatgaaacggaccgtcatggacgttgtgccacatcagcacagctatctcagcatggtgaggtggaatctgacatggctgcatctggcacatcagcttggtgacgtggctataactgacacgtcagcttggtgacgtggctcaccattccatgacagcattttttttcgaaattttttttattagggtaccgaaatgtaggatgggctgggccgacataatgggctgggccgagatattttctgcgcggcccattttcgtttcaaattgtcctccaatttctttttatattgggtaattagccaactttattttaaatttggctcagcccatttcctcggcatattgggccggcccagataataccagcagcccaagaactcattctggaccaaataccaccacagattcaaatacatccacagattcaaatctccaaaatagtacatcacatcatagaagcatcagcacggtatgcttacatgtttactgaaatcactgtatcataccaaaagcaagcaccctaaacaggttcaagttcaccatagaatgagtctactgcacataatgtgctccaccagaaaagcatcactacaggagtgtacttcacaagttcaacaaaatgcagccatccaaagcaaccataccacacagcattaaattcttgcctgactcgatggaatcatggccatcaaacgcctaagtagagtatcagtttcggcttgcctctgcttcatctcctcatcattcttggccctttcttcttctgctgcctgcattttcttcaccatctcatccagctgttggcgctgaatgttcactagctccctaagatctgctgatgtctgcttctcctccaccagtgcggcttgtagctcgcggcgacttccagcactggaatcgacaggtaagctgttgatccccacattcacaagaaatttgttcttcttagttttgccagcaagcacttcagaaacagcatcattcactgacttcggttcacagccatcctcaacaggttctgcgatcttcatctccatttcagcctagcagtgcaagcgacaatacatggctaactgatcaatgcataccaatttaatctatcatttgtttgtgaactaattgacaatttacttacaatagctgattgtacagcaggagcgaaggctttcttcttgctgcagtggagctctttaaacaaatcaagcccatttggtggtgcatctttgtacttgtccccctaaacaatgaaagaaaaccaaaaatttgagcttgttacttcttcaatgtattttgaacagtgattacaaatctgtaatatctctaatattaattaacacttcatgcatcaactatctatacaagaggataacaaatcaatatgtattaaacaaacattaactaaattggactcaccaattcgatgatgtgcatgtcatagctgcgagaaccagttgtctggtggaactgcactttagctctgtttgctttgttcttttcacaaatcaactgcagcaacaaagttatgatcttaaggcacctatgagatccacatggtaaacttgaaatgaaaattattgccaagagcttaccatttttttttcatccttccagtgttcaacaagttgaagccactgaagatcactcatgcatgttacaggagatgttttcaacaccagatgaagtggataaggatcaaaatacttctttttgagcttatgtcgctgctggcaaacagctctcttcatcattgccacacatgcctttctcacaggaccagcagttgtgtccatatcaaactttgactgaaaacaggtaatgtcatagtcaattgctagataacgaatctaaaacagatattaggcagcgtatggtagttcaaatttgtgcattcaattaatgcttcagagaagagtaatgccttcaagcaagaccatccaaaaatgaaaataacatactcactaaattcaataacagatgcacaatgtaccctaattctcactcattcagagacacacacattcaaagacacatgaacttcagagaaattgcaagtacttgttagagatggtatgtaatgttatgttcacaaataaacatagtggaaagcctaaagttcagacactcaccccaactttgttgatgtaaaaccttaagagtttcttgttgtccttgtaatccttccattttgggaatatgggaacatggttcctgactgcaatgttgcactcggtggcaaattttgcagcaattttcacagagtttggcctcattttacctggttcaatgaccacaggaagtttgcccttctttgagcgggacatcctttcaagacctcttcctacattaggaccccttatccacctctcctcatatgcttctgcatctgcaaaggatacaattaacaacacttgtgtgggctgttgaatttagaaagggtttagagtgtcgggatttggagaagataccttcagaatcaccctctgcgttttcattgacgttggtgtcatcaagagtatgctcatcaaggtggggggtagtgtccatctggcaatcatcgttccatccaacaccttgaataatgaaaacagagtttgtgatagctatcaagatatggcatttgctgtgaatttaaatactaattactgttatcaaaaacttgttaaagtagcttgcacaaaccttcttcagtatgagcagcattaacctcgcttaaagcctgaattgggatttcagcttgagtgtcagcagcgagaacctcacttgtagcctgaattgggatctcagcttgagtatcagcaacaagaacctcacgtgtagcaagaacatctggtgccacatgctttttagacctcgtcactttaccaggttgcaatggtgcaacaactcttttgccccctatggcgtgatgagtcacagaggttacattctcagtattcttcttggatttcttggtagcaggctgcaataaatgaaataaatgaatatgtaaagtaatctagaactagtgaattattgacaaaggttgtaaaacattattgaatggagagatctagtaccttatgtttcaagcaatcatgtccagacttcatgttctgtaggtcttcagtctcaggtactaggctatcattactaacatagccctcactgagatcatcatcttcagcattggcatcaaagtcagggtcatcattgtccttattcttttctctatctcgctgggcaactgaatttccaaacacaatactggataatgctggtacccctagccgtcgcatcatagcattgttctgaagacacgttctcatccttttcagttcatagtcattaagtggggtttctgcattaacaagaacaattatagcctaatatttgcataaaccaaaaatctaacgagggctatattccctagccactgtcgctagcaaatcctagcacatgagggcaactcagatagctagtacagaggaaggcagagaaagtattcacctgtaatcttgggtgctgaccggggcctctttgcttgccctttcttcttcggcgccattagggtggtgttgcggtcgatgtccactgcggtggtgcagcgtcgttgggctttcggcggcatatggatcgcgtcctacgaaccggcggcggtggagattggacgcacatagggtttggggtgaacaatgtggtgtatttataccaaccaatgagtgcatgcgaaattacctacaagtcctcctatttagaagagtctaggtcatggcaagcgagggtataagagtcttttgcagcttcgaatacattttggaggtgcgcggagcgcgcgcaccaagcgaaattttgccgccgaaatggagttgggttgattggagttcaggcccagttaaggatataatgtttttaatttttctttcagtagcataaatacatttcatttaaaaatataaattataataaatatgctgattatgaaaaattcatcatcacaaaagttgtttgaattattgagatctagaacttttgtattggtcctttctccataggagttcgtttcatattgtgaaatttgaaatcaacaatatgagaagttccaaaattatttggggaccagaactgatttgaaatgaagaaatcataaaaaacaaagttgtagaactcttgggtgtgtactacttttgttttcatcatttttccaatttacattgtttgaacaactcaaaatttgaatttcaaaattttagaacttcgaatacaaaattgagacactaaatgacttcaaatgaaaaagtcaagaaaaccaaagttgaataactcatcaaaatctacaacttttattttggtcatttcgttatccgagaaactaatatgaacattattcacaaatttttcatctctctcatagttctatgaaacactatgagaggtttgtaaatttgtgaacaatattataatcacttgatcggatgaaaaaatgaccaaaataaaagttgtagatcttgatgagttattcaattttgttattcttgactttttcaattggagtcatttattgttttaaaatgatatttgaagttgacattttttggaaattcaaatgttgtattgataaaacaaagtcccatgaaaagatgaacaaaataatagcttcaagaacacagttaattgatagaacacgattttataaaattttagggaaaaaacatcaaatttgaagcaaatcgtgaatagcgttgttgttgaattgtgcaagtgaacagctactatgtatgttagtcagctaatgtatgtgtgtttctgtgtggttgtatgattcctgaaattgaattgaaatgaaatgtgctctgctcaaccagttcactacttgtgttatgtactgtaaaatcaattcacaggttaaatgacatgataaattcatcgaaaaaaatgacatgataaattaaatttctcagaactgagctaagctgagcatgtatgccatctttcacatgttgacaagcacatagacagttcaatggtagaagtatataggcatgatggcctttcacatgctgacagaatatataattcacacaatttggacaggatgtcacaaaagatctcagctcacaaagacaatacttgtcgcactgacttaagttgacaaacataagttcataaaatgccaataggggcatcacatacacatgtcacaacaggaactactcatcatcgctatctacctcaactggggcaacttcaccttcactccaatattccacagccgtgtcgtcctctatctcatcaccagacgattcaccatcttcagcaggtcgattttgcttcataagtcgagcaacttcagaagcatcaacaacctggcgagcttcatcatctcggttcaaaggcaggtcagataaattctcatctacctctggtcttctcccatcttcctcaatgcactgtgtctgttgatacggagatgcactaggtgcattttgttcatcaacattgtataaatgccgatgcttaaacatttggacaagctgccaattttcgccatgcttattatctggcaggtagaaaatctgtttagcttgagtcgctagtatgaaacaatctttcttgtaccaaaagcttccagtattgacgcttctaaaaaaaccatcatcttttagtgcagtcttcttgccatctagcttgtaccattcacatctaaaaagaaccaccgttcttgtattcccatcatccttgctgttgtactgcaactcaataatatctgtcaactttccaaagtaatcaattacccgaccattatgtattccagcacacgccactccagagttttgagtcttcttatttatgtcacgctcagcagtacagaaccggacaccattgacaacacatgaagagtaagatcttactctcaggtcagggccacatgctaaggcaaacaggtcatcatctacaatatctgaattgttcaacctccacatctgcaaaagggattgcggattagcaaatcattaatcaaaacacaacgtatatcgaaaacaaaatgtgaggcaactaacatggttcctgaaccaagtagcaaatccaagcctagtccttctatcaatatcagctgcttgcacccctgcttcctgtaattcgccttgaaacattctgtgaacaaacagatttcagcaattaaatcaaaatgcaaatgtgcaagagtacaagatagagaggttagaacatactttatataatcctgggcctgatcgcaattatataggatataccaaaccatttgatcaaaatcttcagagtaaccatagtcacatgcaccaatcagattaacaccgtgcccaaaaacatcaatattgaaggccgatggatctgagaatcctggatttctcggtgctcggttaaacctagtctccacatcctccatatacctagagcagaatgtgagggcttcatctgcaacataagcctcagcaatcgagccttccggtcgtgccttattcctaaccgacctcttcaaagtgtacaatcgtcgctcaacaggatacatccacccaaattgcactggccctcgaagcattgcctcgtcaggcaaatggacagcaaggtgaaccattacatcaaaaaaagcgggtggaaatagtttttcaagcttgcatagtatagctggtatttctgtcttcattcgaaccaagatatctttgttgagtgtttggctgcacaattccctaaaaaatttcccaagctcggcaatcactaaacatatatcatcatccaaaatacctctcataccagcaggtaatatcctttgcaacagaatgtggcagtcatgagttttaagcccatgcaagctggttccctctgcagttatgcatctttcgatatttgcagcatagctatctgggaactttgtttctttcaaaaatttacagaatttaatctttttttccctagacaatgtgtatctagcttcaggcatgtgataatcatctccatttggctgcaactgcaattctggtttaatattcaaatcagcaagatcaagccttgcattaacattgtcttttgacttcccatgtatgccaagaagggtaccaaggaggttttcacaaatattcttttcaatgtgcatcacatctagattgtgtctaagcttcaaagatggccaatatggtaaatcccacaaactaaccctcctaccccaaattggcacatgtccctctgaacgcttccttttttgacctggtctaacatcatttaccttggccaattcttctaacagctcttcagttgtgaatgtacctggcttctctttgctttcatgtagagaggcatattcattattcgtgcgcagacgatgacgcctaggaaggaaccgacagtgaccaatataacaaagcttgttccttatggaatatgatagaggatttttgtcacaatggagacaagcaaagaaaccttgtgtggtccgaccagacaaagtactaagtgctggatagtcatgaatgcaccacaacacggcagcacgaagcttgaaatcttttcctgtcagagcatcaactgtatcaacaccagaccaaagactaagtaactcctctataagaggctggagaaaaacatcaaagtgcttcttcccaggcgatctaggaccaggaatcaacaaagccatcatgaagtttgattcttgcatacatgaccaaggtggaaagttgtatggaatcacaaaaataggccacatactataagatgatctcatattgccaaacggattgaaaccgtctgtagccaggccaagcctaaggttccttgcatcttcagcaaaatctggccagcatttgtcaaaatctttccatgcctctccatctgcaggatgggacatttccttctctttgggttccctattcaacttatgccattgtgcttcctctgctgttttcttggtagcaaatattcgttgaagcctaggtatcaacggaaaatgccgcaatactttttctggaaccttcttattcacaggatctttccatcttgatgcttgacaaactggacaagtatcaagttctgcatactcctttctaaatagcacgcaattgtttgggcaaacatgtattgacacataacccagtcctaaagtacgcagcattttctttgcttcttcatatgaattgggaagacaattgttctctgggaacgctttgcgcaagactttcaactgtgcagaaaatgctgagttgctgatcctgtagtatgacttcaaatggagcatcttgactacaaatgaaaaccttgaaaattgagtgcaaccaggatatagctcatgctttgcctcttccatcagagttttgaaaacagactcatggttactagatgggttgccatctccatttgctgcattattacaaggtacttgagcccccatgaggtctgttaagatatcttcaactctatctgcagcattgttttcatgttctataggattagaatgtggatccacatctactggttcctccaaaacatgaacatcattggcctctccatgatgaatccatcttgtatatgtactagacatcccattgagcaatatgtgcctctccacatctctttgagccatggatttctggttaatacaccgactacatggacacaaaattgcagcatccccaggaaatcgctcttcaacaaatttcatgaaatttcgaacaccatcaatataatctggtgtgaaaagtgcaccatgtatccatcgtctatccatctagtacagaaaattcaggcaccagattgacatcacattcatggctaaactccctatcataccctctaatcgaagtggatatcgaaatacataccaggccaatcagtggagctcttcaatggttgaactccaagggaagccaatggagctcgtcgataggcgagccacgccggaggcaggcagactgtagatctcgacggcagagtaccaggacaaaccactgctaccgcaccccccccccccctccatcgctgctgtacccagcctccgacgctgtcgcacctcgccttcgccgatgccgccccccgccttcgccgatgccgccccccgccttcgccgcttccaccccacgccccacttcttttccttcactgctgccgcacagtcgccggcaggcccaggttttcaacttgggtattcgaaattaaaagagatagaaaaaatttcataaagtcatagatggatagaattgaccataaattgaatgcgttaagcatattaaagtacaatactaaactattaattaacaaaacatttcaaatttatagagcatacaaaatgacaaaatgataaaaaattaacaatttagagaagaacttttcgtttcttgatattttgaaaatgattgatgatgtctttttcctacaatacaacaatatagtatattcaaccatgaatcattaatggatcaaattctaaataaaaaatgtttaaccatgaacaatatcctagaggctagattcaactatgaattaaatcctaatatcttatattcctatttcctaatccaaaatgttcctacttcctaattcctaaccacatgacatctaggtgactagacatgaaggggaaacttagtcattattgctatttatctgtggtaaactggtaatgtagaagtagtaagttcctatggtactccattactccaagacaacttaccttcagcgcgctggcgtccagtggcggtggcgggctggtgcggcgccgtggcgtggcattctggcgtcggcgtgtcgccggactagggaggcgacgagacgggatgccgggacgaccggacgggcggcggcacggcgcgaaatcgcgagtcagcgagtgcacggcgggccgcgccgccgcgcgcaagggggcggggcgatggccgacgggcgacggggcgggccggaggacgacgggcggtcgggcgccgggcgggcgcagggcgaccgccgaccggcgacggcgaggcgactggcgctggcggcctgacgcggcgccgcgggcttcctctccctggctgccttgcggctggcggctggctgctgagaaggttgtgaggaggaaaggcagatcacgatagggttccaatccattttgggccttcttttcctattgggccagtgggctgaaatggtgaggagagaaaaatggtgggatggtgagttcagtctgggcttttttgagtgggtagaccttttttctttttccggggggtcggacgtgtctaccaagngagccccaca

SEQ ID NO: 61996 - DNA, 656 bp, Oryza sativa
cctgcagccctcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatca

SEQ ID NO: 61997 - DNA, 22778 bp, Oryza sativa
ttatagatactcatgctgcatgcctgcattttgactctagaggcatccccttttcgttatatatatatatacatatgaaatatatccttcatatatgtattttttctgaaaaaatcttgggtattcatttgaatacccatgaataactgtggccccgcccccctcgtgccttcattcaccgatgccacaccccgccttcaccgcctccatttccaccaccgccgcgccgccgtgacacacgtgttatttgtttttagggtttgattttcatatgatgacgaagggatgtgtatgatttgtttgtataaatatgcagtgttttaagtataaagaaatgaatataccgtttcaaacattcaatcacaagttccatggcattgcagtggtaagccatttctctctggcctggccgatcgtaaggtcgaatcctgggttggccgcctttttttttttcttttctcgctatttaggctgctgtccatatcaccgtccacgtcaccatgacatccacgtcgctaggggtcccactgtccacgtcaccaaatatccatctgtgatatttattcgaaagcgtcatagataattatgaaggtgacaaatggttgagattgtcacagagttagcatctaattctcaaaccgtcataggtgtactacgcgatgacaatttcagaaaccgtcaccagtaaaccgtcatgtactaacatatttcttgtagtgaaagaggatgagctatatactaagatcataggtatcggttcttaactagaaccggcatgtatatctgaagccatataggtgccagttattatagtgaaccctccaatggctacttccgatggtgaagatcttaaaggtgtcggtacttaaatagaattgacacctttctcggatagcgatgttggttctaaaataggccccacattttagaactttgatgagatagaaataaaccctacactttttatttatgtcctcatatcacttaaattaaatttgatggtaactagttatagtttaatttgtttttttataacttgtaaaagttaaaatttaatttacatttttataacgatataacacatgttaatacatcatctcaaatatttttaaattttttcataactgtttgactaacatacgaacaaccagaaaacgtcccctccagttgaaaatccactgtccacgcgcccacacgaaacctagctaataaccatctatctttcggcgacgatctcccccgtggcggggctactactcctccctgccacggtggtcttcacggccgccgccgccgccgccatcttccgctccccctccggcgcccgggcaaccacgtcggcgcggcacacggggcaccaccggctcttcctcagccacgagtccacgcacggcgcgtggaagctgtgctcgcaccgcggcagccgccggcaccggtccccggcctccagctcctccaggcacaccgcgcagtccccgccgccgccgcccttgacgacgtcgtggcacggcagcgcgccgatctcgtcggcggacaggcccttccctcctcctcctcgggctccaccgccgttcccctccgccgcgcgcccgggcgccgcctcctcctcgccgcgcgacgccccgcgcccgcgccgcagcgcccagaagacgacgacgatgtggacgaccagcatcagcgcgacgccggccaccaggaggaagatggagatcaccgacgacgacgacggcgacgccattatattctagctaataactaagctacgcagctcgtggacctccatgtgctgcagccatggatgcatcgtctttgcttcttccgctgctcttgctttggatgtggagacagatagctagatatatagctagcgttggattgttcaggagaaaccaaagaggagatgacgacgacgacgacgactgtaactgttaattactcaaccagatcagcatgcaaattaagctagttgaggagggaagctaggcatgcattaagtgaagtagttaacacactcatcgtcactgctgataattcaagccaggagtgaccgaaacagaagggacaaacataacagttcagtgttgcaagcccaaatgtgcatgcctgttaattggggtgttttaaatgtgagcttagagcatcaccaacacttcccccaaattccaaatccaagaaatctttttaggaatctctaatcaggagttaggatttttttaaaaaaactcttatttttaatagtttgcgtaaaattagctctctaaaaaaaaagtatgcccaccttcaaccccctccatgctattgtcctctccatccgcgcgatcggtccctccccctctgcttcacgctatcaaagattggaagtggttgtgcgctcccaacttgtggagagcttaaaaattggataaggggcgttgaaattttcgggaattgattgggggggactgttggagcatgatttttaacctagaaatcatataatttttgtgttgggagctgttggtgatgctcttagttaataatctgtactcaccctatagcctataacataagtaaggtgttttggttttcttactggttaaaattttctaacttcgataagtttatagaaaaatatataaacatataaaatcaagttagtttcattaaaatccaccctgaaatatgtcttgatagtgtatttatttggtatattactatagatgttaattatctttttacatggtaaaagtagaaaatttttatttaagataaaattaaattaaaatgcctaacaatatggaactgagggagtatattgagatggattatagttacttgtttgatgtaattgcctttaacattttaatatttgataaacaacaactttaacctatgaactggatataacgtatttttttctaaccttaacttgatttgcaaaactagttataatgattatagatttaattttttcatgactataaaaggtggccaaacatggaggaacacaacaaccgtgaattgagccataataatcgtctctctcatgcctatctcgttctacatactactaattactccctccgtctcataatattagggattttaagcttttgcttacaacgtttgaccactcgtcttattaatttttttttgaaattattaattattttattcgtgacttactttattatctacagtactttaagcacaacttttcgttttttatatttgcaaaaaaaatttgaataagacgagtgatcaaacgttgcaagtaaaaactgaaaatcccttatactgtgagacggagggagtaattgttttgagaagatgcatccatgatccatgctgaattaaattgtcataccaaattgcagatagaattcctttaagaaaaggggaaagatagacgacaaagtagggcagcagggggcagggtatatactccctccgtctctaaataatatttgatgccattaactttttttaaaacatatttgaccattcgttttattcaaaaacttttgtaaaatatgtaaaactatatatatacataaaagtatatttaacaatgaatcaaatgataggaaaaaaataataattacttaaattttttaaataagacaaacggtcagacatgtttaaaaaagttaacggtgtcaaatatttatggacggagagagtatatttcagttcttaatcggataatgccattggaaaaggtaaaagatattgtgttcaaaagcggcatgttgtgtgtgcattgttccaatttgattcactactacattttttttattatgatctttttgattcgctactacttgtcttgctaccgatggataatggatatgtatggaggagtagctacctaggaaatggaccgctagtccaaattttatatgggaaagtttgtgacattagacggacctcctttcgtcagcacgatatgaaaggatgtgcccagcccgtgacagtcacactttaacggtgcatggttttgtcacccaaaacagggggactatgctacatcgcatttgcagccgacaaaattgatgagctgagatgcaaagcacggtcaagctagttaattacttcctccatttcatattacaagactttatagcattgtccacatttatatagatgttaatgaatctaatgtgcctaaattcattaattaacatctatatgaacgtgagcaatgctagaaagtcttataatcttaaacggaggtagtagttaattaggtgcgatgcaaacaacgacgggagaaaggcagaaagctagctcacatttttttttaatctctatgatcagggctactgtcaataacttcctggttaatcagggattaatcatgagctatgcaagctacctaatcctcaggttgaatttacttacttactgggccaggatatttgttaatcacctggttattgcaagatcagtgtcacttttgaatggatatggtcactatgagtatatttggtcgctcatatcctccatgcctatcctatctctctaatcctcgctaagtttaatctagtgaaggacatacacacgtagctattgggtttttcacatcggacaaacctagacacaatgagatgttgtttggttggttgcattaaaaataccaaatgtagaagagtttatttggttatatggactttcagaatagttacttctctatttggtagggtgttgatgcgaaaaacacacactggactgggagatctgtttaactccagtacaggttctaaatcttgctcttgggttcaaaggcatgccagttgatttgatccagcaatcaacaagaaaaaaacacaaagaaatcgtagttaaatccataaacgatagccgatcggttagggccgatgacgtatcgttcaaactctgagccgctggtattgataatagattggcgatgaagaataaaggaatataaggttaaatctactcgatcggctgtagatattaatgatatataatcatgttaataaaatatatttaagctaagcgattgggatatatcgaacagtatgtcgagacagtataaatcacttatactcaaatgtactttaagatgacaattatatatacatttatagagccgatcaaatagatctaacatgtatcggctaatactccgataccactctatattaagatattgaaacaaataagatatatcagacagcacacctgatatactttaatggaacaagatcttaatataaagggcagatttagcatgtcaatcaagcatacaataaataaagtagctaaatcaggtaagatcggctgaaaccccgatgctatcttcgttagagatcataaaacaagccagatattgcagttacgaatattacttaatagatcgaactcaaccgatgcagcattaagcataaggataaatacaagatctaagcaagatgatgaaaaccttagaaagatggtagatatgctatataatctagattaataacgaaatcgaaccctatcggctactctccagtgatagatactagccgatcatagattaaatcgtgaaactaataaaggttatgaaacatatatgataacttgacgattcacataaacaagattagagtaacatgaagatgcaagcactaatcccgagaacgcaagctgacataacaagtttacctcttgttgaagattgaaatcgatgcagctcaatccgaaagcaagaactcgtcgaaaacattgaaagtagaaaagggtggcgatgcgctgaaagtgttattgaactgtcgtttttaattacatgggttcgggtcatatttatacccgagatacatgataggtccttaccggacacgactcttatctctaacaaactctaaaatacaaacgaatcttcacggcggactcttgccgaaacatatctctaaagaaactattcaaaatatcctaattaatagatacaattgcctatctgtgagcttacctctatcgtggcaatcctgatgtagcacgtcgattgattccggaaacggtttcataaccatctcaacgaaatcggccgtatcggctgtatcggctatcttctgtccgacccatctcagccgatgccctcgcagccgatacgtactctgttttctgaacacaatccttcaccgaatctacttcgattctgatgtcgaacctggttcatggtttactaaatttggtcgttaacaagggttataatatatcatttttttaagaaatatattaaacacccaatataaccataataactcaaacgtcgattcttttttttttaaaaaaagagtatagtgcatggatgacctctaaacttatgtgaatgcatgtgtcatataggtccttgaagttgttatgtgtatcatataggtccaaacgggtttcaacctattccgtacgctgacgtggtatgctatagtagcacctatagtacgtgccggtgagatccatgtgttagtcacatatagaagcaaaattagaaacatatttttctcctctctctctctctctctcgcactcttaatttattatctttctatgtgactgacatgatatgtgggtcccactgacacgtaggcaatactgtaacatgccactttaggacacggagcgggttggaacctgtttgaacctatatgacatccaggacaagtttggggacttaaaagtatattatgaaatttcagggacctatataacacacaagtttagagaccacccgtgcacttcacccttaacaaaaaatacaatagtgtttgaccctcaataatggagcggccctttttacaacaattaggtggaaaaagaaaaaaaggaaaaagggaaaaagaaataaagaaaaaggagagaggactcgagaagagctttgtctcatcgtcgttggtctattcgcctgttcgccatttagcaccactcaccaccgccagaaccaccagatccgatgggcacgagctcaaggccactagatctaatgttggcgagctcgtggccatgggatcctgcatcgcgatggctgaaagagaggacaacggccactagatctaatgttgaaggcggcagccggtgagaaagtagtgaagtggcgtcagtagtgtgatggaggtgcggtagcgctcctcttcccagatctagtagtgatgggaagcaatgccaaccagatccagttaggcgagtggtggggcgatgaagatgacgggcgtgcctcgatgaagatgacgacaacgaccatggagcgatgggaagacaccgctgatgtgcctatttacccatcgcagccctccgcccaccactcctcgctgcattggatctggcggccggcgacagaagaaggtgcgggacgatggtggccaatgattgaaggtgcgggaactacttgaacaggagggatgtagcagcaaggtggatccatcgtgcaccattccctccatcaagctcattgtccccatcttcattgcctcatcgcttgctggggagaaatgaggagtgtccaggagcaaggtgttgaccccatagcctatccttgcacatgtgggcctggccgagtagcgaagctcaaattgagcattccaacttagcttgactcggggtggtggtgtggggggggggaggggctttttgcatccgttcgtccatgctaggagcgacatgcatgcaaccaaatgacaacccattgcatccgtgcatgcgagccaggtaccatgcaggcaaccaaacatgccctatggtttggtcccttacgggcccaaccttaatatgtaataccacccccgccttgccagtgctagcaaggcccgccgatcaccacctccctccatcctactctgtatgtgttggggcatcttcttttattcctcaagtcaaataagaacccaatcccctacttctcatcctctgtcagtctgtctctagctgcttttttttgttgggggtagtacactacccctatctgtgtcccgtcccttcccttgcctcctaaccacttcgacaacaagtagtcgctagctcacactagcttagtgctctcctcctatactgtggctaaggtggctccctaccacctggctagctagcaggggcacaaatccaaaaaaaatggccaagtatccagaggcggggaacgtgccgagggtagtatgggtgggtatgaaaatactgaattcggtcaatttgtctagtaccctcggttaagcaaatagatcggactgagcagatgagctgtcccccatcccgcatcaccttgctgcctccattaagcaccttgtgacatcctggcccaatcaggatgaggcatgtgtagcccatgtgagctgtgtgcgtatgtttagtacaaccttgctagtttaacaagggtggaaccaacttacaaggccgtgtccctccaactataccactcccagattaacccttttacacaaagcgagaacgaaaatgtaagtgtggtggtatgtgtaagtgggtccgcccgtcggatggactagctatgcggttctgaagggagggctgttgcacacccgcaccacctcgttgcccccatctagcaccggtgcggtaggccactaaccacatatccaaccttcctcctccactcctccacatcacgtgctcccttacaacagtgtgttcgcaggacgccgctccgagccttcgatgcttgcgtgtgtgctggcagtagcagagatccatgagcgatggctggagatgggttcatgtgttttgtgatttttgacgattgtgtgtttgtttggttttttgatgatcttggactctgtgtgatgcttgcatccctagatgatctttttggataactctagatgattttggtcatgatcgagaccgtattgcttggtcctaacttttttttaatgtaagtcaatcttaattttgagatgaccaaaacttcctcaatgaccgaagactgagatggaatccctacccctagaggataggccccctcctacatattctttttatgtaggattatttaattaaatcgataattaacataaatagtgtattaggcactctccatatctcttacctctcatcttgggtcagtagatgccggtgtcccatacatgtcactatatcataactaaacttcttgtgctctcaacatcaagcacttctatatacttttgtttctatatcattatatgctatcatttaattaagattgaatagttagtttggtccttaaacttttacttctgagtcaaattagtccttgatatttcatagtggccaaaggctgagtgcctgtttagatcccctgataaaatttttcaccctatcacatcgaatgtttgaacacatgcattgagtattaaatataaacaaaaaaaaaactaattacacagattgcgtgtaaattgcgagacgaatcttttaagcctaattgctccatgatttgacaatgtggtactacattaaacatttgttaattaggcttaataaattcgtctcacggtttataagatgaatctgtaatttgttttattattagtctacatttaatacttcaaatgtgtatcagtaaatccaatgtgacacgctgaaactttacacctttggataaacaccctcttagacctgaagaaaggaccattttggaaatactatattattcactgggatccaattcacgttcgtcttgcaaatttcaggaccacaaaattaatatctgtcaaatccaaggggctttctaagaaatgtcaggatcaggatcggttagtttggtatcatctgagccattggttcgaccggccggcgaggagttccacgcgccgccgccgccgcttctcctccagccgccggcggggcctcccttcctacccaagcctccgccgccgttcccatctcctcgtcctccgtgccaccgccggcgcctcttccgctgaatccatctccacctcctcacctattcgctaacgccgcctcccatcctctcttctctccgggctccggctagatccaagtcggcgtcgagatccagggctcgaaaacccctcacctatccaaggatttcaggtagtgatctctgcgaattccttgaaactgcatgcttttttaaaaaaaactcctgtggacactttaacaatccaaaatgataaagtagttaattggcttatttcctcacttttctatctaccaattggttcgttaattcatatagatatatcttaattgcttagtaaagattatctcttggattgttgtgtactcgtcgatttttgatattatcgagccgtcccgaaataatggctatagtttccatcttccattgggtagtgttcattgttgtctccgtttcagcgttataaatcaaacattgtgcaaattgtagatagaaaaaattgtgaagattgaggaaaactatcctacggctcaatgagcagagccggtatgtcagacaaccagtgaagtccatgtcttatgcccaatgcttgcactcaaacctcattcctttcctaggttaaagtatgctgttttattttggccttggtgcacatttaagcaccagatcttttactcccattttcatgtccgcaaattcatgaaccagcagattaatcatacatgtacaccaattaaatattgtaacagaagagatatatattcatattcaacatatatgcatagaggtgaagagtaatcggttactgggcatgttgctggtgctattcttgttattcttaacgcccgatgtagataaggatgccgagaataattcattcttctgtgtacagcgacgagggctatggttcactgctgggcattgctgcctgtctttgctgtcgatttgacatagtccttcctaatcttcttcagcatcacgaccacatccttcatttccatcctttgctctggggagtcagccgagcagagcaagcccagctcgaagactggcttaaggaatccatcaatgctactggtagaacaagaggtgtcctgtagaagctggccatcgacaacatggacaagatctataggaaatgcccagtgaacccactgcctgatgctcagatctcccacaaacatggcatctgtgggtctcttcctagtgaacacttcaagtagcatgatcccatagctgaacacatcgctcttccgtgacgcttttccaagaaccccatactctgcacaagaaaattagattaatgacaactgattgcaccacttaattgttgtgaaaagatcaactgggttgagtaagagtacaaaagctactaagtacctggtgccatgtaaccaattgttcctggcatgcttgcagagatcgtagagttatcatcgcctagtaacaacctcgcaatgccaaagtctgccacatgtgccgtcatttcatcatcgaatagcacattactaggcttcaaatcacagtgtacgaccacctcatagtgctcatggtgcaggtattccattgccattgacacatctagcataatatccaacctctcgagaaagcctaactgcatcctttcttccgagtgtaggagtgcttctaagctaccctgaggcatgtactgaagaaccaatgctctgaactccaggttggagcatgtgttcaatatctttatcaagttgcgatgtcgagccattcgaagcacacgacactcagtatcaaagcttctcatggcatgttccagatggttgtgtataacttttatggcaaccaccaaaccgctactcaactggcccttaaaaacttttccgaagcttccagatcccaacatattgtcttcactgaaattatcggtagcgcgaacaagctcatggtaggagagtaattggtggctgatcatgtcaagcataccagaagaaatattttgatgcttaactttctttctaattattccatataggcaacaagttaccgctgcaactactatgattatacccgggagtaaaatatactttagtatgtgtcgatttcttttgggagaggttgtttggcatggagaaaatcctaaacggacaacaccacatagccctgagttccctgccaaggattgcaacgtgatgtttgagaagacacctccttctggtatctgaccttcaagcttattaaaagacagatttaggttagcaaggctggtaaaattggccaggtattttgggatggtaccagaaatgttgttatgggatatatccaaaatttgcaagccagataggttactgaaagagtctggaatggaatcatggaattcattgacagataagttcaggtatcctaacatctgaagatgtccaattgaatcagggaggctaccgacaaagcggttcatatagatatccatgtagttaatttgttttatattgcctatatcaactggcaattcaccactgaagaaattttgagatagatctagcaggatgagcctatcaagatgaaataagctcggtggtactgttgatgataattggttatgacctaatgctaggtgctctaacttggtcaaattactggggtccaattgtaagccagagaacttgttggttccaatgtatattaattcaatattatttagcatgccagtgtttaatgggatggagccagacaagttatttgtctccaagttaaggaatacaagattcctcatcatcatgattgattctggaattttaccatgcagttggtttcccccgagatctagcacctgaatcccagttaaattcgaaatcatagctggaagttcaccggtaaagctgttctcaaatgcagagaatactcgcaacagacttgacagattccctacactgcctgggaggctcccggtgaaatgattcgagtagatgtaaagggtagacagatttatacagttggaaagtatggatagaaagtaaccgatatctccctgtaggttgttttgtgcaatactgagttgcttcaacgagttcatgttaccaattgttgccggtactgagccatccaactggttctctgccaatgaaaggattgtcaatgctgataggttaccaagacaagcaggaatgggacctgttagttgattggttgtaagatccagcactgaaagttggcctagttgtccaatacccacagggatggcccctattaggttgcacatttcaaggcctagtctggttagcatggtgaggttgctaagtgcagcagggattgggccagcatcaaggtgattcctactcaaagaaacatcactgagattcgtcgacttggccagccacgaagggaaaacaccctcaaatagattgtcaccgacgcgaagaacttggaggtacggacacgctgcgagtcctggtggaatttgaccggtgaatctattatgggagattgagaaccactgcagaaccgggaggctgaaacttgtgttgcccgggatggagccggtcaagctattaaagccaagatcaacaacagttaacctagacatgttgaagatggcttgtggcactggcccagtgagattattgtactgcagctcaagcaactcgagcattggcaaagagccgatgcaacctggtataggtcctgacaggctgttgttgccaatactgagataagctaacaaaggcgtgttgttgaatagactgtccggtatcgagccagtaaggtaattcccaatgagatcaatgctgcgaaggcggcgcaaggcctgtagttctattgggattggaccggatagctggttcgacgggaggtggagtagttgaagcctcatgaggttccctatggtggctgggatgccacctgaaagggcattgtggccaagatcaatgagcttgaggcgatgtagccttcctatatcatccggcaccgagcccgtgaggccggtatcggtgaggttgaggacggagaggaaagaaatgttaccgaggtgaggcccgagctctccttggagaggaatgcccggcagctccagggcggtgacgcgctgccggtggcggctgcacgagacacccacccactggcagaacggtgtgccagcggtccagttgccggcaaggatgttgtcaggatcggagaagtgcactttcaaagccagaagcgcagcgaggtcggtgtcgctgccattgctcttgctcagacctagagaagaagcagaagccacaatggacagagcaatcaacagcgcaacggagatccataccggcaatccaatcgccatgtctgggtgtgtgtgatgcattgacaaggagtgaagtaacttcactggacgaacaagttgtggttttatttagcaactcggtgctttcaacgtctaggacgaagaccttgactgttgctctcagaaagtgcaagaaactgtaacacttttgataattaggaatgctagtaccacagacttgctggaaaataatgtcatcacagactatatattcaaccgatcacagcgtgcacgacaagctagatatgagagctgtctctctctcagccatcagccatacactcactgaaaaataattttctgtcaaacaacttgaaggcaaccttagtctttgtcgattgggtggttagtggcgggccttatcaggaaaaatgtctagtacaaatttagaaactactgttgggtacataatagatgtctgagatttgtccacgtcaccctgactatttttttttactccaaatttgttactcctagacttatctatgcgtaatctttttacttcaaaaatgtgaacaaatctcaaacgtctatttgaatatccaacgatagtttttacgtttgtcctacatatatatatagagtttacactacatatttttccgtcttgttagccttaacaagacaggatacacggcctgttcagttatgtagttatcatacagctgtcaggtccgttttgcgtgacagcgtgaagatgtgcaccctgaaggtctgtgatgctgttgtcttttggaccatttgaatgtttttgtttacctggaaagtttgtgtaagtttctctgatgatgctgtgccgacttattatcagctggaatgataatttaatttgtcttagtagttctgatgctctgcttatactcttaggaatgttttgtttgtgtaaagacttcgttcatgctccttggctttctccaaaacccgggtcaataataagaaaaaagtgctctttcacctcccccctgcacgcacatataatcatgcatccaaaccaatttcatgtaggtgtcggtatcagtttactaaatcgatcagacgatggtagcttagcttatgttcattcaccagtgtgccttcatcggcagcagatgaacacaaccttagctcggctgtcttttaatttgattgacatactgtgcccatagtcaggaaactgggtcgaattcagcgttccttaacccgggactgccatcccccgtcttagacacacaggtcattttcatttccccaccttataaaaacatcttacaagtagcgtatcacggtttctcgactctgtcgatccgggaactttgtgagtgcctaatctagtatgctctgcaaatcgtagccgatcacgtacgttctctccatccacctgcacccacttgcacttatctacgcaccacaatctcactgcaacatcaatggtatcactactacagagaatctaaaaggggttggttgaaaatctcatataggtatcgaatttcccaacaagcatctcgcagacggtaccaatgagaaagaatcaaaggtatattggttttggaaccggcacttataatacctacaacgagaaaagaaaaatgagtcaactcgatgaatcgagctaatgaattgaccccatcatcactccaaatattgcagttgagatccacattaaaggcataaaaatcgagaagccatggaagaaaaaatcaagaacattcattacatttcgctcaaaaataaatcaagaatattcatcacattgcacacaacaattcatgtttggatccaacatgaacccatatgccccaaatcacgaactcctgcatatttcccttctcaaaaatcaagaaaccccaacgcaaaaacagaaaagtgggcaccggcgtcatcactggtgaatccccgcagcaggggaattcgcagttgaagtagtccttctgtggatccatcatgccatcctctctcgccgccgtggtgatcccgagcttgagggctgtcggagctggcccccacagccccgtgtctcctcctcgacctcacgggagagatggaaggatgagccggacctcctcgtcgccaccgtgtcaacctcccaccgaccggatctggtggccagggcgggacgacgtaggggagagggagaggggccgacaccgctgcgtatgggagaggcgtggttcgggagaggagaagatgaggcacgcgaggtgataagagcgtgattttttttctcatgctccacgcccatcggctcaattcaatcagtattggtttttttaaaacaccagcacttgtacgtactcaaaggtgctagttttcaataggaatcaacacctttctctgacaggagtcataggtgccagttcgtattaagaaccgatacctatctctttataaaggtgtcagttctaccggatggcgccctatgggcatgtgcctcggacgggggtttgtaggtgccggttttagtatttccgatacctacagcatcgtcactgttgtatatttctgtagtaacgtgtagggatgatcgattagtcgatgcacacaatatatcgtcagataatttaggaagggatcaggaataacttaagctagttaacctcgtgtaacaccttgaaaatttcggttttaaaatacgaaactaaaaattcggaataaccaaaaatcttttctaacttccttgcatgctggaatttattggatgttatttcctgttttcctgttatgcatggactaaagaacgaacgtctgagaatatgtttgtattttgattttaaaatattatttattcaaagaaacatgattatgaaatatgttaatatttgcaaataccaattgtcttcctaaaaacccttctctatataatagaacccctctgacatatttgctctataaataaagttatatattactatttggatggacaccctctatgggatagtacattaaaacaaatactatttcacaaaggaaatatagctctgactattttctaagaattcttaaaagggaataagccctttggaaaatgacttgcaaatgatatctactagtaaagtatttgttaaaatcctatttgtcaaatataattcctaaaaggctatttttaaagaaaaggctttctcagataaagtctggtttctctctttgagaggcctagcccagcccacataatggaatttttaattgttgtgtgtgtttagatttttgagccaaagatctcgactaaaccttatctcctaaaaggatgccctccgttcaacgtcctttcctttcattatcctcccggtctgatttattaagtgcttcggtactaaacaaatcaaagacccgaaactctctcctcttatcgcaatattatcactctctcaaactcttatcctacggttaaattaaaaccgctctattgatttgaattcgataattccctcgaaaaatctacaatcgttcgacagatttatttgtcgtgcgtcgattcgaatatctccaattctatccctatttttgaaccctaccgcgtcgattggatttgtatgccatgcgtcgtccctaaaacccctttgtgttaccgtcgttcgttcgtgcaagcgctcacaaagaaatcgcggtgtattcagccaagcaagatgcaggaaaagctctatgcttgacccttgctcatccaaatgccaatttaaattcaaaagctcacagttccagtccacatatacaatccatgtgcatactcgaattcaaatgtccaagttacacagtcccattacaattatacagtcccgttacaaatacactgtccatttacaaatcccagaaaaatactattacagtggaccaccttttccagcccaagcccactgccagcccactccctctctccttctcagccaactcatcataagtctgttttgcctccctgcatcaacacagccgaatcagccagcatgcatgcacaaaacatgctcgagggaatgcctacaagccacagcattgatttgcaccaaattttgccagccaacaaatgcctgggtcccctcccccaacaacatcccatacacccatgctcccaatccacagaaccatcccccaaaacacaggaaatacagtgagatgagtccacaccgaaaaacaacgccaagtccaggaaacaaagctcaccttggctcctacctacactccaaccgccgagaacgtatataagccgccgccaaaaaccatcaccccctgcacctcctcatttttcctctcctctccctactctgcatttttgttctgccactgcctctcctctgtccagcgcattggctgccgccactactacagaatcggtttttgcatacgggcgaacacgatcttcgcatgcggtcggccggcccgcatgcgcgaaatggtctgcaaagatcgccattagcgcatgcggccggtctagccgcatgcaaagatcgatcttcgcatgcgtctcttaagacggccgcttgcaaaaatacatcttcgcacgcggtccatttaagcagccgtatgcgaagatctatttctccatgcggtcgacttaactagaccgcatgcgaagatctattttcgcatgcggccatcttaagtagaccgcatgcgaaattcaatttccggatagcttaaataatatttattttagccttttggtgagatgtgtctcgtaattaatattaaattattgagggatttattatcgtatttcggaatagtaagcatatgacataagacaagtgccacagtaacaaacatgtaatacataaccataaattcaatcgtaatttacatacgaaatatataatacaagtgccacagttttttcatcatatgtataagtagtgtacatgtcattgcatatgttctttctcccactctctgagaggtttaaatttgtcgtccattgtgagttcactctggttgtcgtagaagagacctcttgcgttgcagacatcacgacggatgaatcggcagaggttagcggccacgttcaagatagtactgtcgttgaatcattgtacaatatatgggatttcagggatctgcgcacagaaaggaaaataaaatggtactcagtgagaagtgtgtgctagatgggtttctttgtagagaagagttcgctgacttactcggttactggttgttttgtacctcccgtttactctgagcatctcgcacacgtaataaccgcacaagttggttcccggtggttgtttgtagcactgcgatataattgtgagggaccgatctcactagatataatttagtatatatgtattgttctataattagttgtatcggtatagatttgatagtaccagccagccagtcctggcagataactgcttctaggatggaatatgtactggtctgcctcttttgcggtagtacttgtgtgctctgtttgaagaaaacaattgttttttcagtagttagaagactagggatcgacctaaacaatttatattaatgaaatgtttatcacttacaaattcaaaatagtgaggaattccataaatgtctccttgtcatagtgtgcggggtccaatgatatgatcaattgatcttttggatatacaaggaataatatgtagtggtctctgcatataagataggcttattggagacataaaattccgaagaagataaattaattaaacaaaaagaagagaaagcgtacgtgaacgcgtatgggaccattaagacatcttcgtcagcgtgcgccaacattgctattgctaagtatgttgctacttctagcttcttcctcttgtgcaatgtcttcacatattctcccttctcttgaggggtcttgccaaccaattgctcgcagtcctctctcagctctacgatgtgttgtgttttgcatattcttgttggatcgatgtatccaacctttgctccagttctatcagcttcgtggaattgcatactgtacaatgaacaaagaagtaatgagatttggtttctttgtttggaatgatacgtgtaacatgtaataaagagttcagacttacagacagaacgccgcaacgtgattaacgtccattttatctagcttgtagagggcataaaggtctcggaaagagataaaaaatatcccattaggaccactcatgaaagcgccttccgggacggcgacgcttatgaaaccgagacccttcctagatgccttgatataccattcgtgcattaccctcatttcccatggtagcttattcataagataagttggcaagaatggcttgccatactcataagtttcaggcacaccggcagataaccaggattgcacttcatcttgggccgctagtactgacttctgggagtctgacatgacgtgagcaagttcttttctcttctcagaattcctgaaagctaaaaacatgaacttctccttatccttgtcaatctcctttgggtcgtatgtcgatatcaactttggaattatacgacgaggttcgaaaggattagacttcggttcagatgtagtaccttctggtatgtgcacttgttctactagagcagattggggtgtaggtggagaggcttgaactgagggcggagccgggggagcatgctgtttagctggggacgtgggagaggcttgaactggttgcggagccggaaaagcaggctgtagagaaggggagggtggtggtgtaggttggcgaggcggtgacctaagcgatggtggtgatgccggatctcgaggtgacggtggttcaggaggcgacggtggtgcaggagcggcagctgtccttgcttgcgatgaggatggagttgaagatcctactgctggaacggccgcggtcaggattatgtctctgcggtgccacaagataaactgattcactgcatcaccgagaagttcaatccccttaggtgcaggtatgtctagttccaaggaaatgtggtcgctatggaccttggcgacctgtacccttgcgtaatcctcagggattgccgtgttgtggaattgatgtctgggtatcgctaaacccgttgcaacctccttagtctttccagcgcggccgataggtacgacgagactgcacggagttggtccagttatactattcacagggaagggagttgtctccactgagcctacactactgggtacattagttgtttgctatgcggattgtgtgggttgctggccatcagggaataaccttggaaaggctgtcgggtttttagctgccaacgagtagaagtgttccttcacttgcgcatagattttgtctgatagttgttctttgtatttgtctctcttcttataacttggtgcgtcttgtggaaaccctatcttccaactcgtctttgaggacaaaccccttacacgttcagagtgttcggcggtccccaacgtcgctgtaagctggtctcgctccctccgtgggacgaactgtcctgctctttctttctcgactatctgctgcaaattagtagtcacttgttctatgtctagagtctcgaatagtatgtctccctcatccgagacttgacctgtgctacgcgccaaaacagagttcttgctacgttccgccatggggtctaccaacagaggtttgccggccgctgcaaatctttgctcggtctcccgccactgatttacgtgcccagcgtatccgctcgaccccaatctatggggatatttgttcttcttcgcgaggtctgacatttttttactcaaagccaatgcttcatctgttgtatgatctttaacaaacgtatcccagtcagcctccgatatatgtccatattccgtgaacggtgggagattcttctgaacataatcccgatttagatcggacttccactgtcgccatcgatctcccatctttttaagtgcgtaatctctcctcctgacctctgatccaggagggtacacaaaatacttctgcaactcattccaaagaagtgtcttgatgttgtcgtccaccgtttcccataacttgacattaatgggacaacgcgtcctgactagagtgccacaggtgttgctaaacttggaccgcactatcagtggctcgacgggcttcctatcctgatcgagagcaatcacgttgtaaatttcctttggtaatttatttttgcttctctcaccacgtctttttttcccactcccgcctgcacttatagatgtatccgtacgttcaggtgcagacgtagtagtgtccatctcaacttcttcctctctcctggtcctcgcggctttgcgtttcgagcggcgtcggactaccatctgcacagtataggtaactctctacaccattaggttcatgtcacatcatagttagtaaataatatatggctaacgatgttcagcacttacggcctgttccataggtatgtagtccggatcatcatcgcgagggacgacttgtgttatttccattggaaacgggtcacttggtgtgcgccatgtttcttcactagaagcgtcaggctgcttgttgctaccggatttttgatgagcgtaaccttcttgaggcgttattggtgcgttcgatggaacctaatcgttccacattttccaacttaacgttaaaaaatttgacataagtcccaatttgacgtaagtcccaatttaacataatttgacataagtcccaatttgacgtaaggggtaccgaatgtcatcaaaggggcggcgcg

SEQ ID NO: 61998 - DNA, 4812 bp, Oryza sativa
gtagttatcccactattcaatattcactattttggtgggaggttgaagggggcgaatttttgccattttttccaagaagaacatgaaaatcataaaagtaagtaaaatggtactgatcatttcttattaatttagtagtacttatcttataagatgttaactaatattttgtgtatttttcaacgatggatcgaagttggatgtatacgacttctttgaagcgtcagtataaagagtatagagatggcgtattaagttttatgaataacgcggaggaggataggagaagaagaaacaacaagttttatatatgctgatcttgggtttttggttgggtacattgaggtttttcttttctgatagaccataaagaaatgtcattacgaactgcagcatttccgaaaatgagcacgttgatcttgccactacagcactagaacctaatcaggaacagatcaaatttaagctgatgtggatgtctaaatttgctttgagagaggtgtacatatgttgaaaataaacgaactacagctaaaaaatatttttgatcaggttcctagcacccctctctcaacaagtagatccgcccttgaacctaatatataaaagactactgataaacatgttggatgaggtaaaagctagaaatgttctttgatcccatcaacaactggtattgcatctgaacttccacctgcctcgccatgcatgattgcaaaaagaccattgccaaattgtggcggaacaagtccccaaaaagtataagaatgtagcggttcacctctccgagcctcccagggctaaaattcctctggatcattttgttttggtgtactacatatggccattggggtacaatggctttgaggatataaagttgcaagggtcaggaaagagacaaagacatatatttatagtggaatttactagacctgctgttactacaaatttatttataggggagtgtatatagcgaaagctagtgtcgcaaaagaaaacggaggaaaagacttgtagaaaggacccttccaatgaaaaatatattattttagcaagtttgagaagtgtgctcaataaaaccaagggagtatctctaggacagcagcagtaatgaatgctgcctgtcctcctaagggcttccttcaagttgcagttggtttcttatgtgatttttatattattatggcattcatctattacaactttacatcaaaagtagccgacagattgtgaacggtgatggtagatcgtagagtttaagggaaagacaatagtatattatggatatcgacaaagtcagtggcatattgttgaactgtgacgaacttagtagtactaagtagattttctgagtggtctttcgttgttattccgtagggttatttttgttaaaaagaaaaagaaagtagttcatgtagatagaaattttttttaccatcgtcgggtttgtatgaatgtgttaacctaactagcaagattcaaaatgtgtaacgccttccacgcacatctgctatggtacaacttagattattttgaccagtaattgatcacttgtaaccaaagtatgcagatttttaatgatgattagaattgaccaggaatcgtgccaccatgatgcgagtcatcgtctctcatctaggtacaaacaagatccagcagtggcaccaacaccagcacgcatgaacgagtcccaattagaccggattaactcacccacaaaatactaggaagccctttccagtttttttataaaaatccacaaactttaactttaagtatcatatagaaaactttaaccttaggctgtgtcctttggacaactttcccaacttcactccctcattttccgggcgcacgcttttcaaactattaaacggtgtattttttgcaaaaaaaaaagtttctatagaaaagttgttgtaaaaaattatattaatttattttttttaagttttttaagctaatacttaactaatcatacactaataaggtatcttgatttccgtgtggaggaaattagttcccaacacaagcaaacaaacacatccaagacttggccctgtttggttccatgggctaattattagtctccaccttttagctatgaattagccccaaggatctaaacaggtgggctaatttggggctaaagtaaattcactactagaaaaacgatttttcatgacatttggaaaatatttttcatggcggctacaagaaaaaaccgctagcgtagaaaatcgggggggatcacgggcacattaagagatccaccatataaaatactatatttttcgatgtctaccagcgaaaatcagtatttttgctggcggctactaaacagatccgctagcaaaatgaaaaagattcaccagcgaaaagcaaacttcgctaaaaaattttcgcagtatttaaaacgcgcgctagccttcacccacccacccactgcatttatctctcatcttcccctcacctctcccagatctagccgagcctctccccttccctcccacctcacctctctcccctcccctcccacctcaccgcagcgacggcaggcagacctggcgggcggcgacgctcgggctcgggcgaggaggccggatccgcggggaggcggcgtcgccgggctgcgggaggccggatccgcgaggaggcgtcaccgccgggccacgagaggccatatccgcggggaggcggcgccgccgagccacgacgacgacgacgaccatggcgaccacgacgacaggccggccgcgggcggcggatgtacggcggcgggaggggcggagggcctcctcctcctcccctcccccacggccccacctctctcccctcctccttcccacgacgacagatgtgtggcggcgggagggacggcgaccaccacgacgatgacgaccatggcaattggtgacgatgaccacgacgaccacgacgacaggcaaccggagggcctcctcctcctcccctcccctccctctccctctcccagatctagccggagggtggaggcggcagcgaccgccgcgacggcgatggtaggcgggcgacgacatgtattgctccattttgtttgtactgatgtttcatatatgcatgtattgatgtttgtttgttgagaatgaagtgagaaattgatgtagtgttctcttgatgttggatctgatgtggatttgaattgttatggatttgagatttggggatgtggatttgggaatgcaggtagcagcatggagtttttgctggcggctggaggccagctgcatatggtttttttttctcaaaccgattatcgctggcggccagtataacacagctaccagtgaaaatcgattatcgctggcggccgataaccgctagcgaagattgatattttctctggcctttgctttgtggcggctgcaatttccgccaggaaaaaccaaaaatggccgtcacgaaagatgattttcgtagtagtgattagctcccctcgaaacattagcccctctaagggatgataatggggctaattttttatggggaccatcgaaaagcagccctatctccccccatctctctcctctctcttcaccttttagccctcaattaactcatggatccaaatatatcattctaggctaatgtttagcctaccaattcaagactaaacattagctctcaaaattagcccggtgctaatcttctaaacagggccttaatatcgaaggtaccaaattttggtgtctcacaaattataatgtttggtgactcttagtacattttgaagaatggtaaaaagctgaaagaaagagagagaagattgctaaagtgttattctaaatctggaaaaaaaagtatgctatcatttttaagagaaacacatctaactctaacaacaagtaactcagccctaatctggcagcgctcctacaagccaggatatctgttattcaagagttggatgttgtctatgtcggctttactatgctagctgaatctggttttgcagcattcttgtcgttgacaaaagcgatgttagcactaatccaaacttgcatattgtttttagtcttgcatgagttgcatgtagataggcacgtgatatgtttatgttgatccactagatagatgcatatgtgtgtcatgtaaacaatggttagtccaagctttgcatgtagagttagttagtgctagtgattggaagatgcatgtgttgcagcataactagcaactgaacaagtctagggaataagaggattagtggcgaattagttagctgcatgcaagattagtggagcatgtttgtggcgtggtttagtcagctcggaggagcgattcttgcgcgtgagacgcatagatcgtgtgagtgagtggctcatggtcgtgcgggcgacccggtcgggctgttagctactccctccgtttcataatgtaagtcattctagcatttctcatattcatattgatattaatgaatctaaatataaatgtggaaaatgctagaatgacttatattgtgaaacggaggaagtagctatatgtgcatgtacgcgaggctacataagccgtgtaatcatcagtttgtaagtgagtgaagaaaagaaaaggcatttgttgccaagaaaaaacttgtgtgtgtgcttgtgcacttctgtgtgttcatccccagagagctattgtgtgtgtttgttgctccgtgagtgtgctgctcacgtgaatttgatccttggccaaagctaaaaagcgacaccctattgtggatgaagcaagtcagccaaaaatgcaccaaacttagcagccgctaagccaaaagatgcaatacagtag

SEQ ID NO: 61999 - DNA, 33504 bp, Oryza sativa
ggcatatatctgaccgggaccaacgtgccatctccaggaggtaacacgccggctccggctagggacgagtgcttggaggctctcatcctgacgggatggggcgaggcgtgcgtcagaccgcctgtcgccacctaacccacgatctgatcggtctgtgaccagtcacagaccggataaacgagcacgctgcactgcgttacatgcggcgtgacgcgctcgtccaaaccgcaataaatgcggttaggtgagccccgctgcgctcacctaacccatacacgcggcgcaaaatccacaaggggtcggggcgcctcagtcgtcggggccgaaacgggagcggtccgacccctcggggagacaaagagggaggcggccacatcaccctcgggcccgacccccccccccccccccccgagggggtcaggcctcgtaggtgattgctcctgcccaagcctctagtcatgatactcccggtcccatgtcaccgacatatatatatatatatatatatacagtctttcgtttcagagttatgcaagaattcggttcctgccactataaaaatatcatatagtactataatttggtaattgtagaaaaaaacctgtgttaattaatatactccctccgtcccaaattataagacctatatattttttacacagtcttcaataacatactttaactagtattttattctattttatgatctcgataaatatgaaattagcattatatgaaagtattttaaaatataaatctagtgatataatatgtaatacttagtatagatatagttagtatggttattactcaaaaggtaccgagtttaatttttcttaaaaagaggcaccttataatttgggacggaaggagtagttaattcgagctcaaattactacaaaattcttctcaaatactataattaatgtgtgacgcatatcgggctggctgggcggccagtcacgaaggtttcaaatcatcgtgattcagtttccaaaaaggaaaatcgtttgacatgtttgcgccggggtgtttacatttacaggtgtaaagttttggcttgtcacatcgtgtataccaccacacatttgaagtattaaacgtagactaataaaaaaataaattacagattccgcatgtaaactgtgagacaaatttattaagtataattaatctattattagcaaatgtttactgtagcacaatattgccaaatcatggactaattaggcttaaaaattcatctcgcaatttacacgcaatctgtgtaattagttttttctatatttaatagtcatgcatgtgtcaaacattccatgtgagatggtataaagtttggtgtgggaactaaatacccccttatggtgggggtagcaatgcatggctggccattgcgagatgattataaaatataaaaaacacaggaataattaaatatttgatttgatcgtaagaaaaaacataacgatttaagggaagataaagattcaaaggaaacttttcattaatttctatctcatacttcctcagtttcatattataagactttctagcattgcccacattcatatatttgttaatgaatataaatacatatatatgtctagattcattaacatttatattaatgtgagcaatgctagaaagtcttataacctgaaatgaagtgagtattacatttcctccggaaactagtatagaatgagatatctcatgaacgcaatgcaatgcgacaaacactcaggttacgactaaaggcaactgctagtgagccggtgttggtggtagggcaaagcaaggcgaatgagctctaagccgaacctatttagaaataagttcatcttagatcccttaacttatagcgagtttgattttcgtcattgaaccacaataccagaaacaacagatttctcaaatattaaaaccggtgcagataaggtcgctcgacggtttggatggcggttttggcttatgtagcacttacgtggttggtttgatttgtcctcgtcctacgtgacagtgatgtggcactggaagtaaaatatgaaattaaaaattaaaacaaaaaatatggagcccacatgttagtaagacaaaagattaaaaaaagtgggatattactgccatgggacctcctttgaatggtttgagtaagtttaggggtagatatttttggttttgtggttaaggtaccaaaaaaatctcgctcttaagttaagggacctgcagtgaacttagtccttaaataaaattttatttcggcccacacttccgtcaccggcctataaaattggcccggtttccccccttccgcttcaacctccgttcccccttccccttcaacctccgccactatacctggccaaatgggccgtgccaagctgggccggcccgagcacggcagtactgtagccggcccaggcccggcacggcacgccagcctgtgggccgtgccagcacggcccgttatcccgtgccgtgtttgggccgacgcctcagcccgtgggccggcacggcacggcacgtttactgtagcgtgccggcacggcacggcccaggcatggcacggcccaccggcccatttatttttcctacgattttctaatttttcccatatatttctcatattttttagttttttccacattttatcctatttgtaccatatattttatgatatatttcctaaattttcctcacatttatcatatatttataatgttttcctttatattatattttttctgccttttttcttttttttcccctcaaatttcaatttttatgggccacatgtactagtgggccggctaccagcccacggtccactacagtagccgtgccggcccggcacggcccagcacctccttgggccgtgcttgggccgaggccttggcacgtgggccggcacggcacggcccgctacaggagtcgtgcctaacgggccgtgccctagtgggccgtgccgtcagtgtgccgtgccgtgctgggccgggccgcccgtttggcctgctatatccgccacactccggagtacgagctgacgaaaatggctgtcgccgacgccgatgacgaggagaaggggcgagcgggagtcgccaatggcgtcctcctcgcgttcctcgcaccagaggaagcgctcgcgctcgggggcgaccacaatgaagcgctccacggcgagctgcgcgtgcgccagggacacgaggtcgacgcgggcggggacgacgatgacgaagcgtggcgcggcgaggtgcgcgctccccagggccgcgcgtacgacgacgacgcggccgaggacgaggaggggctgcgcttcctccccggccgcgcgcgctacggcgtggagacgcgcggcttccgcgcggaggacgtcggcgacgaggggtgccgcggccagggacacgaggtcgacgcggccggggacgccgacgacgaagcgcggcgcggcgaggtgcgcgctccccagggccgcgcgtacgacgacgacgcggccgaggacgaggaggggctgcgcttcctccccggccgcgcgctcggcgaggaggtgcggggcgtgctcccgctccgcgaccgcgcactgcgcctccgccgcgaccgcatgggctacgatgacgagggggatgtccttcgcctccaggcccgcggtgacgcggaggacgacgaggggctgctccgccgccgcgcgcacggcgaggggctcccccttcccgcattcggtgtcagcggcgagaggcgcccgctcggcggccgcgcgcgcctctactacgacgccaacgacgactaccaggggctccgcggccgcgcgcgctacggcgtggagacgcgcggcttctgcgcggaggacgtcggcgacgaggggcgccgcggccgcgctcacgacgacgggcacgagcgacaccgaggacgcgggcgcgtgggcggcgagaggcagagcagctgcgcgaacgacgacgaccaaggcctccgcggcggcgcgcacgacgatcctgacgagccgcgccgtggccgcgtgcttctcacgctccgtgcccgcctcaaggacgacgacgacgaggaattgatgcgtgaccaggagggcgccctcggggacgaggtccaccggggcgcgaacggctaccgcgagggccatcgctccgcgcacgacgacggcgagggacccccgttcgccgcgctcgacgacggcgaggagcgcccgctcggcggccttgtcgaggagctgttcgtttgccgcctcggggacgacgacgaggtccgcgtcggtgcgaaccacaacggcgaggggcgccgactccgcggcccccgtcccgatggcgaggaggcgcgcgtgcgctgcggccgcgcgtaccagctcgcgccccgcgcccacgcgcaggaggagccgcgcgtacgccgcgaccgcgcgcaggaggacgaagaggagccgcccgttcgccgcggccgcgcccgttcgccccttcgcctccaggcccgcggtgacgcggaggatggcgaggggctcccgttccgcctccgcgcgcacggcgaggggctcccgctgcccggactcggtgtcggtggtcgcgcgcgcctctacggcgaggggctcggtcgggaggacgacgccgagcggctcgaggtcgcggtggacgacgccgagggtggcgtggaccttggcgccctcgagctccaggatgaagagcctgccggcggcaagaaggtcgccgtcagcgccgccgttgcggctgcgcgcgccgttaagaatgccgccggaaagaaagccgtaagttcctgtgcttatgaattcaacatttggattttgggcgataattcttttttctaacgattgtcatgcaggctaaggaagctatggtccggtggggacagagaaaccccaacaagaacacccccaagaaaggatcaggtactgccaattgctcgatctataaagaaccagttgaagttggagctttccagtccaatcagaagatttatgagccagacaagagatttatgacgggaaatgaagtcactgacagcgaatacattgagctagtcgggctttacaataaaatgaacaatctccaattagagaccaaggacatgatcaaggggaatgctatgaggagtgacatcttggacaactgcttactgatgaggaacttagttcggaagatgcgatcacttcgtgcgatgatcaaaagaaaagtcgaaggtgaacctcctataatacctcccaatctattagaaattccagatatctcttagtggtgcttggtggtactgcatttgcattcttctgagcctagaagtgcttcttttagtggtacagcatttgccgccttctgtctagagagcctagaggtgcttctgttagtgctacagcatttgcgttcttctgtccgaaagtgggcagtaaatttgtactccttgcagattgactctcatagtattgattgattggctgtagtactgtagctttgaacaacagaagttatttttttctgtgccattgctgccatgttctgctagagcggtgcaggggtggtggtgttatgtcatttttttttcccaggcaaatgattcacatgaattctttttgaggcatgccaacttagaattctgggtgcaaatgattcacatatggtggctggggcaatgtcctaatagggactttgggtgtgtttagttcacgccaaaattgaaagtttggttgaaattggaacgatgtgatagaaaagttgaaagtttatgtgtgtagaaaaattttgatgtgatggaaaagttagaaatttgaagaaaaagtttgattggttcagttgtttgatggaaatggacttgcaccagggaatacaatgcagaaatccgtgtatttcgaacttgaaatgaacttgaaatggctaataggtcgcaggttgcaactaaggagaaattcgctaagaaggcggccaaacttcccattgcaccagaaaaacagagggatgaactggtttcttcagatctagactggtgctagtcacatactccctcgtttcaaaatgttcgacaccgttgactttttaagtacatgtttgaccattcgtcttattcaaaaaatttgagtaattatttattcttttcatattatttgattcattgttaaatatactttcatgtacacatatagttttacatatttcacaattttttttaataagacgaccggttaaacatgtgctaaaaagtcaatggtgtattttgaaacggagggagtattagagagaaggaaggagttcattcactccgattccaatgaccctaacagcatttcgtggataccttcatatagtgcaatcaacaaaacctcacccacagcatttcgtcgaagcattgtgcagcggtagagttctccggagcagctgccggtcagctctgcttctcaatccgcacgtcagggaaagaaactaagagccaaccttgcaaagcttcctactcgaccagcgctatgtcaaaaaatcatgctgacgggaaaatccttcccatcgggcccccgcgcctcccacgcctcgcgtgccacccccaccacgtgtactgttgcaacaaatcacccgcatattacggaaacgttctattaggaggatccatttcattattttgttccaccaacaatatctcagctagtgtactcgtgatgtttcactgtgtatgtaccaaatgtcgtaggggattttttatattgttttaataattttatcttgaaggacacgtggtttgtttatgtatacaaggtttaagtgttgtaatggtttaaaatagtttgttgcatatgttgaaccaaattgtttcatttagtgactgaccgtgtttcactttttttaagaactgtaacattctttcgctatttactgaatattgttttaagagaaaatttgattcatggaacaaaaaaaaaattggtaccaaataatagcacaaaatttttccccaataaactagaagcacatgcctctgttttttcttcgatttgtagcactcccgtcacatttgccattcatttgggtggaaaaagactaatttgcccttcttctattccatatttcccttctcttcctcccgtcgatctcgccagcacatcggtgggtggctatggtgcaacacggctaagcgcctccgacggtgatggcgactgcgcgtggcgagttcacgggcatggcgactgtgcgtggtaagttcgtgggcatggttgttcggcggtggaactcaaacttatgggtgacggtgcacgggagcgaaacacgagatagggggcgactgtgctggcaactggatgcgaacccagggcgacgggggcgttagcggaacacaagctcgggcatggcggttcagcggcagaacacgatgacggcgacgatgggacacgagcatgcaaggagtcggcgccaaacgagctcaggtggggatggtggcagcggagcttggggatggtagtgcgacggcggtgaatgagcttggggatggggactgtggcggcgggatgtgagggccatcgctgtcagccaccccaacaccgccgccacaacctgcgcctcctccggccacctcacccacccatacttttcttagaataaagggtaatttcgtcttttgatgctcctaatcatggctaaccaatggacttggacggaaaatgtgacggaagtgctacaaatcgaagaaaaattagtgacgtgtgtttctggttgaaagaggaaattttttgtgcttttttttaccgttttttttccctgtgctattgatcgaattttctcttgtttttatatagggtgaaacaacgcccgatttttgtggaaaccgttgtttgataagttgttgcaaaatgtttcatgagatagtttggttgtcttctagttttttaaaagaatgaaatattttcgatttacttggtgaaacagcgtccgatttttaaaaatcggcgcccgatttgtatgctcctcaatgctgatgctgttatgtactactgatactggccgattttgtggatataaacaaacagaatttgtgcccagttcatttgtgtcaagaattagactttctgttagatgaacatatttaatattcacgacttgggagaccaacagcatcattcatcgtgaccacaaaacgtcatcgcaagtttgcagcgacaaatgtcaaagtaccataaattaggaaagattgctcatgtagtcaagaatcacataattaagacttagactgatcgtgaatcatgaataatgtattctcccctcaaaaaaataatcgtgaatcattattcccttacatgttttttttttcataatttctcgtatccatattacttcagagatcaccatctgactctgattcctgatcatgtggttcatcttcctcttcatcttcgtgttggtgttcgtcatcagaaacagcttcatcatcgcggtccccaaactccccgtctttgttctcccggagcatctgagcgaactctctcccgcaattctcccagacgagagctcggttctcctcctgccgatcgaagtagccgtcgtccacctcgacgaacccgttggcctcgaactcggcgcgcacccgcgccgccatctcgcagaacctggcccagctcgccttcctcctctcgacgaacccccgctgcagcgccagcaggtcgtcgaaccacccgctccgcaccagctcgtggtcgtcggtgtagagctccctgcgcgccgcggccttgtcggcctcgtcgaacgacggctccctccggtgaaggatccagctgatgtgctcctgcggcatccggagctgcttcgacctcgccgccgccgctgccatggtttcgaattcgattcaccaagttgggagaagcgtcggcgatttatagcgggccgtgtatgtgtcctagtaagagtaggaatcggagaggcagaaattggctccaaattcgttcacggtttggccgaattccagcaccggattcggaatctgtggtggaaaaacacgagcaaaggcacatttctcaaacacatacgtaccaaccaacaacaaaagcggcggcgctggggggtcgcgccggcgagctccgccgacgggaaggcaggggaaagaggggcgaaacggagagagcggcacggggaacccatttcctccactcgatttgggagatgtgcaatggcgccgacggatttcgcgattttgaaacgcgcggggggacgaaaccctagaaatttgataggtgttcaccgagggacgcgaccgtctactcgatcggtgagtaataacacccttttccacctttgcattgctgaattcttaactggtgatgacgtttactgggatgtaaagaaacacagtgcttaataaaatgttgagatagccatttctcattatttaatcttgcaattaatgcaactaaatgtattgacaacagcctaatagcatcgggcattcaacgtcaaaattatacacaattacatccagacagacattagtgatgtgatattggcatgactccacccataactataagagttcaaatcctgatgcccagaaatattacccatatacatatatgctttcaatagaattttaataagaccatggatacatcgtttgtttccgtttattaaagtgtgtgcgagtgtagtgttaagtgtatagtagtgtatgcgcgtgtctacggtgaatctcacactacatgggggaatgaagagcatgcagttcaataaaaaaaaagacggggggggggggggtttcaagggttcgattcctggcctcctaccatcaaataattgcttttatggtgttcctctcccttagcctttgcttacgtttcttttaaaattttaaatataagaacataaattattcaatattaatcttgaaagccttttggcttagtaactataaatttcacatatgttcacttttattccttccaagttcaaaaatgtaaattataattattgagctaagtatttttgctaagactaataacattataatttaagttcgtaaatttgtccatttcaaattaatgtacatcaaataaatttacaaacaaaatatgtggtcgttttggaaaaaaaatatagcaaagcattcacggcgaatatgtaagaaaaaagctgaaaaaaagatgcactgatgggttcaaaaccagaaattaacctgcaactaaaaaaaaaagcctaaccactgggctagatttccttacagtagctcggcgtgattttagattgtacataaggtcaacgcgagctccttcgatgaatttgtgccacgtcgaacaagatctcagcaccaacgttatagcacgccaaggtcatgcttcatcattctttacaacaaacccttctttaaattagttttcgttcaattaagttttctagaaggtccgtttgtcaaaatttcggatgttttcttatccagtgacccccgtgtgcggagccgtacgatcggcagaagacagttgagatgcgaacgtgccgccatctgccgtgacacgggcaggggcggcagtgattactccggttcggtttcggcaatactaaaacggaaacggaccggcccgtttttttttttttacataagccactgaagtactgaactgagagtttgttcagaaatttatcgccgcggggaaatcatggcggcgaggaggaggacggcgacgatgcggctgtcgcaagacaacatcgagtggatcctcgcccgaacggagctctgcaccgacgacgccccggacatcgagaggtacatccccttcgtccccgacgccgacgtcgacgaggaccacctcccggagatctactacgacgagccggaggcgctgctggtgcacatcaacggcatcctgaaggccacctgggccaagttcagggacttccagagctgggtccgcgtcgagtacggcagcaatggcttcgtcgaggtggagtacgacgtcgacgagttcgaggaggcgcagcggctgcaggaggagcggaggctgtggcgtgcgcatgtctgggagaaaatcttcgccgatgatccgccggtggaaggcgagttcaccgagtatgtcagcgtatatgatcaagagacgagggcattcgtgatgagaccgaaggaattggaggtaggtacaagaacgattgctgttttcgacaaggtcaagatgaagcttgtgttgaagaaactagatcagtgatctagtattataaaaacttttgtcaaatagtcgtatatggtgggaaactattctgatccctcgaggggacgtcccctcattggttatgaaaaaaagtggagaatatgtattaacatgtgatatacttcgtatcactccataaatatgcaagttcaaattcaacttctacatctcgcaactagatagttaaggtatattcacagtcaaatttgtttttttcgttgtgagatgtataagttgaatttaaactcgcatgtttgtggagtgatatatcatgttaatacatattcttagattttttttcaaattttttcatacctatttcagtaacatgcaaacaacgaggaggcatctccttaagggatcaaaatccactcccgtgtatgatttatcttcagttagcgcaacgcgttgacgatgcatgtggtgttcatttgttatcatcgggattcaaccatgcatgtcaatggtctgatgctcatgcatagagttgatttgcgatgtttcaatcttgctttgatatttattgaaatttttaatcctttttacttatgtcatgtactataatgtttgtttatggcatttatgctggtctcttgtataagctttgtaacctactggcaatatatatcataattattttgtttcagcatgcccctaaatataccccctttgttttatattataaaatgttttgcgaatcctaaaaaacttctctctcgcgtcgccctcccctgggcggcatgagaggcgacgcctcaccgccaccttcctccccccgcttcctcctcctcttccctcgttgttgcctgagcgggcgccggcaaagccacgcagacgcaaggatggcggcagtggggcctcgtctcgcccaccccgcgctcggcggccgggggaggctatccagggtggcggtagcagtggtggccagattcgggccgagtctggcatgatctggccggtgggtggctggcggcgggggctgacggtggcggcggcgacacctggtagcgaagatggcggcgacggtggcggagccccatccagatccacgccaccctgatcgaatctggtcgggtggcagctagcgacgtgtaagatctcatttttgctcccgtttaaaatcttattttaaatacaaaattattttcaaaaatttggttcttatttgaattctgggttgtgccattaacgatctcaaaatccaatcatctgaagtcctatctaccaacaaattcctaaacctattattagagtccacagtccctttacaatctttgaacacaaatttcactctaattccacgtacaaagtccccacaaaattatagtcccaatgtccatttacagttccatcaaatactctccaaaagtccatctctgaaattccctagaaaaattaagaaagatccctattcctttggaccacctttcctttcccgtagtccaactccctcggaataagatcactttaggtccctctatttgtcgcccagtccgactttcgtccctgaaccccaaaaccgggtacgacccgtcccccaacttatgaaaaccgggcacataagctcctaaggcggtttggatagcggttttggttgacatggcgcctacgtggctggtttgactaggtctccgttccacgtggtattgacgtggtgcttacgtggcaattatatctcgaaaaaataataaaaatcatgggcccacatgtcagctaaaaaaaattcaaaacgatggggcccacatgtcagccacacaacaaaataaatatggtggggcccacgtgggccccacatgtcattcctctcctctctctcggctctctctcctcttccccacatgccatccttactcctctttcttctctctatcccctctccctctctctctctctcgccctgcagtttccacggagaaggccggagcggtggccagcggcggcacgcgaagccggtggggtgatggcggccggtgcggcggcacgatggcagccggagcagcggcggagagcccgcgggagtcgacgggagacaggagaggagggagcggcggccagagctacacgacctcagccccgccgccgctgactcctcctgctacgccgccacatcgatttgcgccgccaactcccccttcgcatgtcgccgtctccgcctccgcctccctctccgccggcttcgcgcgccgtcaccgccgcactcacacgacgcgcatgggagctccccccgccgccgcctccatccctctccctcgcgttgccgcgtggcggtcggtgaggaggaaggggaggtggaggcggtggcgaggcgggtagagaagaagcctccgcggccccgacgccacactcaacctcccctcccgcctctgcgtcgctcccgtcccgcctccgccgccgccgtcgattgaggagaagaagccgctgctgttcacgccgccgctgcctccgaggaagaaggcgttgctgtttccgccaccactgcctgccgctgaagaagaaaccgctaccaccacctctgccgccgctgccggagaaggagaacacctcgttcccgccgctgcttctacctgcaaagaagaagccgatttcgccgccgtcactgacggcggcagcaaagagtccatcgagctctaggcggcagcgccgccgcctttcgtgccccagccggtatggcccctgctggccgacggtgggaagcgcaaaaagctgtcggaccgtggtggccgcatccccgccctggcgccctcaatacgttgacaccgccgtcgaactccgtctccgtctcgagcgcggcggcgatggaggacgacggcttcttggcgcgtactgtgggcctgtggcgacgatggggaagagaaaaggagagagagctgagaggggatagggaatgacatgtggggcccatgtgggccccaccatatttattttgttgtgtagctgacatgtgggcccatggttttcattatttttctgagttataattgtcacgtaagcgccacgtcaatgccacctgggacggagacctagtcaaacccgccacgtaggcaccacgttagccaaaaccactatccaaaccgccataagaccttatgtgtccggttcttgtaagttgagggacggctcatacccggttttggggttcagggacgaaagtcggactaggtgacaaatagagggacctaaagtgaacttattccaactccctctcctctgtcttttcctccttgggccagcccgccctttccctcacccaggccggcccactccctctcccccttgaagtcagccggccggccgcacgtgcccgccacctgctcgacgaaatgtcgagccgggcgagcagcatgccgagacgcccccacaccctccgcacagtcccgtgtgccgccccgagccgtgccgcactgctccgctccacaccacgatgaaatccggtcgcgttccctcctccttgccctagaagcttccgcccacagtggcaaaacgtcgtcgacaccgtccttcacacgccgtggcaacgccgctgctcccagtccacaccgtcgcctcctcgcgctcgagctcccgcagccgtgcgtccacgccaaaagcatgcgccgggctcatgctcctccacgacgccgccgccctgtgcctggctgctccgagttcaccgccttcgcgtgctcgcgctccgtcgcccacagccgcgcgtccacaccgaacgtgtgcgccgcgttcacgccgttcggcgccgcccagaccaccgccccctcgctcctcttcctctgtttctctcaccatggccgccgccagtgcacccagtccactgagccaatcgacgcgccacgagagcccgtgtctgtcgtccacaccgaaagcaaacaccgagctcacgccgccacaccaattccgccaccgaaaccaccgtcgccgccgtcttcatctctctcccggccgatgtcacgccgcgtcgagcacgcctcgcgcactcgggccagcgcgtcgctcggtcgaacgccgccgccgccgtcgcgccatcctccctcccggttcctgctctccaccagcgcctccaccccacgtcgccgcctctgccttcgcccggccgaaccgccgccgcggtcgccgcctcgccgagccgagcgtggctcgcgtggccgccgctgccgcgccgggattcgtcaggcccgcggcgccctcttccatctcgccgccttcccccaccgccgcggcagccgcggtcgctgtcgccgcgccggccgcgcctcgctttctcctgctcgggcgcgcgcgcgtgggaaagagaaggggaatcggagagaacgaggaagaaatcgagagaaacagaagaaaagaagagagacactgtcaggtgggacctacgtctacgtttgtttaccatgtacgcaggctctgttggttctcaaggtttgtttaaaaatatcatattgatcctttatttaaaaaaaattagctaatacttaattaatcacgtgctaatggtctgttccgtttttcctattgaagggttgtgttcccaaccatgaggaaagaacacagcaattagcttgcacatcaatatttcagatggactgaaggattctcagtagcaaaaggaagggctcgccctgccaacaagacgatgattgtcaacatgacaacggataagatcaggtgtagacctttcagaggtataaaatattactccctccgtttttaaatatttgacaccattaactttttaatatatatttgaccgtttgtcttattcaaaaacttttgtgaaatatgtaaaattatatgtatacttataagtatatttaataatgaatcaaacgatacgaaaagaattaataattacttaaatttttttgaataagatgaacggtccaacatactttaaaaagtcaacggcgtcaaatatgcaatttgtggctcaaataggaattggtaggtttgagttatgtagtgggaatgggcatggggatgtgaatgaatgtgcgaaccctttatttggcccgtgctatttaaaattaccaaattcattctctacaagataaacacaggtggagcttcgatgcacaactgcatgtgcacatttctgcaatcttgcttatataattccaatgtttgttaatggggggctattgaatcacatctgcttcaatactagatagaaagatacggatgatttaatggtgtaagataactaagtttgctttgagaacctccaaattttctaaaacagaagcacgtactaaacaaaatcctgagatataattatgcggggtattcatttatctggcctattcattctatattctttctgcaaaaatctagatgcactgctgtacagagcatacatgtttttttccggctctttgctgcttttataaaatcatattgtgtagtataaccacatgattttcatgagcgcatggaaatcatacttgttggttgcacatacctatttcaatatttgcttgtcattactaatgactgtctgggaaaatacttctgcaatatttcatataaagctcccatttcccagtccacatatatacggacataccacagctgcatacctgatgccagtgtacttatctcttctgctgtatgtgatgcagcacatctcataattccagtgctattgtcctcgcattgctttgcatgcaggacattaaattgttgttgcattcattccttaatgccactccaagatgctccttgcatcacattcatttctacaatcttggagattctatccctagcttaattatcttcagaaggagtactccgatgcgataagagtgcattttgtgatgatgagattgcgagaaatctaatcagcaaaattaaccacattttacaaaatcactcaattcattggcgcaaagaaactagacttcacaaggctgtcacaccagggattgaagaactcgcgcgccctgatactgcctgcgtataaacatcaacgtggaatacagcttttcatgcttccatacacggaaaacggagcggtccattaacacataattaattaggtattagctaattttttttaaaaatggatcaatatgattttttaaataacttttgtatataattttttttaaaaaaaacacaccgtttagcaatttaaaaagtgtgtacgcagaaaacgagaggggagtgttgggaacttacctcttgcaaacatgtacaccagtatcttcatctctctcacagtgccatccaccccattgtttccatgcataccctttttgtgaatggatgcaaaatgatgaaggtggtagagagttacgcttcaaacatcactacctttgagttcgacaaaaaaatacatcactacacacttgacttctcgtgtcatacagtaggaatgttgggtttactgcaacatccataaaaggttggatttaccgcaacatcccaaatgttgaaaaacatggaataccatcatagaaactctgaagcattacataattatagagtaccccctccgtttcataatgtaagtcattctagcattgcccacattcatatagatgtcaatgctagaatgacttacattataaaacagaggaagtagcaatgtacataaaacagtacacatcccataaaaatacgttgaaaatatcttaaaatcttcttcaaaattgagtttgaaaaatcaaatttcggttttggatttggttttggcttattagtgtactacaatgaggttgtatctcttaataggtcctcaaactttgattatctttctcttgtttcttttcttgatgcctcttgttcactctattaaaatgtaatttttgtgacacaaatggtgtattggtaaagcaactcattcttttgatcttgcgttatcttacctgttgttctttgtatccagtactttatatatgtatgtacagtgcactgagttggaattgtcttgggtttgggataatctatgtattaaatatgttccccctggattcacatcctcattataggcacttacttgtagggtagtaggagggtagaactcacataccagtgattacaataatgacattatggtagaggatgtgacttagtaacattatgcctaccctcgtcaccgtcgtcacggcctcctcgtcttcctccccatctccttcctcctgagccaccgtatctctacttcccctgccttttcctatccccaattcacctatggatggttaggggtggaatatgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacatttacagtaaaacttctaattgaaataatgtaataaggttataccccaagaatggtcctccgctggagtttgaggcagtattgcctccgttggtgttgacaggagtctccttctccttgtctccagtgttcgacacgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaatcaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttgaaatttatttgatttaattgatttaaatagattaattacccaattaaatctaacagaatacacgccatccttcctgcgcacctccccaacatcatcctcgtcggcgtcatttgaggtctgggaggactaaatctggtaattgcagcatttgaaccgacggccacggcaacgacgacgtgcactcctattgctcctctccataaccagctagcggatgctaatttctctcacgttttcaggtcatgtgcgattattcagcatgagaactctacagtttgattcaaaggtaaattgtcaaaactgacacaaaaatctatttaaatggggatattatactgcatatgttctgatgattggtcttaacattttgcagttaatcaaaaatgttgctccattagatggattttacatagaaatttttacaatgctgatgaagataaaatgatgagcagttactgtaagctactacataatttgccaagtaaattaatgaaattggtaccggatgcctaaaattactgattaataagaaacatgatgtcaaaatagttgtcattgagtaaaaatcagatcgacacatgacgtatatgtacctattttgatatactcaatacattcctaggcatttgatgtgttcaacaaaagttcagatggcaaatatcacagcaagcataataaattgtcttatattaacgttgtatcatatcatatcatggtagaactgtcttatattattatacaaaaagggtagaactgtttgatagatatattaggcagcgttaatattgccaagttcacagacatacaggttgactaatattaacgctgaccatgatacgatttttttttttggataataacaacgcttttcagataatgaccagtatatttgtaatcaccttagcttactatgtacaatgagtcatcagattgcctcattagcccaaggaaactaagagcatgtatcaagtacaatctaccaaggaatttgaaattgataatttttttccaacggtgaggcagttgccgaagttttatataaagaagaagatgtctcattttaaacagaaaacaagatcaaaccttacaatttgaaactgatatcaggaatgtactgcaggtgatagctacagtagagacccaaggattactgcttctcacagaaatattttatggctacccaagacaagccccggcccccacctcttccatgaactgtgaagctggtggcagtgctcctgcaatgctacatgactgccgcgaatagcatgcagtaccgtaaggtgatcaaatccttctaataaacatttttactgtatgttgctattaccactcgctatgaccaaatttaggtaacgaagaatgcaagattggttcacaatttcctcaaatctatggtcgcactgccctgtttctgaatttgatattttgattaaaatgacctgccgttagcccattaacctcaagaatttatgagcgtgaaaagacaccacctcttctaattagttggaatgtgcatatttaaatgtttctttcacaaccatggattttaatacgagaatgatagctaccgggcgaccggcgcgggggagccggatcggacgctccccctcctgatgcgcattgtctccctcctggccccaccatgtatctccaccatatactccattgcaacaaatcacacacatattttggaaaccctctattaagggaatttggtttattttttgttccacaaaaaatgtttcatctagtgcactcacaatgtttcactatgtatagatctaatgttgcagtgaactgaaatactccattgcaacaaatcacccacatattttggaaaccctctattaagcgaatttggtttattttttgttccacaaaaaatgtttcatctagtgcactcacaatgtttcactatgtatagatctaatgttgcagtgaactgaaatactccattgcaacaaatcacccacatattttggaaaccatctattaagggaattcattttatttttttccaccaaaaatgtttcacctagtgtacttataatgtttcactatgtatagatttaatattgcagtgaactgcaacattttttcgcctatttgctgaaacattgtttttatataaggtgaaacaacacccgatttaaatgagtgaaacattttcgatctacttagtgaaacaattccgatatatctggtggaacatcgtgcaacatttaaaaataattcaatagtaggctaatttttttttcgtcggaatatatccatgtgtagtcttgttttgaagatttaattgcaacaaatttagtggtgcaatcgaatcatgatttggataagtaatttaagagaaaaatcagtttaaaatagttttgcacgcatgcgtggcgctgacgtcatgctggcatcaacgcccgattttaaccccctctcgtcagacgcccgagccggagtcgcttccattttaataactgagactggtattggaaaatatatacatggaatggtcattgaagagtgaatcatggaaagtcttaatagccattacgtatgattcatctgagattgtatatgatgtactggtgtttttaagctgaactgcgtacatctttatcttagattaatcaagatcttcagacagcatcagcggcatgcatgaactgcatcatcctcagattaatcaagatattcagacagcatcagtggcatgctgaactgcttgctgcaagcgtcacattgccacatatatatttgttgttccatgtgaatggagaaatggaatatatgatagttgaaactttggatgcctgatgaacagaagtacaaggtgcaatataatcctttctcatttccctgtttgatatgactcttaacttggaggactgattaatattctactagcataacagaatttgggtaagagaactctttgacgcttgaatacaagcagaaaagatcagcataacaaacagcctgtgacaccgtggactctaggtttacttattctagcctcttagtagtcaatttaatttgcttggtatttaaagagcagaaccagtgtttggaaaataccattgaaattgccctgttttgaggatggcttttaaacttcagttttaatgtattatgtaagttgaaatatacaggatgaaatgtacctatatgcacgagctataaagcagatgcaccaatgaaaactaaggggagaacaagggggtcatgtaacatcggaagaggtgaaaacgcggcgactggtgcagcggtgaagacaatgaataataataataataataataataataataataataataataataataataataataattattattattattattattattattattattattattatgtaaacttagtttatcacgtggatgtaaattttgcaataaattgtggtgaattaatgattttttatcatatatttaaaaaagtaaatcaagctaaataatataaatataaatgacagttgtggttgcgcaaatgtgtgactataatgaaaacaaattcttcttcatctaatatcgttaatatattttcatataaataatgtatagtaggatggttacagacttacagtcataccaatgcacaacttcatatgcaatttttttgaacggggaaaggcgtatgacaaggttattgcagtttgtgctgatgatcacgagtacaagcattacaatattgaaatcaaggtgatcccacctcatcgcttcaactggatcaggcgcttcactagattacgtaatactccctcgttacctaaatgtttgacaccgttgacttttttaaacatgtttgactgttcgtcttatttaaaaaattttgtgaaatgtgtaaaactatatgtatacatacaagtatatttaacaataaatcaaatgatagaaaaaaattaataattacttaaattttttttaataaaacgaactgtcaaacatttttaagaaaagtcaatgacgtcagatattttaggatggagggagtatctagttatgcattctaaatgaattctacgaagtatgcaataacttatgccctgaccttaagcccgcaaagtactattagaaaatgtatttgatttgactcattgcagattccctaactcattaattaacataggacgctaccaatatcttgttcccgtacatgcattttctgaactcatgtgtcaactagggtcatgcaaatttgaaaaaacaacttgcctcttagattgaatggtttctttaaccgagacattattcagacaagaagaatgagagaacaaggaggttgctgtcaacgacttgcgtcttaattaagaggcaagcagcactccatgtgagtaattaactcttctaactccggaacgtacaacacggaaggcttgaggaggtgtacgtgtgccacttcctggatagaccgagaggatgttgacgaaaactttggagatactatcatcttatatgaactgctgtggtaatatccggtattaatgacatttaaagtactaacagcacaagtaggaacaacaaagagccattaaatattccatttatagccctcacctcagtgccactatgatacattggcgatacctcgaagtgtattctattgatttttttttttgttatctgtagttctgtagtactactaattatttgccaatgattgaccgagcacaaagacctgggtcgtttatctgtgaaatgaaaagcctcctcggttgcccatattccctaataagtcaaaacggcttattagggaataaaaattaatttatatttaaaacttatatatatttgttcgtagcgacttaaaaagccaacgctaaaaaaattacgttgaaaatatcttaagattaactccaaaatcaagtttgaaattttaaattttggttttttctttgacttattaagctaaccgatgaggctcaaagaaagaaacgccagagccaaggcacaaaatgtacatgaaacagtataatttcaatagaactagtgggattttcgcccatgtcaacataggacataaagaactttcttaacacaggaaccaattttaaattccagtatctgcattgttgggagcatctgtacattcaatctgtatgtgttctaagaaaaggcatttgtatgtgcattcgttctccaaaacttagtgtttatcagactaagagagctaaaaccatgcattaaccaaagtggcatagtaagaattatccaagtatgcagaaatcgagtaacaaagaactcaacatctgcaccagttgatagtcatgcacagaaatcataggcaacattttttttttatcaagggctgcatggccccatttccattactacaaatgtatcatagagtttttacatgaaaggagtaaaagagtgcagcaaaagagagagaatcatagagggtctgggacagaactactggagcagaccaccctctgctagccttggtaaaaaaacccagccaaaaaaactaccaggaatcataggcaacactttgagtcagtaactaaacaaattcattcatgtacagaaatcaggacacaacagaaatcacgacagagagccgaaacctcttcacgaagaatgtttactctaagacatctctgaatagaaactctggtggggtatttggggctttgccacccatcactcttatagtctgacggacctttcttatctcgtgaatagttgatttcatttcacgttcgaggtccttagaatcttcaagtgacagaccatgttcaacggcttccatcagagagatcatttggttgaataaatcaaccaaacgtctgtacttgctatcactgtcttcattcccagtaaggtaggaggcctctacatcaaatttctgaaaaatctgaaaaggaaaaacaaagagtcacatatgactcaaaacaatggggaaggaaatatgtctcattttatccaacgcaataatttgtaagccagcaatactttttattatacttttaccttttctttagggtcagcaaaccttcttttctcagaaggcgagggtgaattggaattgcaaccattgttgctaccatttaagttcccgcgctcccaaagttttcttgcttctttagcctgcagcagaaaatatcagctatgccaaaacaaaagcgctcgaatacataactaaacaaagtgcagtgtaaagaacaatccaatttatccaatgcacggcacaaatttatccgtgctcgcattttttcaagaaactgaaacagcaaaaatgttgctcacatcttaagagtacattaacagagagaagctaccaatgaaagagaacctacaaaccaagccatcaatccaaagggtgtagccagaaatagatgacgcctagggcatttcttacaaactttctacagtaatgagatcttaacagaaaacaaaagggacaaaatattctacacagtacagaaaaataccaaatacacatttcagacatcacatggtgtcaagttaacaaaattaagtagtcactgtaaacaaacaatgatcaagattccatgcaaacaggaaactacagatgtggtacatgcatagataatatgttataagaaagagcgaggaagaataactcttctgttcttagtcatgaactgcagtttaaatcatcagtatagaaagtcaaaacataacaatataacaacatttacaactaaaacaccaactaatttctaagagcattaacacaacccaaattaatatatcaaatgctataatggtcagaaaggatgaaggtttacatgagcaacgttcacgaacatttcatttcaagtttacaagaaaaatttttgactgactgcccaaattacataacaatatgagcagagaatcagtaattaagaagagcataaacaagctaaaacagagcacaaacattagacactaaactaatttacagataactgcacccttccatgagtccatcaagtctttaatagacaaaagattgtagcaaatacaaatttaccaataagtacacattaattcccctcatgtaaacacttcagtttcacaataaaaataagaatacacgtgagtaaacagtatgacgagattattcttaaatagagcaggcaagagatacaaattagtgaaattaccaacaaaaggagcagaagggtgctatgaaaaattaagagtccacaggtagtagaagaaaccggtggactatcaacaaaacaaaaggacagggcaaccatttttgggccgaaattttgttctaaaactgatctgacgctaccaaacagatacagaaacagattgaatagaaatgcaatcccataagccatcaaaacaaaaggaatcacaaaaatcctaatgcgcacaggccgctccccaacacagcaaatttactagaaaaaaaaaatcaccatcggagccaacgaggatgcgcatcctacagcaattcatccaaatccatgttcatctagatgattcgaaacgaacgaagcaaaagaacgcaagatactgaccgctttggcaccctccatgttcttgagagcgcgagcctctaacacggccgcgcgtacagccgccggaacgggagcaccgagaaccaagcccgcagtagcctccaccggctcgtggtccagtacaacgacgtgctcgacgtggacctcctcgccgtgctcgcggcggacctccccgcccggcgcgggctcgacgtggacctcctcgccgtgctcgcggcggacctccccgcccagcgcgggctcgacgtaggcctcctcgccgcggaacaccgcggtgagcgcgcagtcgttttggccatcgagctcctcgacgaggacctcgtcgggtaactcggcggcgcgcttgaccttgacgtgggcgccgcagagaacatcgacggtgatctcgcggccgacgtagtcctcatcgccgcggaggtagttcacggcatctccgaggtcctgctcgacgtcggcctcgccgaagacctcctcgctgggcacgcgctcgacgtgggtctcctcgccgcggaacaccgcggagagcgcgcgctcgacgtggggctcgccgcggacacgcttggacttggaggggtcgttgtagtcgccgccgctgccgtgcagctcctcgcggacgggctcgtcgtcccggcgcccgccgccgtcggggtaacccacggtcccggaagcccccgccgcgcggcggacatccgcggtggcgctccgcttggcctccacgctggctatccccgccgcgcggcggacgaccgcggcgtgcttgtccactgcaccggaacccaccgcctctccattgctccccttgccggcgccgccgctctccggcaccgccatgacgcccgcaatccagacgagaagggggattagtcgaaggcgagaaggggagggaacgagccgtggacgggggtggtgggtcagggtggcgccttggcggtggcctttatatcctactagtaacgaactggagaaccctgcctgaagcggctcttttcaccaacttttgtcaatttttgggcaaatattgagaaaacagatatttgaatataaacgttccaaaatttcatgacaaaaacgaatttagactaaaaggccattcgacagactgacaaaattgatcaaaactcagtcggtctgattgaaaattgaacggtctactcaagattctttcatttctgcacaaaagtgttaaaaaattgacaagattcgtggagaagtgagatatttcatggggaaatgcatggttggaaaaaaaatgtgatgaggaaagtttgggagtaaaatgtgataaatttggtagtagtggctaccctacctgtcacacaggtaaagactaatagtgctaacaaggcttatgaaatggtggtgtactaaggtactactccgtacttgggagtctaggacaggtttttgtcatgtggtgatttgttacgtcatgtggtgatttgttatgtactactacctcccaatttttttaagggttaattcgatccatgcaaatacaaattttctatttgtttaattattcgtagccttgctactgaaattttacaaaattataaccgtatcactctcgttacattttccatccatctcctcctttgcacgtgggacccacctatcagatttatcttcttccttttaccctcccttatcttcttccttccccatcttagtgtcacagtgaggagcgaggagcatagggagaacacctcgatggcacgggcgacgaagcttttgttctagtggaggtcgcaagaggtggtggcggcggcgaaaagggaaggagaagggatagcagggaacccgacccaccggtgcaagcctattagtcgtcgtctcccttgaggaagttgaatggcggaaatggtagaggaagctgacgaggccgagcggctgtgagggagagctctcccaagtctccatcaagccctcaccttcatcttccccctccctactttgctcctcttcatgtcgctgtcgcttgaagctaacagtcatctctcacaccaaatctagacaaagcttaggcaaggcggcactaccggcgatggagcttcggcgggttccacggcagggaaactcctccgtcaccgccttcctcaccttgtccggccgcctgccccacttcctctacacccctcatctccgtatcgcccttccccgtcgtctgaacagtgaacgcacaagcaccaaaaatctttgatgttctaatatggaaactcttaccagaatcagttatgaacttatcatcagatcaggacgagatctttttaatgttctaatatgcattctgacttgcgatcatagttattagaactggactggaccagcggtccgaccagaaaaaactagaaccagggcgccggccggtccggtccagctaaaagatcggtctgcaatcaaaccggcgagaaaccggttgaaccgggcggtttactgcagaaccggacaaaaaccggtgtggttcgaccgctggaacgcgtcgcatcacgtgaagttggagagaaatacggaaaaagctgcagaacttgtgattcgaacccaaaacctccatgcttccatggagagcctccaccactagtctatgcggcttgttgtgaaaccaatataacaaacatctatttgaacccgtttaaaccggcggtttgaccggtccgagcaataaaccaatgacccgagtgccttaccggtttgatcaccggtccggtctaataactatgcctgcgatctgtccctttccagggtttttggaacggatataggagtaatcagttcatggttatgtgggagatgccgcgtgatcatgcatcgtgcatgcgtgcacgtgccagtgtgctttcttcctgtataccggtgttaccgtgaccgtgacgcggaccttgtttgtgatggcgcccggcatagcttctccgtccgttgcgttagctttcttctgttcgatcgtctccaagtgctagcttctgctgctcctgctgatatgtgatgcttcttgtgctggcttgggtttgattggaaacgtggcaatccaaccaattcttaacagatgcgacggcagcactcgggtgcaccggcgtggcacggtcagaggccggtggtggcgttcttgcctagtaaaaaaggaaaacatggggttcggcgttttaaactagctacgaaccccccttggggctcgatcaggcttttgtgcgcagctgatcaagcggcggtcattgacggcatcagattaagctcgttgtctctggtgttcaagaagcagttagccgcaattcttgattggttgctagtactaatagttcattgttgcattcgtccgtcgtcgcagcgtgcgttcctcgtctggccgtctggtctatttgtgcggttgaaccggctgtcgactgtcgtacgccatgctagtgtgctttcttcctgtacgccggtgtggccgtggctgcgtgggcgtgggtgctcctcgtgtgcatgtgtacgcccgtctgcgggagacgagggtttctgaaccaggagacgcacgacgcggaggtgctccggcgaggccttgatgaggcggtgaaaggggttcggcgaataaaactcctaacgcccttggatctacgcgaccagtgatgagctgagcacaaaatgcgaggggaaaccggctcatgttgaaccgtcgcagggcgaggccacgatggagacggtggcacgggcagaggcatggctgtggtgttcttactgagtaaaacgtacgggcagaggcattgacgccatcgttctcgtttgtgtgggtcgagaagagcgttgttctggacgccagtaccgcggcgtgcgtcgtcgtcgtcggcgcgtggcggttcgtcgtagcgttccttgtcagggtgtgcgatcttgcacgttgcgcggctgcgtgctcatgggatcatggcgcgagcctgcctgagcatggtcgcgaatccggctgtcatgggcgtgcgcggcttgacgtggcgtggcgagaatcaggttcacatcactcgctgacaggatcaccatgacggcagcagccagcagggttggtgcttcttcctgtatgccggcgcgtgtcggtggccgcgcgcgtgggtggctcctcgcgtaccagcgcccgccggagatgagggttccgatcgaagcagggaacgcacgatgcgtctctcggaacccactgcgtccattgatctgccacggcccagatgagcacagtgtgcgattgcagaaaccggctcatacttatattgtatgagtgctatcaatttttttttagaatttttcatagtaattgtttggatggctttaaacaaacgagcgacattctctcgagggatcaaaattgtttcctccatttgcagcttcttcttttaatcatgtatattccctaaatagaggaacggccaatatactaatcggcagtgagaaggatgaaatgagcagaggcaaatcttgggtcgcatatagtcatccatgtgaatgttgttactaccagttagctgcaattcttgattggttgctactatgcttactgtggcgttcgtccgtcgtcgcggcgtgcgttcctcgtcgatctggccgtctggtttatttgggcggttgggctgtgccacggcgagctgcaccacggcgatcatgccgctgcgacgtactgcgtgcgcgctcagggcgcgaaccgggctgtcgcgcgcgcgcgcgcgtggcgccgcggcgtgtatcgctcgctgacgggattgccatgctagagtgcctctttcggtacgccggcttgggtttcctgctcgatcctcgtgttaaatcattgtcataattaatatttatgatgaacaattggctgtgcaaatgattttatcaaagaattggtttgagagatgtgtggatgttggtgtgagtgcgtgtgactaatgtgggtcaggttgtgatatctgtgcccagaaacggttgttttgtctgattgtgtgcaggtgacttgaggtcagccttggtcaatggtgaggaccgggactatgctcagggaggagcagaggtctagtgcggtcgggataccatgtgagaaggtgactagagtctggattcttggaggtcaacttcggtcaacggtggggatcggaactaaactcagggaggagttgaggtccagacggtcaagaataccgggtgacgaagttggatatgagatggcacacggtggatggacaccatgtgggagagatctttacaacgggcttcacgaggtgtgcgtgcaagtgccggtgttcgcgaaggagattggagtgagaaatcgagaaaagggtatatggtgctacagtacacgtggtactgtagcatgcatatggatggtatcgatgcatgtatgttgatcatgcatgtgtggctgtgtgctgtacacgtgtgtttagtacatgcatgtgtggctgtgtgctgagattggatggaaggctatgcacgtcagcacgtgggcttgcatgtccgattggcagttggcctgggaggcacaacacagagaccgagtccggctcggttggcggctggagtttcgctgcgacggcaggaggagtccgacttcggtgcggcgcggctgtagttttcgagaaaaaggaaattgagttattgagttctattgtgaataggagttctacacctactttgagtaggaggttttttatgtataaatagagggggagcgtgaggcttcccggtatcgcttttgagagcaattgagttgctagtttagttagggtttcgagtttagtcgagatttttgtaaggagtgctgttcgtgcactttgtaaatacagagaagtaataaagttgtcatctactttaagagttctttgatttgtgtttcatcgggttcggcggttcgaccggcggcgtgcaagcggttcgaccggcggcgtgcaagcggttcaacccgcggcggcgacaggactacgtcgagatttccatcgatttgagggtaacttttatttccgctaaaagtttttaggtatttggttttccctaccattcacccccccttaataggcttggttacttgtgtccgatcctacacctcgtgtgcgtacgcgtccgccagagacgagggttccgaaccaagagatgcacgatgcagcggcggcgctcggacgaggccttgatgaggcggttgaaggtgggttcgtagaaaaaacaaaaaactccgaacacctttggatccacgcgacggaagcccggctcatgctgatcatcgatcattccgtggcacaagtttccgacgtgaccacgatgggacggcagcacaggcggcccagatcaagcagcgagcaagcattgacgccatcatgctcgtcatcgctggtgtttaggccggaagaccttcgatcgcttcgcttgcactgacgcccggcatagcatagatccctcgcccgcgagcggcgcggcgtgcgtcgtggcgtggatcgcagcgcacgttccccgtcgcatttggaccaacgaaggcggccactacgcgatggagatcactcgcgccgcggctgcctgcctgctcatgccggtggtacgtagtgcgtgcgcgcccagggcgaggtgtgcatgaggcgggggggagacggggctcggagaacaaaactccgaacccatttgatttgagatgtctcgcggccgttagatccgtcctgtgcggcttagatgcagccgaaaaaccgcaccaacacaaggccacggggctgaaatacacgagcacccaaaaaaaaatgatg

SEQ ID NO: 62000 - DNA, 800 bp, Oryza sativa
tttacggttgatatttcgctcttataactgtctcaaacatagtgtataaaacgcatgcccacgcattcgcgcgggctaccttcctagttttaataatagacctcccaggaacttatttctaaaatgaaccctttcgccacaccatggtaaccggcgtggccaatctgagctaccgcgccattggtcatggtgtcgcaaattaaagggtgccccgtggcagtcgttgccattgacaaggttaattagtccctgacgtggcacaactacctgttccggccggctccttagcgtggtagctggtgtttgccacgcctggctttttggtgtggcatgcagtgcaactagctcaactatttcatatttgtgaagaaatatcatatgataagaaatttttatgtgttaggaatttttttattaatttcatgaccactgtgataggtttcatggtttatgatgaacatgcgaagtttgtatttagaaagttgatactaaacaggtaaagatgggataaagtatcagcggtatttgtgaggtgttattagaaaacttcgtacggttttgacggacttgaattatgtgttaagcatatgaatggttcaagcattggtgattccttattctctgttttcactgcaatttggaaggatggaaatgactaaatatgtcgtaagcaatcacctgaatgctagttggagccagatcgtgataggatggaggaataagaatgcaagtagaagcaggggcggacacaggataaaaaaatgactggggacatgcatctatataacttatagaatagt

SEQ ID NO: 62001 - DNA, 712 bp, Oryza sativa
  unsure (1)..(712): unsure at all n locations
gtgttcttatgtgatactgtgttaattgatttcttcgtctacttatcttttgtcattttatttttgnaattatatcttttatctccncnccccccgtgggggccgccttgattgttatacgtacctcgnaccgcagaataccctaatgattttgggaaaaatcattaagttaaggtggatacacatcttgtcatatgatcaaatggtttcgcgaaaaatcaataatcagacaacaagatgtgcgaacttgatattttacacgactctctttaccaattctgccccgaattacacttaaaacgactcaacagtttaacgttggcttgccacgcattacttgactgtaaaactctcactcttaccgaacttggccgtaacctgccaaccaaagcgagaacaaaacataacattaaacgaatcgaccgattgttaggtaatcgtcaccttcacaaagagcgactcgctgtataccgttggcatgctagctttatctgttcgggcaatacgatgcccattgtacttgttgactggtctgatattcgtgagcaaaaacgacttatggtattgcgagcttcagtcgcactacacgggcggtctgttactctttatgagaaagcgttcccgctttcagagcaatgttcaaagaaagctcatgaccaatttttatgtcgaccttgggagcattctaccggggaacaccaaaccggttatt

SEQ ID NO: 62002 - DNA, 53529 bp, Oryza sativa
ttcggtaaaatggaggtcgtgggaacaaattctttcacatatgtgtgtgctatgatttgttttcttcctcaccaaaacaaatcttgtaatagatccaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggtagtcccttccgactggattgggagtcgcgggggcagcagcctgccggcccagtgaggtcgaacagctgggggagttgtctgcggcccatgaagcagacgacgagcggtgagtgagacactcgcactgcacatattgcatgaaaagtccatcccctcccccccctcctcccgcgtggggtgtgcacttttaattttgaaatcggacacccaatcttctaaactttacaatccattcatattttcatattacccctaaagtgatatttttggatggttgttttgcgtagatgtttaaataagcggttttgatagctaatataacatattatattacatgtcgttaatttctagacctcaggttatactctatagtaatgctataatagtattattatgttggtacttagtaagtgaaatactgagagaaaaaaagattgttagaggatatatttaactgaagatttcaacatatatttcaatgtgtataccacatagtcaagcccatgcaacatacttcctctataaaaaaaagattaactcctgaagatgagtatggacaattatctaagttcattatcagaaattggttttttctataatggagggtgtatatgcaaattagatgaaaaccaccataacgggttatatgaacagtattgtaaattttagttgttagatgaactttcaaccaaagtttagcggggtgacatggactttttcatataatctaatactccccctgtttcataacataatactttctagcattacccatattcatataaatgttaataaatctagacatatatatatatatatatatatatatatatatatatatatatatatatatatatatatatatatatatatatatatatatatatatatatgtttagattcatcactctctatctctctatctatctatctatctatctgtctgtctgttatatttttaaaacagccttgaaaggaggcaacacgttcactgtagaggctagaaattccaacattaatcggagaaaaagaaaaaaaaatacacgccattagattatagtgggtccaaattataacggtcgagatgtttcttgacagatatagaaagatatatcttgctctttgtttccgactctagttgtcataccgaagcaaatagattgttattaataccactggtcatatgccagccaaaaaaagagctttattaaggtacgttccggccggtcaacgactattggctggcaaaaaaaaaccacccatcgtccggtaatccataaaacacagctcttaatctttaaggatgcatatgactaaaactattaaaaaaatccatataaattagtagtaatataatttaaaaataactgaaattcaaaaattagaataagtaatattgaaagagaagtccatataagacccaatacgagatcaattaaaattcaaaataaaaaataaaataaaataaaaagagttcaagtaggaatacaattttgaaacaactgaagttggaaaaagaataaaaaatattaaaagaatagtgcatatagaacacaatacgagattaattaaaattcaaaataaaaataaaataaattttgaaattagaaaaagaaaaatagaatttcaactaggaatacaatgtataaataactaaaatttgtaataacaaagactattgaaagaagggaccatctagaacccatgatgagattaattaaaattatgaaaatttaaaaataataataagagtttaagtaggaatataatttataaataaaatacatcggaatgaaaaatatgaaattttcaaactcaacgatgataaatgacaataaagatgggagaagccataagcctgtaaagaagtaaagtgatgacggttgaaggggcatctaaaaactattaacaaaaccctaaagagaattcaatgatgattaaaaagatggatgacggacaggcagttaagaagcacgatctcggcggttggcgagacatctaaaaagtaaaaagtaaaccccaatgataatcatattcaattttaaaatcacaatggcaataaagaggggaagcaacaggcgagccgtagaggagtacagtggtaaagccgtcaccactgacggtttggcgggacttctagaaagtaaaaaatgaacacaaatgacaattatgtttgatttttgaaattccgatgacaataaagagaaagtagcgaacgggccgtagagtagtatagtggtagcgtttgatgggacttataagcaacatgtctgaaaaagagtagagtggtgacagttgatggggcatctaaaaactattaaaaaaacccccaaatagaatttcaacgacgattaaaagcaggaatgatggacaacatggtcgcaacggttggcgggacttctaaaaattaaaaaaaaaaaaaccccaatggtaatcatgttcaattttaaaatctcaatgacaataaagaggggaggcaatgagcgagccatataggagtacagcgacaaagccgctgacggtttggcgggacttctagaaattaaaaaaaaatgaactcaaacgataattgtgttcaacttttaaaatcccgatgataataaagagatgagacagcgaacgggccatggaggagtacagtaacagcgtttgacgggacttctaagcaacatgcctgtaaatgagtagagtgatgacggttgatgggacatctaaaaacaattaataaaaacccttagtagaattccaatgacgattaatttttactcaaccttatcctctacgattaatttttttatcgtagaggagtatagtggcagcgtttgacatgacttctaggaaaattataaagacgaaatccaacaagaaaataaactctaaaaactataagatcctacttttaaaggttctaaggagaatgaatagaaagtggtagatcgaacaagcaaataaataaggagatgacagaagtaaggggtagcaactggtgtaacttttaaaaactataaaattaaaaacacggggatgataaagtttagtctttcaaagttttaagacaacgagatagctatttaataaatttttaagtaaaattatattaaaaatatataattttgtacgggtgctagccgtgcaattgcgcgggccacccagctagataacatctatatgaatgtggacaatgctatatatgaatgtggacaatgctagaaagacttatattatgaaatggaggaagtatttactattctatcggatggcactgtaatcacctctctcataggctttttgatttgttcgtgctaagggaattactattattgtttcttgtgctgccatgcatgcatggtgatggcgtgcagatacctgtgcgattgtggcctgcaccgtggccctggaggggatgcaccggaaggtgtacgaggagtccaacggcgttgggacgttccctgtcgcttggcaggccgcggggagttggaacgagcagctgcggctcgcgtgcgagcgcaaaggcgtctggaaggcgcgcgagggagccaatgtgggcgatgtgctaatcaagattcaggagcttgcgggcgtggtgaccagtgtccccggattgttgatgccactgctcagttgggagaagcacagcgccgggcttacccgggagcgcgtggctgagctcatagacctcggcccctgcattgggagactgtgggtttgtccctggtaccattacttcgataccgataatggctgggtttatcttgggtgcggccgggacaaacttgatagggacgatagcaaagagcgctacagaaatcaggtgggctcgcacgctgtcgtctgcttcgcatatcgattctgcgaaaatggtgagatgcatgtgctcgtgttggacaaccatgatgatgacggcccacaacggtggatcgacgttgaagagctggatgcgatcttcaccctgaccgtggagtgcctaaccaacggaggcgcttctcccccaaggaggtgaattttccttcgggacacacacatatatcaaatactatatatcaaagatttctttatcaaatatatggtctgactagagttgttctcctggttggttcctggcaggcagctcgccgcctaaggaagcatcgccagccgcaagcttccgaaatcgaaccaaacatgccctccgagttcgagttggactttaaaaccttatgtctcataaaacatatgaggcctcgagacgattgtataacctccctgcttcttccggccgtagcatgaagcatcttgagctcctgcttctcttgtctccaaataactactagggaaaattcaccgtgtatccctaaaaaattgtccaatctctcatgtatttttctcattttcttcaatactcctgaatttatccttttcataaccttctcgttagttgaccgttaaattcttaaaaaagagagttgtccttttgtatgaagaaacacataaatttatagagtatatcattgaaatatagaaatttgttgtacggaacttatatatttactagcaaaatacccatgctttgatatgggtaaaataataataataatatatcatatatagaatatagcttttatcaaatatgatagtattatttattttcttgtttttatgtatgatatccacttgattcaaataaatattaaactattatataatataaaaaaattatggactagctaatttataaaattgtaaaagtagtaccgaggatggcagaaccaccaaagaccgataaggctaaggaggccgaggccaccctctgctccgccacatccatcgcgccacttcacaaacaagcaccatcactcctctttctctctgcttccctcgattccgtgaaccgaaggaattcctcaacggagggaaggcgaacatgaagcgtggtgagggcggcctgcgccgcgacgtgttgggtgaaggggagcgccgcatcatcagcgaagagctagtcatggtggctggtaaggttcttgacgtgctcacagttgcgtaagaaaggagacgacaaggaggcgttgtggtcgatgtaggggaaaggggaagcgaggaccgctgtaaccctaagcaaccgccggctgcggcatgaccgtggtggcgcgagctcgctggagtcactggatcgggggtgtacaagaaagggagcgaggacgtcagggcgatgaatgctaagcaccatgtcgatttgcataattatatagggagccaatttgcactggttttaaagatgtgtagcaagagacgaaagatttaaagatgtgagagatgtcatacctggttttacggtgaggggagacgattcaacgtggagcaagagatgaaagaatgcaaaatatactgcgtggggtttacatggcgcttggccaagttgaatccgaccactccacttggaagaagttggaaccgagtcgagagcaaattaaagcgtggcctgcaggagcagagcgcggccgctggactgcgacatggcgtggcggaaactgatatgcgctaccctgccgctctctactctacccagactaaactgtccgtggggaacaacagcaacatagcctacgctaatgcggcggggcacacgcttgagtgcgaactcgagttcgttctcgtgcaagaaactaaggcagtggctgggagtctagataaccagaacagcgaggaagaagggcagcggtgcctcaccgacggtggcagtgccgcggcggccggaagtagaattaatgtgggccggcgatggaacatcttcggacggctctgtggataacgaacaatggtgggttagcgcactggacaagaacagaagaactagctgaggggagcgggggaggaaagctcaccagggcctccctgcaggtggcgtggcgagaactcgatcggcctatatgcgttcgcttcaacgcccattctgtcaggagagtaaggcaagggattcagacagcacacacggtgctggactgctgggagggtgagcagctattggtagagccgtagactcgtagaggttgcgaaccctgcgacgaatggtcgacggtgggtgtgcaggatcaggcggccggcgatgcaagatagcaccaacaccaaactgtcaacttcctccagaaccagatagccagttagccacagggtggttgacagtacttcctccagaagtagatagccacagtatttcctccagaaccagatagcattctcgtttcgtgtaaaatggttaatccggaagtggttatggttagaggaataaacccttataagttagttttactcttgctaaactagcaagttggtactaaacatgcgcacccaactctcatgggccacacatgcctcatcttaattgtgtcaggatgttaccgtggcccaaccggcaaggtgtgctttttcaaactaataaactgtgtgttttgtgtgaaatttttttaataaaaaatgctttaaaaatcaaataaatttatttttcaattttttaatgatcaatatttaattaatcatatgttaattgtgtttctagttttacgtgtagctaatcatccaaattcaatagcccaaaagaacatagcgtaatttctcattttgcatagcaggactttgtcgttacttggtgattgctgaaggttacgaatttgctatattggaaaataccatcattacaattcgtgaaatttgtcacgtgtcaatggaagtttgcaaaattccaaccataacattgccctaaaaaaaatgtttgcacctccatctaaacgtagaaattgtcgaaattaccttttttttttcacattctcctttctctctctgcagttcttctccgacgtggacagctacaccttcttggacgtacgccacctagaccccgccaccgctcgctggcctctgttcggggtcaatatctatacgcggagggagatggccaagtttttccacgccaagagcaggttccacaagagtcaagaccatggaattccactgtagggaaagtttattgatcgctcgagggatatcctcttatttatacatatatctaaatagttataaacaaatttaaaataaattgacaagatagataaggatgaaatatatcacttcacaaacatgcaagttagaatttaatttctacaagttgtaaaaaaaacaaatataattgcgaatgtactataactatttttagttaatttgttctttttattgcaactagtagaaattaaatttggccttgtattttttagagtaatatacactacaacggtcatccacatctcaatcaggcggcaaaccccatatgtgtcgggtatggcgcccgtcacgacgtaaaggttactgatgtgagaagttatctctattgagcatacagccgtcacggatgaagttatctcaatcgggccccaactaaagcctgtcatcgatagctttgacccagacgaccagtcaaataagggctcgtcacggatgaccttatttcaattgggcctcaattaatgcccgtcacggatgaccacaatctcaaacgggctttagttgaggcccgttacggatgagtcatccgtgacgggtttaagttaaagcccgtcaccgatgagtatttcctcccaaaaaataaattctgttttttcgctagcctcaggcctttactagccatgcccgttgtaaaatgaagaaacaaatatatttcacaatatcccagcatccccaatcatatacaatcattcacatacacatatgctattcacatatttcatatatccattattcacatatttcacacatccattggaatacacatccattattcacatatttcacaataacatcttcaagtgctaagcatcaaaacctgcaaaacagagttgtaaattagaacaaatttctaactggcgaaggaagaggttgaggcggcgggcgtgctcggggacagcgggggacggcgtggaggaggttagtggaggacggcggccggctcgaggacggcgtggaggaggtcggtggaggacgacggccggctttgggatggcgtggaggaggttggtgtaggacggcgggcttgggcatggcagtggacgtcgatgcgacggcggcaaggacagcgtggaggaggtcgacaccggctgatgtgggctcggggacggcgccaggctcggtggatgacaacgctgggctcccagacagcggcggcagcacgagggctcggggacggcagctgacagcggcgacgctaggacgtgcagttagaaaaatttttgatctagatatgagcaaaagtgaaaccctagtcaaagcattatctcaatcggggtaatttatactgtgcaataaatatctgtaacggtctaatagttatctcaatcgggcctcaagttggagcccgtcacagatgacattcatctgtgacgggcctaatagttatctcaatcgggtctcaagttggagtccgtcacggatgatggatatcggtgacgggtttctgttagggcccgacaaaaatatcatcggttatctttatcgggcttcaagttgggctcgtcaccgataggtgtcatccgtgacgggctcgatttttatgcacatctaacatgtcagtgtgagtatatctttgccggcctctttttgggcccgtttgatgacttcgttgtgacggcccgcaaaatctaggcatgtgaggggccgtctatgagaggatctgtaatagtgatatttcgtactaatctatattgttaaatttttttaaaaaattataattatatttagatgatatgtaaacaataagtggacaatccctttaagggatgaaaatctatatctgcatatgttttttttagagaagggtatttttacccggcctggatatatacggccattgaaatagggaacttagccccgcaaacaacccaatctgaaattcgctactatagagatttgaactcaagaccttgaagtactatatatacggccattgaaatagggaacttagccccgtaaacaatccaatctgaaattcgttcctatgaagatttgaactctaagaccttgaagtactactcaggtcactgcaaccactaggctacgtgccctttcgtatatttgcatatgtgtgggatagagaaaaagaaaaaggctaaagaaaactagaaaaagaaaaaggaaaagcgcgcggcgtgtgtttctcgcgcgtatgcacgaattcgagctcgacggggcttctccggcatctcatggcttggataaggattgtgaatggatggcgaaggtcagagcagcaagccagcaacagcgtcagtacagcaaatcggaaggctaagaacacgctaatttaccgttatactgtaccagaaccgtagcgggactttatcataaaaaaaggccggcacttgatgacctttgtcgttacatacatttcctttattagaaaaaaatggctattttaatcttattatcgttatatgtttagttaaaatgaaattcattataaaaattcgttttgatatataactttttagaaaattatgaactgcaattaagagtccgatcatctcaagttagtatttaagtttttttaaagatatttcttatacgacttcttctgtatttcaaaagcgaacaaacttaaaactaactcaaatacggatatggatatgtatttctagaaacgaacgaacttaaaaataaaccgactcatacataaatgacgtaccaaattattggtaaaaatatcttcaatttttataatagtagagatacagagtactcacgcactcccacctacacttaccatgtggatgcaaacacgtacccctccgtaaaaaaaaataatcaaatcatacgtgtccagattcgtagctaaagtttatcattttttggacaaagtaatacattttatttcgaagaaacttgatagatttttgaagtggacgaaccattattatagacacctcgctatcaaggttatatcatctagcacgaaataaaaatgctgttaaatcctaaaataaatctagcaaaatatgagtgttgtgtcacattaacaacttaaatatcttactcgttccgtttcaaaatacaagagaattttagtactgtaaatttgaacatgatattttagtactataaatctggatatgatcgtattagtaatatgataaatatatgtatttttgaacttcaatatagtcttcgagatgctaatttaaccaataatatatataaaactaagatttttttaaataaaaagagttacatattatgataactagaaaaatgcatgtgcgttgcaacgggtgattgttattttaatcttattattgttattgtcggtgacatgggaccgggagtatcatgacttagagacttgaggcagacatgatcacccacgtggtctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgtacgcctcgccccatcccgtcaggatgagagcctccaagcactcatccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacattggtcatgtcgtcagcagacagccatgttcccacgtcgcgcctgcttccggcggaagtggaggtaggtatgggccgtcccatcagaaggtcattcagacggcaaccatacaagtctccgtctgtttatgaaaatataggataagtccccacaaaaaagagagagatggtgcatgtggtatccccttgaggtataaaaggaggaccttgcccacttagaagggggatattttttggggggggggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaatggccgaacaagcaaaggcgcacagcctctctccgagtgttagcggtgacgacggggagccgaacccacgccgtcgagctcgtactccaccgccccttccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgtggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatacgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtgactcgtaaggaagaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcgacccctactcatgaggcgacgcgccgggcgcggtggtcggaggttgccctcacctttgaccagaccgaccacccaccgtgcgttgcccggggaggatagatcgcaatggtggtttcccccactgtttgcaacgtgaagctggggcgtgtcctcattgatgggggagcagccctcaacatcctttcccccacagcccttgacgctatcaaggccccggggatggtgctccggccgtcccagccgattatcggtgtgacgtcgggtcacacttggccgctaggtcatatcgacctcccggtcaccttcggtggatccgccaacttccgcacggagcgggtgaactttgatgtggcggacctcagtctgccctacaacgctgtcctagggaggcccgcgttggtgaagttcatggcggcggtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgccgtcccgaggcagcggatagtcacgtgcgacgaggtcccggtcaaggaggttgctgatgcgaacccgctagggtttgtggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaactcaatatggtggggttccgattacaggcagacgggcggtttagccaacacgcgcgctgcgagctggtagcaagaagctatctctatcatcaaaacccgtctgttcttggcgacgactagaggtataaaaagaggggaagaactaccatagggtcgtgctccaaccctaggacgcgcccctaatgggcccaacttggatacacagcccattgggccaaaagaggtgacgcaacaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcatctccatcgttcctgagtaaaacacgagtgcacgcgtctccggggtataaagacgaggaatatgaactcaagaaagaactcacctgataatttagttgacgtgcacgagcgcgggtaataggaccatcatgctgtacatgggggacgtggatgtatcgatggtgttgatgtcctcatcagttgccctgggcgacggcccgtccaagaccacacgaatcggtggtcttctggatggcaaatagaaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagatttgcatggctagggaggatgaggaaaaaactgcgttcattacccccataggaacttattgttatacgacaatgcccttcgggttaaagaatgcaggtcctacttttcaacgtactacttgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcaaggccgccctaagtcggttcatatcgaggctgggagataaggcgctacccttatttaagcttctcaaacgctccgggccgtttacttggacggaggaagctgaacgtgccctcactcagttgaaggcgtatctcagctctcccccagttctggtcgccccggagccaaatgaacctttgctactctacttagcggcgaccccgcaagtggttagtacggcgttggttgtggagcgcgatgaggacaatcctcattccgcgcacccccaccctgtgctggcttggcccgggagagagcagggaggagaggccctcgagccgaacggtggcccaaggcccccgacgaccggagcaggccctctgcccgcttgtcaggcggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggctgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatggacaatcgaactttctgagtttgatttgcactttgaaccacgccacgctatcaagagccaggccctcgccgattttgtggcagagtggaccccagctcccgagcccgtctcagtccacgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgacttttgggcgaccaataatatggcagagtacgagggactccttgcgggactcagggtggcagctggactggggatccgccgcctcctggtgttaggcgactcccagctggtcgttaaccatgtctgtaaggagtaccggtgctctgacccgcagatggacgcttacgtgcgccaagtatggcgtatggagcgccattttgacgggatagagcttcggcacgtgcccagacgggataacacggttgctgacgaactctcacggctcgctttctcgcgagcccagaccccacctggcgcctttgaagaaaggcttgcccagccgtcggcgcgacccgaccccttaggggagacggacgcgcctgacaggcccccgaggcccgtcggagtccaggcctcgggacccgaggggagtgctcccagctcccttagattgattgcttggatcgctgagatccaagcatacctcacagataagactctacccgaggactgcgaagggagtgaacgcgtccagcgcatctccaaacactacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccaacagctctcaatgatgcggtcgacctggtccggcaatgcagagcgtgtcaattccacgccaagcaaatccatcagccggcccaggccctgtagatcataccactttcatggccatttgctgtctaggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtaaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccatgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagtgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaaagccaagacacaaaaggaccgcggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcactcgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatcttcgagaggcgctgggtgaggcccccctggttggcggcgtacttcgcagtccgcccgccccagaggcccgcttgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgctgctgcgcgccctcgcgtccaactccttctcccgcgcctcgagctcagcggcccgctggttcagcgcggccctctcggcgcgggcaccttccagattatggcgcgcctgctcctcccgcgctgcctcgcggagggacaggctgtccgccagccgttgcgccgcggcctcggcctcctcgagagctcgctcccgctcggtgagcgcgtcctcgcggaggcggagcgcggactcctcttcggcgcaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtctccgctgcccgccgttctcgggcagcggcagcgtcaaggaccccccgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgtgagttgcctcggaagtcgtcgtcgcctcggcctggcgaagtctggcctcctcccgagcggcttcttcagcttggcgagctcggacggccacctgggcagcttcctcggcttctcgaaggcgatctgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccggtcagattcccgcctccgggcctttgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccgggcgcctgctgctggcacgcgccgccccgccccctcggcgaggagatgggggaggggttccttcctgcttcctcttcccccgggcatcggcagggcggccgctccccaggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatttgaccccctggtgggtcctcatgtagtcttcggacccggtgtactcccaggcgccccgggcgcgctgctggagcggcgcaatccggcgacgaaggtagtcgccgtacaccatggcccctgtgagcccctgggatcgcaggcccgccaagcggtcgagaacggcgtcatagccatctcccagatctaccggcgcccgccagctggaggcctgcgctggaggctggctcggaagtcggaggcgcgctttgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgtgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcgtggcgctgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgatgccggaagaagagatgtttgagagcgagcgcgtgtggcgaaggtagggcacaagaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcctattcgcccgtttgcggtgcatgaggtggataagcggctgtggcagtcgagatggaacatctcgtgcgcgcattaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacatgatcacccacgtggcctaaccccctcgggggggggggggggggtcgggcccgagggtgatacggccgcccttctctttgtctccccgagaggtcggaccgctcccgtctcggccccgagggccgaggcgccccgaccacttgtgggttttgcgccgcgtatatggggtaggtgagcatagcggggctcacctaaccatatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttttggggggggggtccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttctacataccgagagcttagaatctcacccagggcccccggccgaaccggcaaaggggggcctgcgcggtctcccggtgaggagccccacgctccgtcagttatacagtttaattaaggtgaaattcactgtgtgaatttgcttggatatatatattttttagaaagtcataattaagctgtaattaggagtccgatcatgtcaagttagcatgcaagtttttttttaaaaaaagacttcttacatgactccttctgtgtttccaaaagcgaccgaacttaaaaactaactcaaatatgtaaatgtatttccaaaagtgaacgaagttaaaaaccgactcatacacgaatgacgtacgaatgtaccggcaaaaacatcttcaattttataatagtagagatttgtttaatgataaatttagtaactttaattttacatgattaagcttttttctaattaatagtcaaagttaaaaatatttggcttaatactatattaaaaatgcttatattttagaacgggcagagtatatttcattcaacaaaaatttctttaggacggatggagcagtaaatactcagccctactggataagatatgctcagtcgctgtcgttggtatacaaggcagagggccaggttaagcacaattgcactaatgtcccattccaattatttcagtaaggtgtcccatcaaaaaaagaatatttcagtacgtgtttttaatagaaaaggcgtctcctcgtaagcacccggaaattctgctcgtggaaataggcgctgctcgtggaaaggcctcactttcacagtagtaataaaaatgaaccagcaattccgtaataaaaattctgatggcgtcactttcgccgtcccggccagaaaatacgaagtaaaaaagaaccagtgatttaagcgcgtcgatcgatcgacgagggactatgtatttaccgacttactgagaattccaggcatcactgatcaaccgtactaacaataagccatagctagtgatcgatcgatggccggcgtcgtagaaaccgccgacgaagctacccaagcaccagctgttgcttccataagtaccgcagcagcatatgcacggccggtgggcacactgcttgatccgaagctgttcatggctgctcgccgcggtgacatcaacgggcttaaggaacttcttaggccagacgacgacgacgacgacgacgacgacgaggtagtcatcgtggacgtcgaccctgtgcctgctgctccctcctcctcctcggcctcggggtcgtcgcatcatcagctccaacaacttgatgatcatggggtgaccagcaacgagggtgactccctactccatgtggtcgccacccgcagcggcggcggcgacggcgaccggttcgtcgcctgcgccaacacgatctactaacacggcagcagcaacggcgccctcctcgccgcgcgcaaccacaagggcgacacgcccctgcactgcgccgcccgcgctgggggtgcccgcatggtcgcctgcctcgtcgctctcaagacggctgaggtggtggccgcgcccgcgggagacgggccaggtgtggaggagttcctcaggatgcggaaccagtgcggggagaccgcgctgcaccaggcggtccgcgctgcctgcacggcctgcatagacgagctgctgctggtggatccgatgctggccaccgttccacaggagggggagggtggcgcttcccccttctacctggcattttcactgggtaaactggatatcgcacgccatctgttggacaaaactaatggccagttgtcctactctggactcgacggacaaaacgtgttgcatgcggctatttctcgtggtcaaggtacgtgaaaatgatactaagggcctgtataaatcttctggcaaaatttttcaccctgccacttcgaatgtttggacgcatgtatagagtattaaatataaacgaaaaaaataactaattatgcatattgcgtataaattgcgagacaaatcttttaagcctaactagcatgatggcccgcgcagattgcgcggctaacatcattatattttctctcatataatagcatatatatttttttattatattattaaaatatattataatgacaatataattttaaattttacaataactttacgaaactactaatgtataatattcatattatattttatatacgtattagttattaattatttttaatatcaaattttagttatttgtaaattatatatatttctatatggactctagacttgtcttttaatatattttttaattctgaatttttattatttctaattgtatttctatgtggactctaaactcatctttcaatattctttaatttttaatttcaaattttatttacttctaaattgtattcctatattgactttaaactcttcttcctatgtttttcttaatttcgaattttagttatttgttaattgtatttttatacggctaaacactacttttcattttattatgtttcttctaaattttacctagttttaaatttctatatagactctatactctacttctaatattccttattttttaattcttaatttctattttttttcttaattgtatttctatatggactctatactctacttctaattttccttatttttaattccgaatttctattacttcctaattgtatttctatatgaactatatactctaattctaatattttttatttttaattccaaatttcaggtattttctaattgtatttctatatggactctagtctcctcttctaatattccttattttttaattccgaatttcaactatttctaaattgtatttctatatggactctagactcctcttctaatatttcttattttttaattctgaatttcagctatttcaaaattgtatttctatatggactctgcttttttatatggactctatactctacttctaatattccttatttttaattccgaatttcagttatttcctaattgtatttctattggactctagtctcctcttctaatattccttattttttaattccgaatttcaactatttcctaattgtatttctatatggactctagtatcctcttctaatattccttattttttaattccgaatttcagctatttctaaattgtatttctatatggactctaccttttctttttctccgattaatttgagaatttataggctatgagagcgaacgtggaggctcctttttctattcctttaataatataatagattgctccatgattcgacaatgtggtgctacagtaaacatttgctaatgacagattaattaggcttaataaattcatctcgcagtttatatgcgaaatctgtaatttgttttgttatagtctatgtttaatacttcaaatatgtgtccatatatttgatgtgacacgttaaaatttttcacccctgatctaaacacagcctaacactacgctagatcggctcacatgtgatgggtcaaaagtacttgtcacggatggcctcatctttaatggattaataaggccataataggtgaggccatcggccgaggcctgtcatatttatttggttacctgtgatgggccaaaatttacacctgactgaggtctacctttgccgggtgcaaattctggccctttatcggtataaatttcagcccaacacaagtaaccatatacatgtgatgggtctcactattttagccaatgattgcaatttcggttgaagttggtcaaagtttatttaaattcagttaaaatttcggtcaaaaaagtgcaaaaaaatcccgaaattttggtcctaccgaaatcaccaaaatttctgccggaatcaaaagtgtaaaccttgtgttctaacctgtcaaaggtgagtttaactcatctctgatgggctcaaacactgacccgttagaggtgttggaaccctatatatacccttaccgtcaattgctttccatctcaatcctgcacacttttcacttttcgggtggtaaggtaggaggcgaatttttgctggatgcatgcatcttattttgcgggctaattaagagtgatcgagattatcacaattaattaaatacaaactgcaactgcatatatacataatacatgcatgcagcgctgcctgtgcttttggagtggctgaaggacgtgacggtggacgtgcaacaaggcgaccgtgctatcagggtgcctcttgtatcgcatctggcgcagcaaagggaccatcagacggggagcacgcctcttcacctggctgcatcgctggaagggtggccatacgtgggcattctttctaaatggttcccagatgtttggccgcggccgaaatcagcagtcgcgctgctgctagaagccaacacatgtgcagcgtatcaaccggacgctgaaggattataccccatacatgtggctgccttggctgacagcctcgacgtagtcaggaccatgctgcagaaatgcccggactgcgccactttgcgagatgccaaagggaggacgttcctccattccgcggttgaggcggagggatacagagtagttgaatatgtctgccgccgaatgccaaaagaattttcgtccgttctgaacatgcaggataacaatggggacaccgccctacaccgagctgtccatctagggaatctgccggtttttaactgcctaactcggaatccgcatgtacatctgaacataccgaacaagtatgagttgacgcctcttgatctttcatggattacagtcccttcatcgttttattatgattcggtaagttactagtgctattgttcttatttcaagaggcagttccctccacccaaactttataagttatccctccatccaaaagtttaatacctatttcattttaccatcaaaactaaagagtaattaactcatccactacgtaacaaaaccattaaattatacacaaacaaataagtaataagatggtttctcggattctggtcaacaatttaatttagggactatctatacaacattcaactgaaaattagcctaaaaatctatcaaatgtaactgtaacataattacaatgtaattttcataattacactatatttatactataattacatatgtaatttttataattacactatatttgtactataattacatatgtaacttgcatgtaactcacgtgtaattatagtataagtaagatataagttcaagctagatcataaaaatatagtagcccaatggggcagtcacgccttcatcccatgaggtcaaagatcgacccctaaatatggttttgtttttcttcctaaaagcacatatcttgatgcgtattaaactgttatagcatgaatctaggacacattcaacggtttagaaagtgaaagatttagccataaaaaatctgtcaacaaatatttagcaattccatttaatttagtatatagagattacaaatacggtttaaacttttggaaaaaccaaaaggtgaaatagattttagacttttgaatggagggagtaatatttttatacaagatcattgcttaaatgatactagtatattaactgttcattctcgcagaatccaaggggtctcatacaattatcattgcaatttgtgggagctccatgcggtgcaagtcgaccggacctcttatcccaaaaacacatcccaaagatagacaacggcaaggtctcggcgcatctaacaaatgcatcgcaaatgctgggcattgtgtccgtacttgtcgcgaccgtgacattcgcgtcagcattcacgttgcccggaggttaccaaaccgggtcggataacgcggcaggcacaccactgcttgctgggagctatgcctttgacgccttcattttatctgacacgctggcattcatttgctcgtgtatggcgaccttcagcctgatcttcgctggggtccctgcaatggacatctctatacgctgcaggtacttcgaaatttctgccctcttgctgcggagttcgggaagaagctttgtggtcgccttcgcgttggggctatacctggtgctggctccagttgctcacacgatcgcgactgcggtctgtgtgattatctttgtgtcttcgctctacgggaattcggaagcctggcagatccttcgtgtcgcagacatggcccgtgctagattgggaactcgaatgcatgtagcatggactttaggactcacgttctataacgtctttgttaatttgtttttgaacttctggtccttcattataatctttggcctcccagcagtaattcggaaggttcatgcaagggagtagttttcgctacctttccatttccttcgttagcattcggttaaaactaaatctccatgtgatcaattagcaagggacgcatgggctatatacatgtatgtaatcatcccatgtacaagattcatgccccttcatgggctatatatatgtatgtaatcatcccacactactgaaaaaattatctttgttggttcactcaaaaatcacattagtcctggtttgagtaaaaaccaggattaaaaatatctttagtcccggtttgaaaacacacaggtattttttgatcattactccaggttagtaacaccaaccggaactaaatattacttttactcctagttcaaaaacatatcagagccctgttatttttagtcccggttggtgtccatctttagtcccgattgtttataccaaccgggtctaaagttaaaaaaagttgcgaaaatccttgcaccgagccacgcgcgctgcctcgtccttatcccctcctcttctcctcctcccctctcattttctcgatctcctccacctcctccccctccccctctcctcccccttcccctctcctcccctctcccctccctcctctgacgatgacgacggcgacagcgggtggcggcccggcggcgcacgatgcggtaggcgggcggcagaggtcgggtcgccaaagcggcagcagcacacggccgacggcctaccctccgccagatccggtgggaggggaggccgggtggcggcggacgggcgaaggcggcctggcggagacggccgggcggcggaggccgagaggcggcacacggccggacggcgtgttttgtgaaaattttatttttggaatgatttgtaatttttgttgtagattattttagattttgggatgattttgtgaatgactcgtggatgtggatgattttgtggatgggctaagaactgtggatgatttgttgtgcatgatttggtgatgatttgtgtggtttggggatgatttgtggggatgagggtgacaataaatgcaagaagcaaaaaaaaataaaggaaagaaaaaagcctaaccaaccggactaaaatgggactaaaaatccattgagtatctttagtcccggattggtcgtcccggtttacaacctgggactaaaaggggttataaaccgagactaaagagcccttccccagtaatgccatgtacaagtgaaaagtaaatacaagaatcattcatctctagagttctttacttctaacatgttatcacgcacgttagttgttccacttaacgatagaaggccaagaatacgttcttcgtcaacaggagattggtcgatttcttccaaggtaagaacatgaatcaatttcattcttctacctttgccatcggcatcgagtggctcttccccaaaacctttcgcaagatgccgcaatggtgttgccatgccatggtcactgctaaaaaaaatactcattggtgctggctccaaaggtcttataggtgccagatttggaaccggcacctataccaccgttgccgccaccttcaccaccacacgcgtgcgacgtgaagtaggcgggtgccaggggaggaggggccaccgccgccggcacgcggaggagaaggggggaggaggggtggcggatggagaggacggtggagaggaggagaccagtgtgagagagatggagaggaggcagtctcgaaaatataaggacggagaggaaggatgatggcctattttttttaataggtgccggtacctatagttatattataggtgttggtttttttaaaagtccaacacctgtagtattggtacctgtttttctctaaaattgatacctgtaatgtaagtgtaggtgtcgattcttctaaaaaaccgacacatgtagtattggtaccagttttttccctaaaactgacacctatgtgtttaaaggtgccggttctatatttttttcattgtggcagaggtgagaaaaggggtataggtatcggttttaaataaactggtacctatgggccagtcgtagtagtgggtctttggtccgatattgcacggagaaatttggtgccgcccatgcttgcatcttcgttggcaaccccgacggcaccggccttgctagctccggcagcatcggcgccaccaccacagccgacccattttgactggccacggcaaaggcgctggccatccactcaaatgatggcatcaccttacagggggaggatttttttttgaacttttttatttttaaattataaaaacagaccattctaaaacttattacagaatctaaacctttggccatatcaactagtctggcgtggcaaaacaatactgacaccccacacatagcgagcataataattttgtcctactacactagcgagaatagtgtgaccaaataacgttgccacgccagccagaccgacgtgaccaaataacgctgccatactagccagaccaatgtgatagtattattttaccacgccaatctaactggtgtagccaaaaggttcatatcttgaaaataagttttgaaagagtttgttttaaaattaaaaatttaaaaagttcaaaaaataaaataaaaatttgagggagagaacggccgcctgccgaaccccactccattctctccaccgcgtggtgccggaccagacccccctcccccgggtgtgattggtcggtgaccagccgcgcggggctgcacccgcacggtcagttttgcccgccttagtccattagtataactactgctgctacaaatactacaactactactaatactaccacattaccactaccagtaatagtagtaatagtagttctattaatactagtactactactataattatatatatatatatatatatatatatatatatatatatatatatatatatgcgcgcgcgcaaagtttatatactacgtattaaaaaatttaaaatactaaaaaatatatcatgtatacaaactttgtatatacatatacaaactttatacacacgcatataaagtttgtatatgagcatataaagtttatatacatgtatgtatataaagtttgtatccacacgtataaaaaaccaaaaaaccaaaaaaaaagaaaaagaaaaccagagaaaactattttttttaaaaagaaaaccaaccaaaaaaacccacccacgtgggcttcccacgcgcgagcgactgccccccctctccgcgtgccacgcgtccatccacgcagggggaggggcgcgcgccgcgtgccacgcgtctatccacgcaggggaagggcgcgcggatatccactttttagcggatctgcccccaaaccacgacatatgtcctacttccctgcccacttctacatggatgtgcagccactgggggatggggatgaaagcgatggagtatgtgtagctgtggctgatggcagaatcgcggtatccctcctacgtcgtggccccgggccaatgctcctccctcctcgcgcaatgtgtccacgccccgcccgtctcttgacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgctaccaagaagaagtaccatcaccacttggggtcaggcggctatagcgtcacgatgccgaagtgggaggagatagaggctagcttgcttgagaggggtatcgaaccggccaccgctaattggccggaatgatcgaagttctggtactatgctcacggtggaacgctcaacccagctgatggctccctgatcttcggcgatcagatacgcgaggctgcgcgttgactaacagacgtagtggaagcctcttctcagggcacgttccgaccggacagagagaaggacgagctgttactcgccctgcagactccagagcatccaggacgaacacgagggaaaggagtgattccttggaagattgggttcaaggaggacatccacacgtataggagttggatgaggagcaagagagataccgaggcgaagattgcagattttgagttcagggtatcgagctacgagctcagcatgcaagaggaggtggcaaggaaggttgatgaatgtcacgcccagaaattcccgaatagaattccaagcagaatgtgcattaaaatccccgtccaggaccggccggggtacacaaacgacaatgttgacattcagatccacgtcttacaaatatcataaaagtcttacataaatgcagcggaaagaaagaaagacaacaggagctaagccttgactagaactgcagcgggaacaccactccacaggcatcctcgacggcacgggcaaagcctattcctcggagaaaccttcatctgacacatactcgtactctggggttgggaaaagtagagcaagactgagtactacccactgtactcagcaagtcataccggaatagaggcatgatgcagggaatcatcaaagaagagctaaagtggatcatttgcataaagcgagcatttataaacagaagttgaaagattaaacagttgtaataattaattagtattaactatccactgtccaacgctatcccacgttgcaacaggcccaaccatccacctaaactatccaaattctaaagattacactagggtgatactaatcacggtgaatctggttgaccgcccataaccgcgggcacggctattcgaatagttttactctgatcagaggtgtacaactgtacccacaagacacagccccacaacacgtttccatgcgccgacatgccaccacgacatatcggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgttgactagaggagagctacactacaagcccagccgttgcccacgctggcttgtggtaagtacgataagttcttccagggcatcccgcgaacaggtccttaattgccatgggtgcgaccagcaaaaccatgcacccacaacccaccatgtgatttattttaattaaccaacaccaaagcggtgtcactaatccaacaaaaccattagaaccaacagtctaaacattaataggattttccccattgtgcactagttgaactaagcatggctaagcaatccctggtccaatctctagtcatgttataaccccaagctgacaaagggacaaggtacaacaataacatggctaagacaataggtaaacatcccatagtaacattataaaacaatgcaatatttgaaaggaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacatcagcacggagggggcgcggcgccggcaagcgggccccaccggtcagcggctcagggggagcggttcaccgtggactgggaccacgcgggtggtccaccgccggtccacgggaccgacggcccagatcgccctcgggccgatcggacgggcggcgatagaggcggccgccgggcttggctcggcatcaaagccgaccggccggccatggctagcggcgacggcgcgcgcgcgaacgcgttgccggcgacggcaaccggcggcagaggcgacggcgcaaaagcgacgcgaaagcggcggcagcggacggcggcaacgaccaaaggcgacggcgagcgcgggcggcggcgacgcacggggaatcggggaagtaaaggaaaggggagggagttcctcaccgaaggggacggcggcgaccggcgacgaggagcgacggagggaagtcgacacgcggccgacggcgaccgggacgacctaaagaacgaaaagaaagagattagagaggaagagaggggccataggaggcgggaatactggccgaaggcggcggacatggcaacccttaccgtcgcacgacgggaacggctctccggcgacggacctcgacgaaggaggggtggacggggtggatcttggccacgcgaacccgacggcggcgacggcgcggtgcggcggcgagcctagcggcggctagcggcggccggagtagcggaaacggcggcggcgggtggttgcacggcgcgggagcgatggggagcacgagggagttcggcgagaaagggaaaaagcgagagggagcgacggggaagcttaaataggggaggggagggccggacgtggccgggagaggcgggatttcgccggccaacgtggggaagtgggggaggagagagatgcgggattcgaaaatcgaatcccggccatctcgggcgcgggcgcgggcgggagagagaggggagtgggcgcgggggacgcggcgcacgcgcgggcgtggtcgacgtggcccggaggaggcggaggcgtggcggcggttgcgggcgcggcggttgcgggcgcggcgccggctggaggagggagacgggcccgacaggtgggccccacctgtcggcgaccccgagagaggagggaggcgggacggcctggatgggcctcggcctgcggccggcccaacagggaggagggggaggaaaggagagaatgggccagcggcccattcgaaaaaaaaggaggaaaaagggaggaaaaagagaaagaaaaaggaaaaaggattttccctggaattaaaatattgcttgctcaattttaattggttaaaattatttctagagctctgaaaattccactaaaaatcctgttagtgaatttcgacatgtagaactcaagcaaaattctacatgccaaatccgattattatttgcattactttcttagggttttctcttgatttgcacctgcattttcttggggggtcgtttataaattaaatttttggcttgggaggaaaacttcggggtgtgacaatgaacgcatggccgcacatcggtccaatgatccccagccgaccattcctcctgcaatggtgagcccatcaggaaatcgtagcagctgcgcctcaacggggcaagtaggatcacagagcatggacgccatgcaaacccaggacgaaaccacctgccccgttgatgacatcactcagcggacaccatgtgagctgcatatccccttcaagaacttatcaataaaggtaaactcgtagtttatagattttagatttggccattccgctagttgctgcttatatatgttgattactaataaataacctctcaccacatgaaggtggcgtcgggcatggccatctcaacggacccttcaggtacttaccactacaggccgattccagcaggatactccaaggtcgaagttgagttggtcgaaggcgcgtacgaggacctcgagctggattaccctggaggagacggtgagacgcatctacaagacacaagccacgccattattctatggcgcaagcggtacatcatcctccctgggcgacaagcggcgtctcgtgcactatctcctccggctccgccatctcctcctcaggctcctacaccgtctcctcctcatgctccagcaccgtctccacctcaggctcctgcaccgactcctcctcaggctcctgcaccgactcctccgcaagctcctcttccggcaccttctaagtcaagggccccccaagctccaccacctgcccccacaagggcaacgaagaaggcgaaaattgacgccgccaagaacaaggacccagggtacgattgcacgcaagaggagcttgacgcttacgtggcatcagaagtcaggagacaattcaagcctcgaagtccagaaaagaagattcctatagacccgagtgtcaagaacttcttcaggggtatgtctacacctgccaaggaggccataaagctattggactatgagcgaacactcaagaaagcatcttctggaaagtccaaaccagtccctcagcttggagagcaaccaaactaggagatcgagccgttggtgaccggtgaagattttggaatacaagactttattaatgacaccgggctaactacggatcaattgctaggagacgcaccaatcgaaaaggcggaagtgaaatacatgtacgaactcggtaaaccgcttgtcaagcctgagctgttgcagtccctacccacacaaatgtacaagttccatcagctgtatatggagatgagcgccaccggtagagagatgatcggagcgaggatcagggacacggacttcttgcaaggagatgacattctctggatcaatttcaagggaatctacgaactataccagctggacgccctcgacgtctctattatgagttgctggattttgtaagtatattgttcggttagacttcttactacatctcctttaattaattaggtccttctatataagtagactatatataatatatactcccttttatcgttgtagaatggagattcaaagggcccgatggcgggggttttcgatactggattcattgacccccggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacttggaggcctgcaccgtcaacgtatatgactcaatggataaaaaagagtctacgtttgataaggttttcgaacttatagacaggtactgtcataagttcctatgttaattaagaatcttgttatagttaattgctactacgaatcatagctttaaactccatatagggcttggtatcggttccgtcatttggtccgcggcaaatggagagaaagacttaggcggaagttcaaatttcctgtgattacacatgctctacatttatatttctccgattcaaatacatacaagtgtatattaattagatctctcgtcatttatttatagtgcgtaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggtggttcaagaacaacttatgggattcatcaacgaacaaatccttgatcccaagggtgaattctactacgacggaaacacaattcataggtccttagcttctgagatagcgactactactacgtcgaaatcgtagctagctaggacatataatgaattataattaatacatgactatgtttctatatgcatgtgtacacattttctataatgtaaatatatattttagtcatatatatatatatatgcatttgcataacatatatatgtataaatacatatatattatgcatgtacatatgtattgaaacatatataaatataatataatatatatatacatatatatgtattgaaacatatatatatatatgtatggtttatatatatatatataaaccatgcagcaacagggccatgcaaacaaaaaaaagttagctcgatctaacaccaaccggtactaaagatggctcagtcgggcactggatgatcgccggacactggtcgattacgacatccaggagtccacgctccacctcgccgtccgcctccgcggcggcagccgcggccactatccctgcctcgctcccggcctcctcgccctcgcgcgcaagtacatcgagatgaagatgatctgccgcaagtatgcacacgcttccgatccgatcgatccaaaactcaagtggggttaattttgggagtacccctggttaatttgaacatgcatctatctagttcgctccgttcaaacaagacgcagtagctttgtgttgcaaattaagtaaactttgtctttgcatgattgcatcaacggtatgaaatgcgaaaggaaggaatctcaattggtgtgcatctcagctttctgatgattttgattcacagccgccttgtttgcatagttaattagtttcttgattagttgggtggattcttgatgggcataaatgatgaattaattagacgtgtacagttacattattattgagctagaagcctataacccttttgcggcaaatgtattatctgtctgtccttttaatcaacttgtttaactgtttgcctctatgagttttgaaagttttgtcatttgctagccatttacttaagcttgctttactgcttaacttagcaaatcagtcataatggactaaaatctttaggcacaaacttctgactttgccattcatggatgtgctgtctctttctttccctgaagaagctagataagttgttccgctactaacattttcttttcttgcaggtgctatgcacgccttccccccaggtctacaaactgccgcaagaagaagtgtggtcacagcaacaaggtgagccttgttatcaagctatcgaagtgttctttgtgtgggctttcgctgattgtcttattggccatggccgtcttaactgtatccatattcttggcttgagtcatcagtaatcctggcagcatccatgcatgttcttaattagcagcatttcaaccaatgtcttaatttatgcttgtttcagaactgtcattgcttggtatctataaatattcttattaagccatttaggcatcaatacttgcactttgacattatgttgtgtttttcacagttttgaacagtctgtatatagtaagtgtacacttggattcactaggtagatgatagtggatttaaggtgacaaacatgaattccttcattctttgatctgatgtattttacaacattcctgttttctttttcagctaaggcgtaagaaaaagttaaaggactactgaaccatgggaatggaaaagcgaacgaaacgatgatatatatacagctgctgtcagttgaatacttgaatgggatgtctttaagtcttaacatgatagaactaccgctgcggttagttgaatgagatgtcttagcatgatggaactgctgttattagtatcatactggagtttaacttcagccctagctagtttaacatttcctgctgggttatgaaccttgattacccgtttccatatgctaatggtggtttaattttgaagcatggcagttacatgctccagaaaccccggctgaaagttgctgaactttttttttatcacactatggatattactgcatcgtgatggttcggatagaaatgctagttgcagatgaacattgcaaatattaatcttctggatgcaatgttccctagctgtctactgtgtatcgactagaagtgatttttgagaagataccgagaggtgcgtaaaatttgatatattttggtaccactaatagaaggtatcaaatctacgctaaattaaaaaaattaatatctttttatgtgaatgaattttagtatattttatatttcgtcgtaggttgtttatgagtaattcaggacgaaggaagtaggtaagtgtgtatttagttcgcgaaaagaaaattgttgggtgtcacatcggacgtttgaccggatgtcggaaggggttttcggacatgaacgaaaaaactaatttcataactcgcctggaaattaccgtgagatgaatttattaagcctaattaatccatccttagcagatgtgggttaccgtagcacttatggctaatcatggactaattagtctcaaaagatttgtctcgcgattttcatacataattagttttttatctatatttaatactccatatatgtgtcaaagattcgatgtgacgtttttggaaaaaaaattgggaactaaacaaggacaagcatcacacgtttttgaaaattttttttggaactaaacaaggacgagcatcaccaacagtctacctatcttattcccaaaactgatttggagggattttagccaaaaaaaaaacagcttcaacggatcccctactatcctacccgagttttagagttcccttctcccgattccttgttcagtttgtatacggacactaaagttgctcccaatctcgccctcccgcctctctcctcccgttcccacgcgtgggagatagcgatctttctgagcgtgaaagaaaaaaaacggaattttctcctcccgttcctgcgcgtgggagatagcgatctttcggcgcatgaaagaaaaaaaatggaattttccgttggtagtttaacagaagggcccacttttaagttttggggattgaatttagactatctgttagaggaggagttttttcactttctattcttctatctactttatagttcaacaaatgctttcactcattctttcattcatcactcaactattcaaatcatctggtgaaaatccaacggtccaaatagatcactagcctcccacctccatcgaacgcgtcatcgcgctgcccctaatcgcctccctcaatcccgcgccgcatcctcctcccttcctctctctctctcgcctatcgcctcgcctcccccagacgccgccgccaccgtcgcctcccccagacgctgtcgcctcgcctcgcccgccctatcgagcccaccccctcccttcctcactctcgcgcctcgccggggggcgggactggcatcctcaccggcaatggcgatggctactcggccgccttctcctggtgaacagtgggggcccacctcgcgtttaggaagcccgtggtggtgctggtggtggtaccatcggcaggccctggaagcgttgtagaagcggtggtcgcttgccatgcctccggccgagctccacggcggtgcccatcatcccttcaatcgtgcccactctccagcatcaaagctccatcatcgcccccatcctcgccgcgttctccgcatcttttgctagacgcggcatgctctccacgaatccaccaatggcatgccttgcctcactggctcacttctgagtcatcgtcctgactatgccggctttgccctccatcttgttgagattttacaggttggttggcgaccttggaccttggtcatttcttttcttgattcttccctcatgttacatgtatatgtggttattcatgctttctgcacaacttttcttgattcttctatcatgttacatgtatctgtggttattcatgctttctgcagtctgcagatctctgatatccaaatacgatatgtccgcttcccacgatactaccaaatgttgctaatagtgatcagatttacatagtatgttatgcctggaaataaatagagaatgcactgatcaacttaaattcccggttttttgttacagaaaatatcttcttcatttgaatggagatgtgaccctgtatgctcttgcttcatgctagcagtgcatggcatgcatttgacattttttttaaagcgggcaattaatatatggatcctctaatctttagtaattttattggtttcttttcgagaataaaagagattgggcacactccaggactgattcacgcacatacggatttatgtggttgtctgtcctcgtaatggtaattctgtgcattgcactatcgcagttcttctttttcgaagccttttctaggtttccgttatcaaaagatatctaatttgcagaatatatactaggtggtggagattttatttccttcaggacatagatgttgcaagctattgcaaaagcttatgcctctaaacaatcatattcttgcagagtggaaatttaatctgggggtaaatcttgcatatttctttgtttcagcagcagttattacgctcacattttttctagcaatgttggttccatgtgcacaacttactattaactttcaatgtgacagttttaacatattcgatggcgctgaacgtaacatcccaaatcatgaattgctggtggccaggtgaagccacctaatggttctcaaatcttagttgtgatgtggcggtgatgagcaagcttggacaagagcccaaataagatatgacttaaagtggtgcaagttaatcaggacagcaaagacgcttagtcttatgaagaaatgtcacatatacaggaaaggatgagattggccaaaatgtttttttagtcttctgatttgcagatgcttgattggagttatcctgctcctgccacaaacaggaaatggtaagaactaagtagagtgtatactcacatgcatatatatcattgagttgggtgattctaaattaatatttggcacattgtagaaaatattggtttcaagctattttttttatcaagcatacatgacctaaaaggcatatggtttctatcgtaacggttgataactccatattgatctgttctttagaaattcatgaaatagacatttgcatgacatctggaatggttatcttctttgttgaatgttctttcaagaacttgcacctttttgtttaatcttgtaaatttgatgtgtaattgagcttgtagggtgagagaatcaagtgtgattgagcagatctatactctatgtactgagattgtgtagagtaaagacgatgtagtatttccttttataatacaatttgtcacgcttcatttatttttcttatggagcacatgttgatttcaatcattggaatttgttctacccttttggtatgaaatttctcttactgattaaatgatcttggtatgaaatttcccttttggtatggaatttgttatacctgtcctgatgtgatgtccactgctagagtcctactatttagcagaaaatcagtgagataattgatagtcccccttgaccataatggtgtatcaaatctgttctgggacaaggtaggcaacatggcatcaagccactccaaaggacaaaatgttgctttgtgacaagtgaataatacagccactttctggtatcgagtctaggttgcccattttttatttttcttgattttttttcatgttcttaaaaaaatgcttcaacagaaggatcatttgagattaagaaatgatcctttgaagatttttgtttttttgctgttaaagcctcatcatatatcttgctaattatgctatatgagcaatcatacaatcaattatttatgcaaagatgattaagtggaacattcaagattcaaagtggtatataatcaagtattcttgctgccattgcaagtatattaattagatcactgctggcaattggatgttgaaaatgcaataaaaatgttgaggcatggagatttatggtatttgacattatggcccatttgttttattggtcaatggcatgtgtcttgcccatcagcactgtaaatttgtaggttgcgaaaccaataaactaattagttgggctattttattagttactgaagtgtggaaaatgaactgcagatcacttttttttttcaggagagctgaacatcattttatagataagcataaatcttttttatgaaacaacactgaactattttatgttatgtgcaagtgcaacccccacaaagtgatttttttttaaaaaaatattttggttccaatatattaggtttaatttgtatgttgatcataacgtgcatcggtgtgcagaggctatactgctcaaaatggattttcttatcttccaaagaagcgcttaagctcaaaatgataagtcggtgaagtgcatattgtgttgttcaagaaacctggagcgtttgatctgcatatgtagctgttgagctcttttttttttgtcgaacctattgagcgcatatttcactctaaatggttttgggaactcatatgtgtggcatgactgttctgttatttccttcaattaagcctagcaagtacatgattaaaaagattgttcatattattcactgcatatttatttcatcaattcttttgtgctgtttctcctcaggagagaatgagttggtgtagatgcttctttcccttgtcattatgttttcttccctgaattcttttatctgctcttccatttcatgccatgttgatatcatccccatgtgatatggtgacaatgttttcagtattctgccattcacttgttaagatctagaagattaaggtatttttcgaatatctattcattggttgccttgtcccttgaacctcatagatgggaatcattatcaatctatcatcctaaatataaactactccttactgcgcatgatagccattctattttgagttttatagagccatgatacaatgtctgtaagagataagcgacggatacaccaccgccgccatctgtcaaggccttgagaggccgagaatattctctctcggtattacgaaccagctcagaaacatactctataatgtccattcaaaaacatactctgtaatttcagagaggagtaagtgccaatatagtggttttaattaacatccaaacaatatagatagaatgcgagcatgtgatacttctttgtttataacaattttgtgtatcaatcttttttgcgaatttatctcattctagacttggcaaaatatgttttctttcttacggttgttcgatatatatcattaaacattgccgtagcgttagcacgagcggattactagttttcagtttagaaaaaaatatttttttagagagagataatagataatctgttgctgatgctctaaatattgaaggagtctaacgagtctgacgggcgacggtcgacggcccagctccgtttcattcggtggagtcttcgccgtttggcgatagacggctgggccctctccggctctccgccaacctcgcttctccccgcgatgcgaccccgaatcccgccgccggccggggctcttgctccgctcccccctcgaccaggggcctcctcttaccttccgaggccgtgtgcatcccatcagatcccgacctcccgtgctccgcctgccgacgccggccagagtgctccaggagcaaaccaaccagaggccagagccactggcctgccagggaatggtaatacgccggctccggcctgagaagcgcatcctgttgatgaagaagaagaagaataggaagaatacaaggcaggtagtatgggtattgtcccatcttaaattttatattcagcctgcaacctagcattttgatctgtttcgcctccaaatgagacgattatcagcagtggtaggtagaggattattgtattacttgtgggaaaaccataatattaatgtatgctactgttggtactggggagtgagaactcgcccagttggaactgcccacgatttcggcttcgtttcatgacaagagtaatcaaattgaccaaatgcaggccttccaggaatttgaagatgcagatatagttgaccttcacacggacgaccttgcaaccgcttctacctacctgaaatatgattgatgatagtagtttcttcctcagctgcacttcttccacctcctccaatctgcacttgtgcagcctgtgacgcctgagaatacatcaagtgaggctccatttcgtaactgctcgtcgctcgtccgtgcaggagcctattaacctacaggtaccaaaatcgaatttcttgtcagttctaatttcctcctctatttctactttacttttgccaaaacatgatatagtagagtgcccgacatgggatgcgtaggaaacgctcattcttgaagttgaaccgattttgaaacttaaaaggggactgttgctatttgaagaccctattatacatagcatagcgacaaccttctccaaacttgttactaacagactagcctcttaattctattcagaaatagcatatcaagatcatagaaaggagaagataaaaaaacgaagtccctttttttacatcaggaacctttctagtgttccattggcatccccatcactccgccaaaaagaactttatcaaatactagttccttgcagctagcagtatagagcactagtacgttatgagtaactataataaaattgtcatcctccaaactgtcacccttcaattattatcgttgattcagttttctggcagattcaagttccactagccccattcctgtgatgattgatcagattttgcacctccctctgcgtataattggttatttccttcatcttaatggccaatgtagttggtgttagggatcgttcttacacctttttccaaaagcaagaaaatttggttttaaaaaaacatggaaaatatttgccatgcacatacatataacatagggagaagaataaaaggggtaaaatcctaaaacataggccaactgggtgagcaatgtttatgcatataaagccttcattctttcatataaaatatttttctagatctgtactgctataaataatatttatcatatatatttatgtgacaactgctaaaattagctctgtcttgccacatttgtttcttcaaattaaaattgtctcatcttctattcgcaataaaactaaccagaaattttacacatgacttcctcagaaatcagaaaagtattccatgttttctttttttttggctttgcacattataaactacagaaaaaagatatatagtgatttcagtaatgcaccatcttcatgaatttgcaggcacaatataactatatcttctgttcactcttatgggagattggtatgaacaattttcacaatcttttaaggatgctgctaaggaaatgttggcaaaaacagatattgatccaaacgttaagtgcttcacaagaaagcagatgaagcgcatttcaaacaactacagaactatccttgggaaagggggcttttctgtggtgtacaagggtaggctcaatgatggccgtgcagtggcagtcaaaaaatataattggaaaacacagaaaaaggagttcacaaaagaggtaatcatacagtctcagtttagccataagaacattgttaggctattggggtgttgtgttgaggcagatgctccaatgttggtcactgagtttgtccccaatggtaacctttccaaccttctgcacagcaacagtagccagtttcctgtttcattagggacacgcttacagattgcactggatgtagcagaagcacttgtatatatgcattcctcccaaaatcatccaatccttcatggagatgtcaagccttcaaacattcttctgggtgacaaggatgtggcaaaactctgtgactttggaatatcaaggctgttatgtatggatagtgacgaatacacgggatttgttataggaagtagaggctatgtagatcctgtgttctgccagactgggcggttaagtctaaaaagcgatgtctacagttttggggttgttcttttagaactcatcaccaaaaagaaaggaattgatgacaagaaagtgtgccttgcagaaacttttgctcgcatcagtagaaaaggtaatggacacgaactatttgacatggacgttgtaacaaatgagaatatggagtttcttcaaggaattggcaggcttgcacttgaatgtataaagtttgaagtagaggagcggccagaaatgaaagaagttttagagcgcctttggagtctcaaaagatcccgagataggagaatccgtgagatgcaggttatggtacggagcgagattgaagtactttggagaagatgtggctttggtaggtttatgatctcgaaagagagaatggacgatatgacatactacttcaaaactgttctcaaggaatgtgcatcaggcaaggcttacatagggagattttgcaacgcacaactgctggtaataaagatgtcgatttcagttttagatcaatggaaaaacatagtctggaacgaattgaatgtccaatctagaattaagcactggaatgacgccaagcttctcggttactgcttagatctttgggaaggtctagtgcttgtatacgagtatggtgcgatgagcttgtatgatgttctttttcatgatgcaaggaaggtatctcccttcatttgtggcctgcgcctgaagattgcggttggcgctgcagagggccttgctcacttgcactcacttggcattgtgcatggcaatgtcagcactgtcaatatattgctggatgatctttcggtactcaaagtgattagccgcaattacccagtaaagattgcaggctatggaacatcagggctccctgacattgacaaggcacagcacacaggattcttcatggaggattcgcttgtaaccagtcatgggaaggagcatgacgtatactgtttcggtcttgttctcctaacgctcttcacatggaagaaggtgtcactgcaagaggcggataccgtgtttgagcagctctgggacattggaccgccacatgatgtgaattccgagcctgagaaacctgggcaacagctcaaggaagccatccttagatgccgtcatcttgaggaggttaagagcctggtttcacggtgtctgacgtccgaggtgacgaagagaccatccatggtggaagtagcaaaacatctcaagaacataaatgatttacatgatagcacagcttgccatgagctggcgatttatcaatctcgaatgctttcgggctaggctaggctgcaagtagcagtcgtacatggttcttctttgagtaaattaaggtgccgtagtagatgctataatgcaagcgccaagcaacatattacatatgtgtattttatatcccgacaaagaaaaaaagacatgtgtattgcatatattttgtaacagcaacggatgtttgtcatgttgattctcgtggcgctgctgccatataatgttgattgacagatccttggggaaccaacggatgaactaatggacctctcggcatcctttgccaatgactcttgcttcttctgaggtttggtggctctttcttgtttctaattcttattcagtgcatttgcctacatctggccctttggcctttctttcttgtggccgattttgctcgatctttattttttgtgtaacagaagaaatttactacggctcatttgctccagtgcatgcaggtccttgtggccctttggatggtactgtttcttgtatttatgtatttgtgaaaatttccagttttaacctctcttgtggccttgtgggctccaggtggaagtgtgtctggggtaaaaaaatcttttgaaaggttttgccttaaaagagtttccaaagttcatttccatatgtggagggatgatggtcctgattgtaaatttgtaattatacacataataatttgctatccttacgatgacaccattgctagggccggtcctgacattttggaggccctaggcgaactgcgaacttacactatgagcccttaagaaattaatgattttttttacttctaatatatatactctatataaagcacattgatttatcatagagtgacacagataaacatttctaacatgataaattataaataaagcagtttgcaaattgcaacagagcaatttattctcgatagataatatcgatagtataattgacaactaaaaaaacaccatagaaataaattaatatgaataccttaataggagaccacaaatatctcatgtcccttataaaaaaaaaagagcttcttcacacattttttgaagcgaaatcatcgatgacacaatgctacatatagccaagccattcaaactttcctgtgacatagttgaccaaaaattgatattctcgttttcttttgttttttttctaaacacccaacaaatatttcctaggtaacattattataacacctgaaatagtgaaattgcaaagtaaattatataacaataactatgaattgaaatgatagaggcatagccgtatagagccagttgggcagttggttcttgcactggtggagaaaggggctttactcccggttggggaccccctgtagtcccggttatacaaccgggactacgaatccgggactaaagatgggtatctttactcccgggtgaaatcttttttcttaaatcgatttgctccctaaatatccccgatcacattcccaaatcatccccaaatcaaagtagcatcacagatctaaaaagaaatacatcacatattgaaaagaaatgcatcacagatcataatacatcacatcacagaatcttaaacaaaaaatacatcacaaatcctaaaagaaatacatcacaactcccagatcagatccaatatcacgtacatcacagatcaaatccaatgaatcacaaattcaaaaaaaaaaatcggcaacagagaggatggcgctgccggcctcccggccaccgtcctcgcgagctcgcccggccgaccgccgcgcccgcccgcccggcaggccgccgcgcccgcccgcacggcggcggcctgcccgcccggctgccgcacccgttcgtccgcctgccgtacccagacagccggc

SEQ ID NO: 62003 - DNA, 7795 bp, Oryza sativa
tctagagtctgaatcaaatctatccctacttaaaactttggatttttcccatcatcacaatgtgttttcatccgtcgttgagcaccttctctgcctcgcgcggttagcgccttctcaagattccaaatttcccaactcaaacacaaaaacaaaactaaaaggaatcagactctaatccacccaaataaaattagaagagggatccacgtttgaattctaatccatcgcaacatgaaacaataaaaaaatattccaccttgacttcccttaggcctgacggctgcatgcatcgatgcaatcgctccctccgcctaaaggacgagatcgctcgaatccgctcggcaccgaactgcaccatgaatccgtggatgatctcgtcggtggaaaggatgcaaaaataagaatgcaccatgaatttaaaaagaaaagaggtgcgaaaataagaatgtaccatgaattcaaaaaaaaaagagaagttggacatgatagggccgtggcttctctcaagagtagaaagggagtcacctagacatttttcgttaggcggctcaagggccgacccgaacacaatggaaaaagaaaagagaagttggacaggatagggtcgtggcttctctcgtgagtagaaagggagtcacctagaacattttcgttaggcggcggctcaagggccgacccgaacacaatggcaaggagatatagaatgctagcatccggcacgagacccggggggagaaatatctccctatatacctcgatcccccaacaacggccaccccaacaacggccaaaccctgccaactcccgccccctacagctagggttacaagctcacgccaccgagctcggtggtagcatctcgatcgtgttcttttttataccggtttaagccgatgtagattttccatgtggtacgaaactttgttcttatgggttacacgtgcactaatatgggctgtggcgtcccagtaattatcatatctggtcttattatgtttcgtcctcatcgtaattttcgttgcagaatcaatgtgtccttgtgtggtttggatacaaagccaatgagccaatttttgcatagacgcgtttacaatcttggaatcccagctacaaccatggccggcgtcgcctctccgagacggcatagcaagattgcacctgaacgaacacgacggtgatggcggcgtacacggccacgacggtgccgacgaacgccatgagccggtaggcggtagtcgtcggcggcgcagagcgcgaacgtatccgcggcgaactgcgcgacggccgtcatcatgttggtgatcagcctcgcggtgaccctcctcgacgcgcatccgctgccgccatcgcccacggcgagcagcaccgctaaccagtccctgggcctcggcatccacccggcggctgtagcgccgcctggaacgccatggcggcgaacagcgtggccaccaccaccatccagccatccgcgcatgcacaacaagccgaagccgccctgctgttgcagccactcctcgccgctaccaccagcactaccggctttctcactgacaccgccggcgacggcagcggcagcctgacgtccgatgttctgaacgacggtgtggccattgagagggacctggatcgtcctgtcgccgatgtcgatcaccagcctgatgaactaattaatcaccattgaacatgttcatcaacagtaaattgaaagcccttgagctgagttgattagcctggagaattggcagagtcgtcggcgacagaatcaatcgatccatcgatctctgcacaaaaatcaattatgtgctccagctcactctctgaatgtggaatcctaacatgattaacgtcattgttttgtactctgctcctgcatcttcacctcacctgctctgcaattctaattctcatcatcttcaccccacttgatatttgaagggaaaagtaaaagaaaaatagcatcataaaaagaaaagaggagagttggaccagatgatatggccgtgggcttctctcgttaaagtagctgggaagttcactgacgttaaacaacgcagggctctaagcaacccaacgagaccagggatatcttatctataccctcgatccacccaacatcggccaaatcctgccaactcccgcccgccacagctggggtgacaagctcacatcaccaagctccgcgggagcaacactaccacgtcctgtttaatgcgggtctctaccactataaatttttcatgtggtacaaaactccattattgtgcattgcgccgcgcgtgtatatagtaataatatatggctgaatcaaacgcatggccggcccagtattatcggtctttttacattcttggcacccagctacaacaaccatggccgccgccgcctctcccaaacggtagagcaaggttgcacctgacgaagacgaccgtgacggcggcgtacacggcgacgacggtgccgacgaacgccatgagccggtagtcgtcagcgacgcagagcgcgaacgtcgccgcggcgaagagcgcgacggccgtcatcatgttggagatcagcctcgcggtgaccctcctcgacgcgcagccgccgccgccgcccacggcgagcagcatcaggagcacggcgagcgacgtggcgaaggtgcaggtgctgacgatcagatacagcatcgccttcccggcctggtccctcgtgacggcggccgccgccgggtcggcggcgagcagcgccgcgaaccagtcacgcggcctcggcatccacgccggcggctgcagcgccgcctggaacgccatggcggcgaacagcgtggccgccgccatcagccacccgcgcatgcacagcaagccgtcctgttcttgcagccactcctcgccgccgccaccggctttctcactaacgccgccggctgacgacgaatcaccggcgacggaggcggcagcctgacggccgatgttctgcacgacggtgtggccattgagagggacctggatcgtcctgtcgccgatgtcaatcaccaacctgatgttctacacgatgcaattgatatacacacataattagcttaattaatgaactaatcaccattaattaaacatactaatcaacagtaaattgcatgcacttcagctgagtcgagagatttaacctggacataattggcagagtcgtcggcgacagattcgatctccacatctggccgaatccgccgtctatccatcgatctctgcacaaaaatcaatggcgtgctgactagctcactctctgaacgtcgagtcctaacgccatcgttatgtactctgcttctgcatcttcacctgctctgcaattctaattctcatgtcgtagtctcaattgagttggcaagagaagctgcctaatagcactatcaactgagctaccaactactgattgtgtttcgcaaaatgacctatttttcacttcgattctcttcttatacgtaggcgcaggcgcgcagcagtcgccgactcgtcgtcgacccgatatgataattgcaagatacgcacgagcatctttaagaagagatactaccagactgacagctaaatatttaggacaaattagagaagaattgatgaagggagacagaacaaaatattcaggtgtctgaatattagctcagagctagagaacacatactgtgattgaaaagaaaaaaaaaaactaagattgtaatgctgcttattctgattcccctcgggcaagtgtttgtttaggcattctagctctagcttgattaactaaagaacttagtttgcctaattccattccatccaaaccgtccataaattaactgttgctgtcaacaggaatataactctgctcaactgccctgctctgtcttttagtgtcttatttctatcagctagcatgataatacgtgtgccataccagctgcgcacacacaagaatacatatatttctgaagcatgtccatgtctgtgtttggtagactggcattgatcatgaataaatggatcatctactaatgtcagcttacaacaacagatcaacagcagcagcatgtttctagcagttgatctctccctgtaaaccatccatacaattaaaactgctgcatccagaatggagctacgtaacagatcatcgaacatcagtggctcaccgcaatgttaatatgttatctaaacaacatggaattgtttgttttataatggacagaaacccgacatttgtatccacaaagagtaaataagtatacatggtatttgggtatttttgaaagaaaaaaagaaaagccatacccaataatatattgtagaaccttgtatatctataaggttattttggttaatgggcaaataattggcctatttgggggaccttttggcggctgcagtttctttcaaaattagaagctccccaaacagtccagcttttgaaagtcagaatctgaaaatgaactagaagtcagaatctgcgaaacccaacatttttagattcttagaagctagctaccaaccagctatttctcagaatcttaatctcgcctaaacaggcacaatatctaaatcacgtggcttctgaatcacgacgactgccctaatatcatccctaaaattttccacaaatttcgttaaaaaaattacaatagagttggtgcattattgtaagccagcagctgatgtataataccatcaaatcttccacatattcagatatagctccactttgccggatatgtgttaggcgttaaaaataggcaacacgcagtttgtcaggaacaaattgataacaagataaccattgcgtttttcgacaacgagcgaccgattttcaatcaaatcggcaaagagagatagattaatctactccagaaaaaaagaacagaacaataatcgtagaatcaatttatcgattgggttgaggggtttattcaatcggcactgaccttatataggtgtcttgtctttaaattagaataacatatcattcaaccgaatcaacaccgattaagaaaaatattgtgccgtcccagccgcagcaaattaaatgatggttaccttccttttaaaaatcttgaccactcagatcttctgcaatatgtacccatagtttatgatgcaactctaggatcgagtacacgaaccaaatctatcagaggagggtgaacggtagaaatactaaaaaccaaaaaaatttagtgaaaataaaagttacccttggatttggcgaatttacaccggtcacaccattggatatccgctggtttgaccgcattactcccgttggtctgatcgcctgctcgccaccggtctgaccgatgtgcggaggaggcggcggcagaggagacggctgtgcaggggctttctcgttaagcgcatgatgccaagccagaggaaagcttggcgaagagtgcggggaccttgacgctggagcccctctgccactgttatcaatggctcctccgcacatcgccatcatcctcaccgtcgttccgcaggtctagcagcaaagaagaaagggggagcggggatgaggaggggtagcggggagcggggagcggggagcggggatgaggagcggcggcgtggagcggtatccttcgaggcggtgcgaagagacggaggacccgtcgctcacaacgcgctcctccactaggatctcagtctcctcccgcgcgctcaatcatcatgcccaatagctcccccaacctgcaccgcatccctgacgatgagaccccgccttttgcgacggcgagcgtgccttcggccatctccctggccgaccgccgctgatgagggagaagggggggggggggggcgcaccagttgcgtctgctgagctcccgccaccgctggacggtgctgatgcaagggtagccgctctagccactgttagattaatgggctaggtccaattaaatcctaataaattccattggcccacattaaatgctatgggtaataataccaccttggaaatctaagtgaagaggttcaacttaaatacagagctagtggagagtctctgttgaccggttgagatggtgcgtggacaactaggcggggcgaggcgaggcagacagctgctgctgcgctctctcgttttgtaacggacggtaataaacacggagaattgatttcatatcaatgaacgcgtcggttacggaattaaacgtcgtgaattgattccatcggttacggaattaaacgacgtgaattgattccgtattaacgagcgcgtcggttacgaaattaaacaccgcggttgatgactccgaatgttactctcgcgctcgcatatatatactccgcagcgaccagaaggacttacgaagttcttcccaactcttgcacttcgagttcctcctcctctgtagctgcagaatccttacccggttctgttcacctgcgcacacaggtgtacgggacgagcaggtgcctccagaactccgtccacttgagaacttgcacgggtaggcgcgcaatcaagtttttgggtagcgcttcaagcgcgactgctcctgttcttcgttcttcgacgacaacgttgcatcttcctctacttctgcttcaccatggcttctactttagagaacggaggagacaacatcaacggaggcaatacgaatgcctcaacatcttctgcaccattatctgggtataagattcaaactttatttgattttcttcttgttatttacatgttcacaatgttatccataggatttcaatcctatgtgaatgtcaacgatgtctatgcttattttaccttaagcatgcttatgtttatgtttagccttatcactagatcgtttctcattgtgtatgtcatgtttattgtcttaatattttggattaaaatatgccgaattatgaccaaatttccaacaatccaaaaacttgataggtctttttcggtagttggctttgctgcatcactaaaaccacatgctttcgatggttcaaattagaaaagatggaaagcacacacactttttgtggttgacggcgatgcattgtttctttgtttcacggggcaaaccgagtgaaccgcctctctcccctgaggaggaggctaagttcgaggctgcggatagcttgttccgtggagcattgatcagtgtgctcgccgacagtattgtggacgtgtatttgcacatgccttcagggaaggacatgtgggatgatcttgaggccaagttcggggtttccgacgccggtagcaagctgtatgtcatggagcagttctatgactacaacatggtcgatgaccgttctgtagtggaacaggctcatgaagttcagatgctggcaaaggaacttgagaacaacaactgcgagttgccggacaagtttgtggtgggtggcattattgccaaattgccaccttcttggacagactttgctacttctctaaaacacaagaggcaagagttcagtgttactgatcttattgtctctttgggtgttgaggagaaggcgagggcaaaggacaaccagggcaaaaagatcgagggaggttctagcgccaatttgctgcagaagaagaaccttcatgcatctcacaacaacaacaagaaagtcaagcctgatgtcaaaccaaaggctactaccaattttaagaagaaaggcaaaggaaaggcaaaaggagattgctttgtgtgtggcaagcctgggcattgggccaaggattgtcctgagcgcaaggacaagaagtctgcaaacatggttattagtgagggcggaggaacattggggtatggtaaatttttacctacagttctctctgtctgtcactcacctgattggtgggt

SEQ ID NO: 62004 - DNA, 1035 bp, Oryza sativa
ttctcataagttcatcgatagtctgatgtattaagttctattattgtagtgcaaactcagcatacgcatgctcatttctgaagtgctacagtttccttaacccatccccaagaaaggtcgtttcttaatagtccttagtgatcaccagagtcaagacattatacatcagattaaggtagattatttttcattagcaattaataatagtaatagaaaatcacatgtgggacaactaatacaagtcaactgaattgagatcctataacttatttccctctgatgtcagtcattgacatgtgaaccctccaccaagtgggctggtatatcagagactcaaagttatagggatataagttagaggatttgcttcccaagtcaacggcacctttggaggcctcagttcatatgttatggcccttgtaacttagacttcgtttgaaaaggcttcttaccttagattttgagtggcacgtaaaacgagataagccattaccacttaattaattaagtaatacgaatcaaaaaataatattgtttgaattttttaacacatagtttaacaattagggaaacatgatcacaaaaaatgagggagaaacaaatctaagaagcagtttagaactcaacgttactctctgtttttatttaattgtgttgacagtgaaatttggtaatcggcaaagacgtcatcggcttagaatcattatcggctgcagcatctcggaatcagccgatgggagttatcaagtcgccaatagtccgattcctgctatattcggctaaggaaatcaatctactaaaggaagcttatccctaagtgaccgagtttaaagaggatgcgacatggcagtttatctattaattacgaatagtttgttagtttccttttatctttaggaaagtgtgtttagtgtccgataaggactttatattttccttttatctttaggttagtttctttcttatctaaaaaggactagtatctacccatgggtataaatatgtacacctggggtctatgtaatctatcgctac

SEQ ID NO: 62005 - DNA, 1040 bp, Oryza sativa
agtggcagagctagaattttttgaaggggtgggcaaattgtaaatgaaaagataaaactgctacccgcttatataatgtttatgtgctcattttactaccaatcgaaggcagaacaattttctaataaaagcatagtttagtttaatatgcatataatttttcactagttgaaaaactacgttgattttaatataaattaaaacggacgtatgccatattatacttgaatggatcattgtcatccattgtgaagcagtcaagtctggctaggcctaattgcatcgtgcaacagtactgcttgcatggctagctgccagtaccgatgcttctaattatgtctacgaagtaaaaaaatcgttggattttaatgcaaagcaatcactcgatcaccattggtggcacacgcagagcccgagcagctgcccgcgctggccgggcagtgaatatgtcgctcctcacaagttctatcaatagtctcatatattaagttctagtactctaatgcaaaatcagcatgctcatttctgaagtgctacagattccttatccgattctcaagtggggatatttcttattagttttaagttgtccttagtgacctactggagccgattgcccgttctaagcgctgacagaaggcaggttaatttttttaattaaaaatctataatttaataggaaaaaagctattggtctattggacgggatcccatcttcactatcggtgttgcgcacggtatgcgctcgcgcgactcgacgcgtgctgaaccgctgcaaactgttgattaccgcatgcattcactattcatgcgccatgtggtggaggggcttgtccagcaggtcattgactcggcggtggaggagcagctctaggaggttgtcggcctctgttttccgaaggagctcgtagcaggtctagcgctcgattttcgccaacaactggttgatacagaggagcgcggcagcgagttcctgcaaacaagctagcggcactgaagcacaaggcgtcatatagccagtgttgccagagctttgtcct

SEQ ID NO: 62006 - DNA, 12906 bp, Oryza sativa
  unsure (1)..(12906): unsure at all n locations
gacgacgtcttgtgtcaggctccgtcgcggtagtttaggttaggttacttgttggtgtggtgtcgtagttgtggttttcgcttagtttttcctaattacctgagcattgtaaggtttggtcctattttcttcttaaaatagaatatcttcttcttaatataaaacgtcggcaacagcctgaccgtttgaaaaaaaaagaccatgtgcagagatagcatcctttcagtgtataccatctctctcgtcaaagcatggacattgcttgtagggcaatgcacattggacacagcactgtatttggatgccatctcatcactatcgtggaacataagtaatgtgccaaagctacagcaaagtctaattgaacagatgctgagccataataatgagatccccggcttgatcagcggtggattcatgaaggcgtaggtggataggtgtggcacgtaaatatcagagcaattattgcgagcttgtgatgtgtccaatggagcaatgctgaaggtgtgaatgatatctcaagcttacattttcctagatttggtgtcacatgactaattcgagctaaggatttttttttttttaaaaaaaaagtagaaattcttgccgattttaagatatggaggattggaggttacatatttttttgcaattgcaacaaatcatcgctgcagctaataagggagactccaccgacagatacggttaacctggatgcagacggatttgcaacgcatccatgagatttattttgtttaagtattgttcgcacgtctagcaattccagtgtttgtcctgtccatgtatcattaaagacattaaagacgagaattagcgcatcgatctcgatttctgggggagaccaaaattttgcctgattttctgctgtttggcagagggaagaagacaatatgtctcaccttttcaggagtgtttctttccttggtgcaccccgtattttgctaaagatgttcactatttaatcaggcagatgatatttgtttcatcaagccgtttagtagtactagatgactagaagtgattgcttctgaaatgaggaggtgactattagggactactagcttgtagccaaatgaagggtgtccgagtttaaagacgtcaatggaaaatagaacacctctgtttatttctagcaactaaaaatgcactaattgattagatgctttaatgcttatattaagattcaggcctatgtgataaaatggaggaagatcccatggaacagaggagagaatttgatactatcgtcaatcactcaatctaggagcctggtccatctggaaaaggcgtaacgatcgagtgttaaactgacgacagtgaaacttttttttttttggcggggttttgattacggcagtgaaacttggtcgatattacaaagacaatgggcgaaagaagcatagcggttggcgaacgttgcagttccgtagctacttctgtagccagtgatagccctaggttgccttatatgttgcaagaatcaaactagtgcaacaagttcctttccccctgctttttttttcctgttccgttgtaattagcaatctttactttcttaatacaacaaagatgcgtaagttttttttcgtattcctgaaaagaaaatgtagttcttatatgaagttgcatgaaaatatatgaatatatagatgaagccacaaaatgaagtgtcttaaactcttctatatcattgagtttgtcatatttcaacaatttactattgactttatctttttctacaatataccagcgactttatcaattattctacaatacattattgggctgggcttatttttcaataatatctaaaatacccttatagacatataaggttaacaattgatttataccattggaagttttaaaaaatatataaaaacttgtatgtggcatccttgcatagtacaaaagtttgtatataagttttaattttttttttcatttctattttttaaaataacttatttgttggtatataaaatattttttgtgttgttgtttttaatgtaaattatttttcatatgcaacataagatatttttctattatcttttgtgtaagctatttttctctgatataccatacaaaaatatttttttttctaagaaaagaccaaaaaaattgaaaattatgtacatacttctttgttgtgtgaggaggccatgtaaaaaaaattcatattttttcgatactttcttatgagataaattaaatattaaccatttatgtctataaggatattttgggtattttttagaaagaggcctatcccaatagcgtattgtagagcaattgataaaatcatgggtatatattgtagaaagagaaaatatcagtggcaaattgttgaactgggataaacttagtggcatagaatagattctctgttagggaaaagactaatacgtaagaacgatacaaccagttatccatgggagtgtgcacaaacacaaaacacaaacattttagtgatatattgcttgcgtcctcgagatgattgttacttgccagatacattttagtgatatattacttgttccgtgtttagttgttttggaaaaaaaaattgacgtatacgaacacacatttaaaatattaaatatagactaataacaaaacaaattacagattccgcctgtaaactacgagacgaatctattaagcttaattaatccatcattagcaaatgtttactgtagcaccatattgtcaaatcatgatgtaattaggctcaaaagattcgtctcgtaatttacatgcaaatcgtgcaattggttttttcgtccatatttaatgtttcatgtatgtgtccaaacatttgatttgacggaaaagttagaaatttgaagggaagtaaacacagccttgcatgatcgttctatacacccgcggagctgagttctttcccacttttcccaactcacctttctcgttttccatgcgtacgcatttcaaactgctaaacaatgtgttttttgcaaaaaaaaaattctttatgaaagttgttttaaaaaaatcatattaatccattttttttaaaaaaaagtttagttaatacataattaatcatgcaataatacgtgggccgttttgcgtgccgggtggagggtttccaaccttttatctcgaacacagcctaactaagctagtgttctagcctcaaaaggagtatctaaaataagtgcagagtaaatcgtatgtatcctttcccgcccagctaatacaccgttttggtgatttgaccttggagtcacatgacgaactgtaagcgagcttaataggtgcactttaattttcagctattccaatagtgctacaattcacatagatcacacaattaacgccaagatacccacaccatggacccatcacatctataatagcgaagtgaaataaccttgtcgatcaccacatgtgaaaatgccaagcacactgctgcgaggaaatcgacatactcgttgggtttcatgcattatattctgagtgattataaaaacgtgctggcagcccagtaacagtagtagccgagagcaccatttttgttttctcctcgatcaatgaacgtctttcatcaccgacacaaaacacacagccgccatcgatcctcacgtgcctctaccacacagattgccagattggtgcttgattgttaagtattattattactgcgtgataacgtgcgtaccacaaggttaattaggctaagagcaaagataataatagcgctcacttcctactattaatgtatcttaaagccaacatatataatggattagctataaggctagctataactttcttcttctctctatctctcacctatgcatttaatgtatttaattagaagcttgtgttaagctaacttttacattagagccaacatccttgatttttttttatcgctattcttcacgtaagctcactattatacttgctctaatagagtagtactgctaaggctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctaaatacgacctgctccaccgggggccatccctggtaaacagctagagagtactaagctatgtacagtgatcctgacctacacgtacgtcaaacgtttcagaccaccacggcgccccgactggaccagcagcgaacacaatgtgaccagcggcgaaaccccctccccctcccccacatgcacgccaatcccctcaccgccaccaccatgccgtgtcacatgcccgcttccccgggctaccatccaagcctccaccgtgtatataatgcggtgccatgggtagagccattccacacacactgacctgcaagctcgctgggcagcttacacaggggagtgaagtagagggagtgtgagagagagtgagtgagaatgggtggcaaggccgctctcctgatggccctggtggccatcagcgtcgtcctggaggccagggcggacgccggtggctacggcggcgggtacacgccgacgccgacgccggtgaaaccggcgccgaagccggagaagccgcccaaggagcacaagccgccgcaccaccacgagcccaagccggagaagccacccaaggagcacaagccaccggcctacacgccgcccaagccgacgcccaccccacccacgtacaccccgacacccaagcctacgccaccgccatacacgcccaagccgacgccgccggctcacacccctactcccccgacgtacacgccgacccccactccacccaagccgacgcctcccacctacaagccacagcccaagccgacgcctgcgccttacactcccactcccacaccgncaacatacaagccgcagcccaagccgaccccgccacccacgtacaagccgcagcctaagccgactcccactccctacactccacccacgtacaagccacaaccgaagccgactcccactcccactccctacactcccacgcccaagccgaacccgccgccaacctacaagccacagcccaagccgactcccacgccgacgccgtacaagccgcagcccaagccgactccttctccctacacccccaagccaactccgacgccgccgacctacacaccgacgccaacgccgccgtaccacaagccgccgccgtcctacacccccggcccgccgccgccctactagttgtgttccgccactctccgtcacgttccgaccaaaggtatagtacgcccaacacttcagacgctcacggttcagtttgcacatttacttattttcggaaagatttttgagtccgaacaaatttaaatataactaatatttttacaataaaaatttcagcatagattcacttatcaacataaaattttatattgcttattaattaacctgcatgcatggacgaacggatatcttgaataagtctcttaaaagcgggtgcttaatggcgtactctgtttgttttctgtctttgcaggaggtgaccgaccgaccagagttgtgcgagaggccaaagaggctcttccttccgtgaagattgctgtgcatgccgagctgcgctgcctttaattacctatagctaattaattagctagggccaatgttgcgaggagaataatgcatgcttgagtgccaatgttgctagctcgctccctctctagatgtgatgtgtatcatgtgttgtgtgttgctcgaatttgtactgtctagcgtacgtcgatcccgtggtgatttgtggagtatggtattgttgtgttacggtataaccaaaaataacagcggaaatggaagtaaaagctgttttcgatcgtcccagcatttcttctttcctctattcctgttctttcgcaccgtgcaaccacgagaaattgatgattgcatgcatgtcagagaagactctaaactttactagtacaaattgtactgataattaaactccacacagtgacatatagagatttcacttgaaataaatagtacttcctccgttttcgtataacacccgtttcaaagatatttgatactgtttgatcattcgtcttattcaaaaaatttaagtaattatttattcttttcatatcatttgatttattgttaaatatatttttatatacacatagttttatatattttataaatatttttaataagacgaacggtcgtgctgctactgcgtcaaatattttaaaacggagggagtactcccccagaacgagccacaagggtacgactatcacaattggtgacgccattataaaaatgcaatagtctctgcatttgcaggtgcagcagcatgcatgcatgcctgagcagccgtgagctgtcacgcgttgctacagtctcactcgccgcacagcacacaggtacagcgaccgcctctgcatttgcaggaggacgcccatacggctgtgacatcaaagctagcctgcgctccaaaacttcaggaccagaaacaatgtctgtttgcatctccattttcgacgcaggcgcacacgtcggtccgatagactttggagtgcaacaagaactcgaaagacataagcagagtgtaatcaagcatatggtttagtgctgagtttttcatttcatatagcaagggcatgtttatttcgcgaaataaaatttttttttgtcacatcgaatatttgactgtatatcggaagaggttttcaaacacgaatgaaaaaactaattttataactcgcctgaaaaccacgagacgaatcttttgagcctaattaagacgtcattagcacatgtagattactgtagcacttatggctaatcatggactaattagactcaaaagaatcgtcgcgcgatttcctccctaactgtgtaattagtttttcttttaatctatatttaatgcttcatgcatgtatcaaaagatttaatgtgatgtttttgggaaaaacttttggagaaataaagggacctaacaatagcaacgttaagtgatggaacatgatgaacaacgagaagaaaatccactgtgtcactcttgcgcagtggcggatttagaaagaaatagtagttgggtctaaacaaattaaatagagttacaatgtccccacccatctatatataataaaaaaatttagcggtatcttcgtgggggctctcatagttttcacgccagtagtggaggctcgagaccccgccgcccccgtgctagatctgagagtgagaaatatatatgcactcgcaagcaaactgagaagcttgcaaggacgtgtactctacacgatcaatcctcctttgcagtagcaaactgagaagcttgcaagaacaacggattgcaagctgggcgatgaattggtggaaggtggtgtgtggtcacagtgatgttcgaaatctgaagcaatgaattcgacgaagggggagagaaagcgtgcaaggacattggtcggtagaataaattggcttgcagtaaaagaagatcacgtgatggcgcatggccgcatgggagaacttatggtcttttgattccaaaggtttcaagcgctttgttgtgaaaagctgaaaaggtgaggagaacaaagaaaatttagatctggtttagtttccaattttttcttcaaacttttaactttttcatcgcatcaaaattttcctacgcacacaaactttcaatttttccgtcacattgtttcaatttcaatcaaacttctaattttagcgtaaactaaggccgggtttagttacaaatttttttcttcaaacttccaactttttcatcatatcaaaactttcctacacacacaaactttcaacttttccatcacatcatttcaatttcaataaaaattctaattttgacgtgagctaaacatacccttaaaaagatagtcgtcatattacttcaaggagaatatactacagtagtatatataggagtagttttattttagataatgagtatataggagtagtaaattatggaaatggtaagatataaccatgttcagtgttctacttttcagtagcctctcacagggtacacaaaaacaaggaaccaccaacattgtacttgagatggttaatactctaaaatctagataaaacttgggaacaaagagaggcactaacattttctttttgttcttttgataaaactggtgcgtagccattgcacatgaagctcgttttattactactactactactgctactactcaacttgattatagaacttgaatataatgttgggttgttgtgattatctcccgcggtaataatttttttccactgaacgaggcagcgcaagccagaatgcacatgttcatgagataagtgtcagaggggatggatttagtatttggaaaatagcttatgccgatctgaaaactactcagattttcgctcagtggtggtgcacgtcgctggtctttttttcccatttcctcggttcgtggctagcagcctcttgccctcttctagttcacacgaaactggttagtgcactatttttcaatgtatcctccacatgggtttgtcgatggatgtcagatatccctggaataaacttcagagaaaaagttatttttgcctcccccatacctcctctttggcatggaaaggcacacacgggcaaaataagaggggtgaaaaaggaatgcacagatgccaaaaatccaggtttatgtcgcggtgatgtttactagttgtacatgttgaattacaggtgcattttaatttttcaactggtttggagcataaaatcttacaaaactttcaatcaattaatataacccttttttgaatgaaataaaaagaaagacaaagatattagaaaaaaaatataaatctaaaaacaacagttgtaaaatctaattttaatatactgtaaccaagtacaatgtaaccaagtataattactatgtaactaactgtaactacaagtcgagtctacatgaatacgaatgttgatataaaaccttacggacgaaaaaccgaaacccaaaaaatctatagtaagtgaaatagcaactttatactaagtcaaaaacaagatacattaaaaaaaacaaagacagcgtgctagtagaaaaatcattgtactagtatatcatacttcctctgttaaaaaaactaatctatatattctagtacgagagatgtgatatattagctcatttcttttcttagactgagggtgtaggtaaaaacattgattatgggctactgcatttccattgagcaagggccaaggggaagaggagggaaccttgtgcccgggtgcgtgaggacatgagaataacctatagggtaggtttcagtaatggcggtcttaaccggcctgaaaatttttatcaattcctgcctggagatagatctaatcccatttgaaaaatccaaggacgggttagtggtacagtagttaagtttactggcgcagtttctacctcgtgaagttgtcatcactcatcagctgcccaggcaatgcaatgcagaacagctggctgaaggtatgatgttgatcctttcctccaaaaagaagaaaaaaaaatgaaagctctagtacaacaaataactacggagtactatcatcattgacccacagtgtggaactcagtatggatcagaaggatccagagaagccaaaaaaacaacaaatgctacgagggctccacatcacattgaccacttgaagcggcctctctctctctcacacacacatgttgaagcccaactaatgctcactacgaacagagcaatggttagtggcagtaattaaagtgcagtaacagtatgtcagtatcgctatgcatcgtatcaaacagcttcacctccgtgggctctgagacgcgggtagccgagcacggccgccacgagccaaaactggagcgaaacacagctgccgaacacgaacgcaaacttgtaatcagcgccaatttcttcgatcttctttacgaacgcgtaaaaaaaacacacaccaatatgctatagaaaaaagttttagttacacaacacaatcaaccagaacaacttatatcagagaaagggagagaaaaaaaacttaaacttagaaactagggtggctaaacacgaactacaaacagcgaaaatgagccgagccacagctgcccaatttcttcagtcaccagcgtcactcacgtccacggaccacggtccgccgctgatgatgataatgcccggcattgcaggggagatcgggcagctgcaagcagcagcaggaggaggaggatgatgagccgggcccagggtttgaccaaccacgcatcgagcaaactggccgagtgccgacaccgcgcgcgggaccggactacgtggtctctcgtctatccagagcgcggaaccagccggccgatgcgacgcagtgaccgggcggggcggcgattaaagaaggtttcagagtactaaattataatcgcagataaaattatgggtgcgatgcggagaatgaagcgagctgagctgatcgacgatctcacacgatcgggttaggtggccacggcgcccaatcagattagatgggtcatatggacgtacgctgcaacttggggatggccggcccccttttcccctgtccttcacctccctctctatacttgcagtttcctgttcgggttttaatgttcctcgtgttcttttacgtgcgtgcgtctaggttcatccagggcaatcgattcgaaaatcaatcattgatgacccgacaagagctaattatcagatcgatcgatgatggatgatgggcatggatggccggatgggagatggttatctatcaccagtgactacgtgcagcgcggtggtgtggcactgtggggtactctacaattcgacgtgtttgggccttatttagattctaacttttcttttcaaactttcaactttttcgtcacatcgaatttttctatacacacaaactttcaacttttccgtaacatcgttctaatttcttcaaactttcatttttaacatggaactaaacatagtcttggtccggtaaattgtgaagatgtgctaaagtctctgcttgatttgctcgaatggatctcgatgggcaaactagtttttgtgttaggaacggcctaagctaaggaatcaatctaaagctaagagcctaacacgcatgctgttccatggatctattattggggaaaacaaaaatgtttcagatctcactgtcatgagaagaccagatccatccatctaaagcaccaagcgtacctacctttttaggttgaccttaccagcggattaacgccgtcgatcgatgccggtttggcctaacccatatcctgtgtagctcacatgcctcaaagcgtagccgcttaataatgcagtttttatcttttccgtgatggacagtacgaaacaatagaaaatgttctctgaagagaaccaacctgtcgagttggctatcatcatgcctcctgaattttgaagtgtttatcaggatcagaaagaattgcagctgtgcttcatcaggcctcaggtaaagaaccagcaatatcttgtccaaatcaatgctgttacagtaagtccaaaatccagcaattcaaggtagacctgccataacatcaaaatgtactcacaaaatgatcacagtaacggaatttcatttttgagtgaaataactataaactaaatgaagaagatgtgatttcattagagcctgtagtgcaaggctaggaaagagccaaccaatcaagacaggcctgtaatgcagggctaggcaagagccagacaatcaagactgctgatgattacattccaaaatgacagtattacagaagtcaaatgtaaaactttcgttggatgccaaaccatcatgtcgcagttccagcctcctctgccgctagtgtctaggggtctagattgatttctgccaaaccgacgaaattcatttgtacccatactttccgtccagataattgtccagtccaaagacacggacgttgttgaagcccactagtatctcctgtggactgtggttcggtccaaacacaccgcagccgcaaagatcaatgcgtccttaaggtccaaactagcccattaaagtgtcagttcaactaaattcagctaacgacgagaggacgcatcaaatcgaatagatcagtcaagatatcccatgatactctgtacttcactacttgtgtacagatatacagccgaaagtgaaatagtagtaggcactccgctaccagtgttaacactataatgcaaggtctgatttgagtgttcagtaacaatctatctatagcaggtactttgttccacatcttaatagcagtcatttagatgtacttttgaatggagcatatagaattcaaagttaggttgagtgtgttatctagccattttatgttaaaaataggttggaaacttgaaattcgaagtgccaggataccaaagtcaggttgaaactcgaaagaccaaactactagtaccagccaagtccaagtaccaacagcgtgaaatttggagctccttgcaacacggcccagtcctccaaagtccaaagctcaagataatgggtttggtaacatcgaacaaacgggagattcaaacgcgccactataaaaaggcgccaaatggaggagatcactcgaagcaagccgagcactgcagtgaagcgatcgagccaaagat

SEQ ID NO: 62007 - DNA, 12411 bp, Oryza sativa
cgccccacctccgacgacgacgacgccgcgtcggtcgtcagcgggtcgtcgatggccaccacggcgccgaagaaggtggaggagccgttcgtcgacgccgcctgcgccaccctgatcgccgtcggcttcgtcccgcccaccacgtcgtggaagtacaccttgaacttggtcatccccgccgcgccgtcgtccgccgcccgcgccaccgccgccgccgcgcacagaagcacggcaagaacgaggaaagccggtgacgccgccatggccggagctgagcaagatgaggaggagggaggaggtagctagagctagtgagagatcgagtacttatgaagcaagaaatggagattggagagtggttggtgtaggagatgatgaaattcagtgagatagagtggatgtggcagagcaagcatatgcaggttgccttttctaatggggtcggtaggtgaggtgagaagtggtggccaagcagtacttaattatagtactcacttcattgctaaatatttatcaccgttgactttttaaaatatatttatcgttcgtcttattccaaaatttttgtgaaatatgtaaaactatatatatgcataaaagtatatttaacaataaatcaaataataggaaaaataattaataattacttaaattttttttaataagatgaacggtcaaacatgtttaaaaaggttaacggcgtcaaacatttagtacggagggagtataaatttggcaattaagttttctgcttaattaatttattaataattaactaatatacctaattaatgtccagactaatgaggtgattagtcctagtatattagtactgggagttccgtatagtgaaggccagctactaccaccaagaagtgaccttttgtagcgtgggctgtcatgaggttagttaatgagctcatgcgtgcccaactcgtcagctaactaattaacctactttcttgtactatactaattgtagtagtataagctactttgtacagggaagcagatgtgtagtttgtacctgcagattgggagctgttgctcttgaggcaacttagattaactgtctatgaattagacgggcaacgatatgtgtactacttctttcattttagattataagactttcaaatattgcccacatttatataggtgttaatgaatctagatattttcagattataagactttctagtattgcccacatttatatatgcattaattaatctagacatgaatatggacaatgctagaaagtcttataatctaaaatggaggtagtacacttttgaactttttacagacattgaggtatcacattacggttaaatcttgattattattttttacaattttcagttgactaaatcaaatggttaagattttttgttagaaagaagtttgtatgggatttttgttactaagaaatttgtaagaaatttttagtatgtgcagccaccatcgttgtcactatcgacaccatcctcgagccctagggatgccagatccggcgtccccaggtggggggacgccagatctgatcggccccaacctcgtggtgggtcgattcggcgttggttgagttttctctccactcacgagcatcgccaccacctccaccttgagcttcggccgcccccaagcgccggcggcaacctctccacctacaagctcggtttgccaccgccaccaccacctccttcatcgagccacaggggtgccatatccagcctcctcgaggtcaggaggtcggggggacactggatttgaccgcccccaacaccgtagtggctggatccggtattggtcatgtcatctctcccacccacgagcacccccgtccctccgcctctacctcaagctctggctgccacgatcatcgtctcctttgcccccaagagccagtggacgcctctccatcctcgagctctggctaccgcctcttccaccccaagctccacctgccccctccaagcttgttgttcaacttgcaaaagaccacgacggatggtggtagcggtggaggaggaggtcctggcggctagttgcaatccttgtcggcaagctgccagatctagccatgcgagcccctatcggccatcctaggtcttgtctaccttatgagccccttccgaagagtattgtttccacagaaatttcttatggttcctcatgtgagatgtgagattatgtgattgtgatgatcgagatcttccatgtttttttccgcaagagattttattgcatttagtttgcagtgagagatccaaatgattgattcctttctgtttgtagttttttgacactgtgttgatacgacaacgatgaacaaggattaactttttattttttgcttttccacattagtgcatataagtgacgggtgctaacatgtgaactgatttttttccctattaagcagctcattgatgggtgataatatgtagtccgttagagaacaatatcacctgtgacgggtgaaattttacgatctgtcacatgtgatgagtgaaattttacgacccgtcacatatgatagtcatcactaaaggatgcctccacccgttagaggcgagaggagacaacactgaccactcatctctgacaaaggttaaatccgtcagaggtgatgttttgggcctgtcactgttgatctggactactgtagtggctggacctcttttcctcttaaagcttccgattaagctgtctcctatgtgatcctttggggctttcttggtcagtgaagtcaactgtttaggttaagatccgtcgtagcaagtcggagctgcttatcttattgtaagcttgataaacaatcgataaatcaagcatgttacaacaacaaacgatgtttaacaaacataaatgtgcttatgtatgtcgctcatcatcttctagctacgccttgacgaagagggtgtactcgacgatggtctcgccggacttgaagccggagtcgacggtgcgggcctcggcgtaccccctcgccatgcggaacttgccggagccgccgacgacgctcatctccctcaccggcgacatcacctcgttccgccccatgatcgccaggctgctgccgttgtggtcgccggcggtgaacacgaagttcatgtccatcaggaggccgatcaccctctggtcggcgaacgtgtacgtcccctgcgcgcgccccaccacctcccccgccgccgccgccgccggcgagctcgtcagcgggtcgtcgatggccaccaccgcgccgaagtaggtcgacgacgcgttcgtcgacgccgcctgcgccacccggatcgccgtcgggttcggccccgccaccacgtcgtgccagtacaccttgatctttgtcatcccggcgccgccgccgccgccgtcgtccatcgcccacgccaccgccgccacgcacagtaacagaagcagctggagagccgccttcgccatggctgcagctggagcttgagctgatcgagcaagctgaaggaggagctagtgagaggatgagtgctgctaatatataattaatgtagctactactgctgtactccttccgtcctaaaaaaaacttaacttagaaggagatgtggcacatcttagttatccaaatttgttatattaaaagagatcatattttttcttaggttgagttttcgtgggacagatgaagtatttaagatgaaagggaagcaatggatataatgcgatgggagtggttggtgtaggagatgaagtgatgaagcagcatgcacgtggtagagctttttcccttttctaatggggttggtatgtgaagtagccatctccttgatttaacctatatttagcatctccttaattagcctatagttagcatttctctgtttaattattctgtctttttttctattatatatactcccttcgtttttaatgagacattgtcaacacctaacaattcatcattcatcttatttaaaataaaataagtacaaatatatagaaaatataagtcatatatacttgagccgtgtatttcattcgtcctaaaatagtaacgtttagtcttcaaagtttatttaaaaatataacaacatctttatccatgttctcttcccaactaattacaacactccacaaatcaatttcctcacttatcttcacttgcatccaatcacaatcttccctatttaattctatctgttttgttaataattgtgttcaaccctaaaaatcctaatattttgggatggatgtggtataaaacaagtcgcaacaaaagaaataatgcttatatagttcttttagcaagataaatagtaaaattctatgttcagaaatcgataattaacgtcacacattagaaaacggagaatgtgtatagactaatgaggtgattagtccttaatagtacactagtagtgtcagtagtacaattcatgccactaccaccaagaagttacccttttttagcgtggactcgtcaggttagtaaattgcattacgcgtgcacatctcattagctaattaagcaagctatactttatagtgctgtaatatttatttagtaagcaactattaattattgttagtgacaggctgatagtagcagggaagaatgttaagcatgtgaattgtttgtacctgaaaactgggagtagtcggtgttaaggcagactgactgcgactagctaagattcttcagacattgggggtggttggatggtggtgacactgaagagaacattattcatgcaggatttcagaaaaggagttaacaatatgcagtggtgattggcctgcttaattacattttgatcaactggtttcattattatagatatattgaattaatcatccaagttatagatatgccacctgaagattttaataattgagaaattaaaattaaggtcgtggtgtcaacgtgtcatcactgcattgcagatctgtagtcactgtttgtcgatatgcatcttggttcttctagtgtgttcctatattttatcatcttcaggtttggtgggtataacaacagtaatatgataaggagagaaataattgatctgccttttgcagataaccaacttcaccaacacagattcgttcttcctaattttgtttttttttataatgagagtttttattgaaccagttaattatatcaattttttttctctccttactatttcagagatttgttattacgaaagctcccagatttaagcaaaacgtaaataaattagtccaattactcatgcacggtcctgtacctactcatgcacggtcagagagtgcacatgatggactcttgcttgcagctaaatttacactcgcagaattaaggagttgtaattaacacagtacggagtttttcatattattaatctctgcttgcgtatacattaacacagtactagtaagttagttgcgtcagaattatcaacttcacccgtaggaattaattcctctcttcttacacattggaagaatcagaatgcaattataaggactagtccaaatacaacaggtcagataaagtcactccaaacaagttatatttagagctgtctcagaggacagatgtgtttgtttgtcattggcacattagtgtgtgtgtatgtgtgagagggatgcatatatacttgaattattagtttcctgtgtcaaggaagagaagctaagaacaagacagggagagagagagagattcagaattttcagacatgagagtgactcagtggcacggtgaaagttccctgacagaagtttccaccgattatgctgagttctttagagctcattgagaaaaaaaaagccgagaaagctattagcatataattaattaagtgttttaaaaaaatatctatttaattctttaaagaaacttgtaaacaatttcttttaaaaatattgtttatcagttaaaaaagcatgctagtagaaaacaaagcactggtcagcccaaaaagctcaaaagaactaatcttaacagtgactcgtttgccaaggtgaaagccataggaaagaagttgcctgcagccatgaaaacatgattgacctgtatgactaccaaccaaggctttcagtgctgatctgtctgtcaagctatgtactctacaattgatgatcttgggagtagtttttctggccatgatcatctgtagaggttcggtggtgtgcgtaaaagataatactcccctgactggccgaccctacctaattttgcaggtaaccagcgcgtacctttgtcccaccatgttgccatcgttgtaaagcttttgttctcgatcgattttcaggttccaaatccgatcgaatttaagcaaacagatcgaacaaattcctctgtgataaagagcataacttttctctacccatttctccatctcgttttgttcagcaaagagtttatttgtgatgttcagtggtggtacagaggttgtgatgatgttccagttgagatcagagtttttggagattcttagttggtataattgcgcagtggcacatatactccctccgtttcaaaatgtttgacaccgttgactttttaagtacgtgtttgaccaattgtcttattcaaaaaatttaaataattatttattcttttcatatcatttgatttattattaaatatactttcatgtacacatatagtttacatattttacaaaaaattttgaataagacgaacggtcaaacatgtgctaaaaagtcaacggtgtcaaatattttaaaacggagggagtaagaaacatgcgcaatacgtacgaattttgtttggtttgaaatggcgaaagattagcacaaattaataagctttgcgcagctgtggtgccactgagcctctgaagactgaaggagaaagagagggtcggagaattaaactccgtacgcactgcgtagtgggccgcagcttcacaattcggcaaattgcaccgcgttgggcccgacccacttcacagatgggccttcagattatggctgcttctttactttggaggcctgaagggcgatggtccaaactgcatgcggcccagtcattttgacaagtgctagatagatgaaatactccaatacattaatctttttttttaaaaaaaaatgaacgcaagcatgtccagactccagaaaccagaatgacatgtgcgtatgaacaaagttattggccggtcgattttcatggagcaggagatatggaaaataactgcgtacggatgcttataatttggagcgagattaattcttctacctgatggcgtacgtttatgtgttaattaatttggatctaatttggagttgatcgttcatgttcgaaagggggtaatttttaaaaaaatggattatttgaatttgaccctgaaagacgtggaatgcattgaccagctgccgcatgccgcgtttctacttacccatcacgtggccatgcttacgttttttcacactatactacatccgccatggaagcttcctcttccgggtgcactgctgctgacctttctactacctcatttcaaaacataaacatttttaaagataggctgtgtttgaggaagagaggattgagaagattgggaagatacgtaaaacgaggtgagccattagcatatgattaattaagtattaactattttaaacttcaaaaatagattaatatgattttttaaagcaacttttctatagaagatttttgcaaaaaaaaatgcaccgtttagtagttttaaaagcgtgcgcatggaaaaggagtcgcaatctcccctgtctcctgtgaacgaacgcagcctaagggtgtgtttgagaagaaggggattgaggagattgggaagatacgcaaaacgaggtgagccattagcgtatgattagttgagtattaactattttaaattttaaaaatggattaatatgattttttaaagcaactttcctatagaaattttttgccaaaaacacaccgtttagtagtttgggaagcgtgtgcgtggactatgatgtattttctcaccctaacttatcagaacgaacgctccctaaggatagaaacggatagaattggtagcatctgttcgaaaaatattatcgattaatctggaattgaccaactatttagtgtcaacaagaagatcgaataaattagaaaaaactaaaatttatatattgttagagtcggaaacggcaacacttgtgtggatacgacgctcggttagtggggaaaattttccatgattattttgagtatatgttatcttgacgggatggtcagtgttaggtgaaccaaggcgtgcacaaaaatcttggaggaatattaccatccatcaaaataaaaaattgtaacaaaggtaagctaatgaagctctcattattctaaaacacattaagaacttataaacaataatcatcctcaagaatacacccctaccaacaacaacaacaacaaaaatcatagctagcgtttttttacagggaaaaaaaaagcatatgacaccacacccagcttatatattctagtaatcaactggtcaacacacagcaaaaaccggcagtaaaatgaactgatcaacacgatcatcatcttcaatatcatcgtctcaagtaatgagaatgaatgaatgaattaatcgaggcggagatggatgttgtactcgacggtggcgtcgccggtggtggcgttgaaccaccacgtcgtcgcctggcagtagccgcgcgcgaaccggaacacgccggtgccgcccaccaccggcatctcccgcacggcgcgctccgccgggttggcgccgaggatcgcgaggctgctgccgttgtacgggccgtcgccggcgaacacgaagttcatcgccatcatcagcgacagcgcgtccttgccggcggcgacgtacatcccctgcgcgcggccgaccagccgcgaggccgtcaggttgggcccgtcggtgagcgggtcgtcgatcaccaccaccgcgccgaaccccgtcgccgaggcgttcgtcgtcggcgcctccgccacctgcgccaccgtggagttgggcccgccgctcaccacgtcgtgccagaacacccgcagcttcgtctccctctgcgcctgcgccgccgtcgccgccgccaggacgaggagcgccgccgcgaacacgaaggaggaggaggaggcagccattgcttggttcggattaagctagctttagctgtgtgatgtgatttgcgacgacgtgtgcatgggtgaatttaaagggggaggtcggggacgtggttggtgtgtgctggattcgaaggttcttcgatcgtcgtctacacggcgaggaaggcgactgcaaaaatggtcggatatatgcaaacagtcaggttagaaatataatggaggataaattagttaacactagtggagaaaggggttttactccctcttcggaacccctgtactcccggttttacaacaggaaggacgaatccaggactaaagataggtatctttagtctcgggtgaaataaccgggcttaaaaatccatctttaaagatggataggggccacatcccaactgttttttttcttttatttattgtttctttttgctgcttgtatctattcccccagccaaatccacacaaatcatcaatcatgcacaataaaaatttccacaaatcaagcacaacaaaaatcatccacaatacatacacatccacaatctacaaatcttgtgagatcatccccaaatcaacaaaaaaaatatccaataaaatatacaaaccattcatcattcactacaaaaattcacaaaataaaaaaaatccagtcgctgttgtcgccgcccggccgtgggctgctggcctccttgcgcccggccaccgcacgggccaccgccaccggccgccgccaaacaatacgtctccaatccagcgagtagatgaaagagcgagccattccttgccatggcggtatgcactactacagaaataatttttctagacaagatcctctttagattgcagacagaccgtaactagtccagtatgtaaaaaatcgtactccattttcgcatacagctccttaataggaccgcacgcaaaaatcgattttcacaagtggtcctcttaaggattcgcacgctaaaataagcttatttttacaggcgaacctctcaaagagacgcccgtttcgcaggcgggcctcttaaatatatttttgtggcgggcgacgcggctgacaacgagcagcgggctgtgtggttgacggcaagcggcgagcggatccgcctccgccggcctcgtaatgggcggcggatggcgtggctgacagcgggcagtgggtggtagcaacggaccacggtggcgggctcccccgcacgttgaaggaggcaacgacagcttccttgcacggaacagtcgggcggcgagcggccgcgatggagcacggcggcaggctccgtcacacgtcgaatgtggcgaaagcggctcccacgcggatccagcgggcggcgggcaccgcccggatctgctggcagagggaggagcccggcggcggtggctagaatttttttgcgatttttaattttttcagatttttatttttaagtgcggacgatataagcacccgcatgcaaaagttgaattttcgtatgcgggtgctccactagcatagaaaaagagagattttttcataactttcctggtagacgggccagagttccgcatgcaaaaatgatcacttttggcccatcttgagatatctaaattatttacacataaaaattttggtatcatggaatatctagtagttgaagatataccaaattttacataaaaaatacgatatctcataataccttctctaaaagatgaaaaaatatattatcttctgacaccttcttaaggttagctctagctgatcgtgtgttcaatttagactttgattaatttacattgcattcttcaataattcttgcatgcttggattaactacatgtagaaattcttatggcattcttgcgtgcatgcatgcaagttggatatgttaatttattttaaattcttttggcgtgtgagagggtaggaatggactgggtcggtgatcggacttttgaagaagctggcaacagatgcagtaggtgaagtgctgactgtgaattggtacgtatgaactactcgcatcgatctctggggttttcttcttcttttcttttttaaggtgaaattagcacgcgtagccgcgtatataggtatttggtgagatgaaggcatgcttggtttaattaatttccaagcttcttcggtatatatgttctagaaatctattgatgtaattaaatatgctccgatcatcacctttggtctttggaacgtctgtacgtgtctatccaaattgtgataacagaattatagcaaagttatgttgcttctgtatgttcaaaaatcaacagatttttttttgaacgcttagaagttcttgctgacaaggcctctagtttaacttcgtttgtgctaggcttattccgggtcaagtcgggtcaacagaaaaacaaatcagtttatagttcagtccaaaaatattttgtctatagtccaagtattggcaattaaatcgtacagaaattgtaactgtacaatacttatttacagctcgttaaagccaatgtctacaacagacaacactctaaagagaaaggcactcctacagaaagctttttctcaaacgatcatatatattcagctttttcaaacagacgccaaacatgtataaaaatactgattgttatgggctggcaccgtaaccacatgcaaaatcttattttcgtaagcggacatgtgaagatgttctcctgcaaaagaattttagccataaaatctccaagataatttatacccctagccaccgtcaaatcgggtaagcttgaaggctagcgtcgtagctgcccaaagcgaggtatgagaagaggcgatgaagctgtcatcattgtcccccacgtcgagctccaccagatccaacgagcctgaagcgtgctgccactacccaaagctcaaccgtgggaagcgagggacggggagaggcgatggaggtcaccattcctgtgccgccgacggtggatccgtcactcctgaggccattggaggtggatcgactgctctcgaggccagcgacattgtccagtcagctcgcggcagcggctcttccctgtcaaagagccgtagccataaacgttattgccgtcacagtcctcacacaagtgcaatggctcgccgccgccacccgtcgccggccacaaagccattgccggcgacctgctcgccgtaaccatattggtggctcggacccggctggtctggataatattagactacaccgccgctgccatagttgttgtcgccgccgacgttgtattgttgtggttggcagtggcgctgtcaccggcgccggcggcggtgtggtctgggttagggccagagcgctc

SEQ ID NO: 62008 - DNA, 1108 bp, Oryza sativa
gacattccttttgggcccatcaaggcttacatttatagtattaaatagctcaattgtgccattcatgcaaagagtcgatatgtccgagtggttaaggagacagacttgaaatctgttgggcttcgcccgcgcaggttcgaaccctgctgtcgacgcatttttttccccttcccgtagtagggtcttgtgctgttgtgccatatttatcccactttattatcttttttttcctttaactagacatgaattccagtcttcgtgtcatttatccttttgttaatattttttccctttaactacacagtaattctactcttgtgccatttatccatgcaatttattttgcttggactatatctccttgtattcttttttttttctatttcacttgcgatagatgtttagagtcttatttttagattttcttttcattcatagaatcttgcatcaaagattcgtgtacgcatagatctaacttgcaattacaatcagttacacaacacttgtacagagtgttagcacttatactcagttacatgtagttacactcagttatacatttacagtgcaccgatattaaatttttacaactatatttttttctagatttacaattttggatatgtttgtctctttttttatttcattcgaaacgggttgtatatattggttgaaattctgtaaaatttaaagctccaaatatgtcgaaagatcaatgggtagacctttttgcccttaaataattttaacatatttctatttattttttgagaaaaaagtatgctgtaccaaaggaataggagtactcctttttggcacgtataaacccgcggaacaaaatcatacaaaccagcatcttttggtcgaaattgaataatcacaaatctagccacgacagtgactttgcacttctattaggaaggaactgaagtgtttacaacaacctgttgtgtgaatcttttatctgatttttctttttcttatctcttcatcataactccaaaatcgaataaaaaccaaaaactaacttaggaagaggcaaacataattctgtctaaaattttgggggacaaaaaaaaactatctcctttctttttgaaaaaaaaaa

SEQ ID NO: 62009 - DNA, 1091 bp, Oryza sativa
cgactctagaggatccccataaaagtatacatatatcacttttcaataaatacttttataaaaacaagaagtcaaagttgtgttttagagaccgtgtcgctgtccaaaacgacttcctttacgagaaaggagggagtatagtttaacaacatgtgaattatatattataaaaatatttataatcactactacacaaatggttttttttttggcggccaaaacacatttttgctggctagtgaagataaagcatcttcactggcggtgaccaaccgccagagaagagatgttttcactggcagacggcttaaggctgccgtcagagaaaattatctttgctggcggcacccatacgaggaccgctgttggtgatatgggcccgggggtacgcaagatggagagaaagagcccttccgtccggccacgtagccgcacggccttcccccccccccccctcgggggggaaaacaagcggtcatgaagcggccaaggggcctcgggatgccctgccgcacccctcggggccctcgggcaagctgccccaaggcccccgctcggctgccacatggtggccgagtgggcggagagaggggtgctctcaagcgccttaaataagcatcgccccaaccgtcccccgccgcatttaatgtggcgtgggcggacgtgaggcgccgtccgattgatgtgcgtcaatcgggcttgatcggtctgtgaccggccaacaggcggacgggacggatagcagcgtacccacgtcccgcccggtgtcaggcggagtgggggcagataagacctgtcccatcggcacgtcggtgagcgtgctgctcctgtatggagtccaccaaagtcgccaacgaattaagggcgaatgacgggcgtgtcccccgtgtcaggcgggggacggcgctgggcccacctgaggatgagcaaccaccttgtttctggttgaaggcaaggacaacggcttgacccaagacatgtgggcccccacccaatgatggattgtgtaaggcggtgcatgtggtatccccttgaactataaaaggaggaccttacccaccgagaaaaaaaacgccacttgagaagcttgc

SEQ ID NO: 62010 - DNA, 16669 bp, Oryza sativa
  unsure (1)..(16669): unsure at all n locations
gtcctaaactctcttcccatcaatttatatttttaggttataaggccgtgccaaaattttaattttaaaatttaattttaagagttaattttgtgagtttttatcatagtttattgtttagtattggtttttaaatcgcaaataatatagtagaaaagttttgtctataaattttttttagttgtttgtatgttgttttacattttatcagttgtaagccaaccgatcagactaacccaaggaaagactcggagaggcttgacaaccatcttaatcgagtgatcaccaaccatctggtttactctgaggagccttgaacaattccgtgatataatcctgttcgtttatgtttaagatacacattctatctcaattttcgttagaaagtttttaaaaccactaaaaagtgtgtttcatgtgaaattttatagaagttgctaaaatatcaaatatatatttatttttaagattaaaataattaaaactaaattaattgatccgcttcttcatctatctctgaccgggtcacaactcttccaaaatccagaaagaataacctgaaggaacgacttggccattcactcgttcaggccggtcaatgcagcatcacattaacaagacgaggcaacagtaacaaaagagcagttggtgcacaacttttcaagcgatgtccccattccaccggaaagttttccctagcggacacaacaaaagacaaacatttactctgccccttttttcctcttcgttgtcagacacgtcaccagtgaaaattaaattataaacatcgaaccttgttgttcatgcatggtacagtatggaggtgagtcaagagatggactagccgtagaaactgtaggagaaaaaggaagaacagtgattgggaccaagatgactcgttcacccttatatttaattaatcagcaccgtttcttttatgaatcatgatgtaatggcgtcattagctacccttatttacccgccaggaatcgtgcacgcacatgtaagcgaggagggaatttgtggtactacactactactttgttcaatggaaaaagcttttattcgaatgaagcttaaaaacataataatagtttagagcataacaagaacgggagaaactctgcgagaaagcactgattgttgtgaaaccagttccttaggtttaaattggtagacgatgtacctatcaacagcgatgtgcccataatgactttatcaatatcaagatatgccgatccaattttttaaaggtagggataggatgtgtgtttataaagatagggtgtgtgagcatctatgtttgtattgtgtttctaaaaagaaatactacctaatatgatttactacttaaaataatatggtaatctctcccttaccctcttagtctcctgtcctaaaaaaactcattctgaagtttaaattttgtccaaaaaaaaattaacttttaccatcttacctaacctcagcacataaaacgagaagttttctcctttaaatatcctttatctacctattaaaatgaggaccgctacaaaacgagatctagttgcaacgggatagatatattaactattctcttgcacgagtatcacagataccagataacaggtattacaggtattaggtaccatgcagctggtagcctggtaccacaacagaggtaacaggtatcacaggtattgggtaccatgcaactggtagcctggtaccacaacaggtatcaggtatcctcgtataagggtatcccattgtattaggtaccaggtactatctcatagaagggtatcccgttccaatgagataccgttgtataagctttctgattaaaattactactttttctaacaatgaggggtattttagtcatttttactcttcactaatctttctttaggatttaggaatgggcctttctgggaccgaggggagtacgtagtaccatgaaccgtaaaagtctctaaactgaagcatccatctgactgacgcgactgcaagcaagcgtacggttactggcattgacgaccaaaggtgtggagatgatgaagagtttctgaaagttgcatgtcggaagttggagactacggttatgtaattttttgccaattatggttggagatttacaaatagacttcaataattgtaatctccttatattagactggattctttattgttccttgcggtgtgttctattcaattagatctaccctatgttcgtcaaacgcttctatgtaataattggctgtagctcttttgagtaaatgccgggatatttatttatttcattatctaaaaaaaaactggcattgacgaccccgatttttgtcaattggaagctttgaatcgaaactcatctaccattgacgatcccagctactaatccttaataacaacaataaccctagaccagatgacacttatctgtacgatcgatcgtgccgtccgtacacacgaaaagacagccttcgagaaaaacgcaggtaaagcgatccaaagtaccatcaccagtacggcagattttaaattttgactcgatcaagatcaaatcgaaccgaatccgagcgaaaacgaagcgtttccgtgatctcgtcgtcgtggttggtgcgtactacgtatacgggtcatgcatgcatgtagatcagttctgtcaggagttttacgcttggtggttgcttcataattctaaatcaacaattaaatgctttgtcttattgtctaatggcccttttgcttaattttggtgtttaaaccttttgcttggtcgattaattgtttgagcctagcttttaatttatctgtccttgaaaaaagtatttatttgagcctacgtatctgaacgtacttgagtattttttttaattaatcatccacattcaattttcttcatgcatgttttatcctgaatcaccctcgtctactatcaaccatctcccatttaataagggtaacattttttttctactcaatgttaatatttgctaaaactgctaggatgtgtttatattttagaatggaagggagtatatacatatatatgtgtgtgtgtgtgttcttcttaatttcttctcttaattctctatctcactcgtagactttaaataaccactattaataattggaaaatatgttattcattcttttgttacttttctctctcactcatggaatttaattaccgctgctaataattgattaatacttttgtctagagttggacccctcagactctgctggcacatcgagtgtcagtagtaaaagtgtttactgatagtcacttagtcagcttccttgatagattagagtgctcccatatgaatggtatgatgtagttgtaatttaactttcattggttcccaaaaatttccttctggcggtgaggtgtggaaaattggtttacttaagcattaagctatacacatttataaagttgttactcgatctatttattcatcgtctattttgattcaattaagtagtgagacgtgtgatgggtatagacaaacactgtgaacaaaagaagcgtgctacatgaatgatcttgtcaaacatccaagatttcttttagaaatgacaacttagctagatttgtgccagataataatgttcctttagggcactcccgatgaaagtgttcatagttattaatggcgtgatatgtagatgcaatctaagttggtaacagaattgaggatgcatgtgtgagagaaattgaccaacttatggaaaacaattaaataaatatagtattgtgaccaaccaaagtgattccacatcagaaaatcagaggaaaatgaacagagataagagtaaaataaaatgatgaactccgcctcactgccggccctctgatagccagcttgatggtttctaagtaagttccaaagttttttccacataaattctttggtagatctattatatataaaagttagttttttctacggtgttgatagaattatttttttaagagttgtttctttctttgttggtgcctacttatttgtcacgttttatagtcttctataaagacataggaagttttatctatcgcgttgtcgatgatccaatcggctcgttgactttagagtctaggtcaccaatttattcgatgacactggtttatatactttttggatatgccggaatcatatctctcgcaacgttccaagatttggagtttctttgttctatttttggctcttaaatgtctccttctaccaaatggttagaataatctcttttatttaaatccaatttgccctgtttcaggaggggaaaaagcagagaaagtgacgatgaaatttattattcggcagcgcttgtaatattattgcaactggcaggtcagcttctataatgatgtccctatgatatgcaatatgaatttatgatagacttcacatggttggtatatcattgtgaattccctagcaaacaacaacataatacacttaggtcgtcgtactaggcataattaaaccaagaactcatcaatattggttggagataattaagagagcgaggcccccacttactatatatgcattaattttgttcaaaaacattttagttttcttaataagtacgaaatatatattattgtataatctaaacggacccagctgatataatgtttgaaagttgaaaccttaccagtaagtccgtaacatggtacagttttgcatcgatcgtacggttttttggacactgatttttagccttaatcaagcgggccattgtacagcatgcgactttatgttgtcgttgaaacaagagttattcatttgacatgagctttgcgttaggttaatttggtcccaaaaacaaacacagcacaacggaagtaaacatccatcagtagtcatgtgtactcatgttatgttaggacgaagctagatatatattgtaattgatggacgcattaacgagcatcggatagagagtactacgtgatggctcaactcacggcagttgatatgttaaataattgctttcaataatttaccttttatgtactccgtgaaagagctaacggcgctagctatcgtggttagacagttaagggttcttactaattatcagtacctttttaaatggagaaattttatagtccttaaaatagtatctcaaagtatctaaattttacgctaaatttttgctacctcaagatacgtaccaaatattacattaaaaagtgccgtacctcctggtactttttcaaggtggtaaaattacccttttagctatccacggtgtatgctttacactgaatcgggatagccgtctgatcagctaaaggagcgtacatgaactatatctagaaatagagttattatctaatatgtgtataccctgaaatcctttaaccgaataatattttttttgcgagtaatctttaatgaaataatgaatggccatacaaatgtatgtacagcttcaccgtagatggggacaagttgggagcatattggacgtactgacaaccattccaactggtaaatggacaaagagataatgtagctagctgaggtagttttcatgttggcctcaggacaaaataaaaggccagcaactatagctaggctaacccactaattaacactgatgtctcacctaatagtgcacaatccaatctactaccaaatttaatcttggagatgctttttggtccttttgtttcatcatttttgttttggagcaacttttccaactccaagctggtccttttggttccttgggttctagaagccctgtggtgtgtacctacctacctacctaccaacttccccttatttggtacctaaactaaccagcatggatactgttggctaatagtctactgatcaatcaattgatgtataccattacaaagattgtgtatagattatggaaagagatggtgggcatcagccatttggctacctatggtaagagtgtactagatcccttaattagttttcatgatctaaccaataggcacataggaattctttttttcttcttaagttaactgctaacaccactctctcttcactactggaattccacggggtccctagggttttcaaatgttccctagagccctaattagaacccaaggggataataagttccctagagccggaactaaaactcaagggaactgagatgatccctagagtttttgcttgctcatagggaaactagtacagttggcactgataggagaaccacggtggcagggtccactgactttttcagaaaccaaccatgtggaaaggttgtaatagtttctcccgccttgtgaatccaaaatttggactgacaccatattcgctttccattggaaagtaataaagtaccccaagctgctaaactttcccctttcttcttccttcaacatgttctttcatctcttcctccccaaatcaactccctctccagtctccaccaccaaatctactctcaagtagtagagatcgacaggagcttcaaccttcgagggtggttgcagcagcactcctgaaggccgtggtgggcgtgggctgattgcatttgtttgcggctgagaggcgacgccgggacaggggtgaatcaaggccacggcgacctgtgcagcgtggtgttgccgagctgctctctagttagcatttagcaaagatactcgagcagatattttcctgtgcatattttgaagttttgatttttgatggattcggtgcttgatgcagatcggtaaggccgagaagtcaagaacttattactgcggttagtaatcaaagctagaaatcatgtgcttattatattgaacaaatagagaatcccacgtatatatatatatatatatatatatatatatatgtagctgcagatttccataagttcttattttcttcaaccttcctactcattttgcagcttgatgacttctggaagtgctattacgtaccattcgcattggatacaactactgcagaaggctatatttgtgttttattttgtcttttgagagagcaaagccacgatctattaagtgttcgtcaattttcaactctggatgtactctccctctgcgtgtgtgtttttttcttttgtttttcgatgggcaactctgcatgtactcccaatttttactgttgagattaactttataatgcagtatatatattttttgttcaagcaagttgacaaaaatatgattggaatgcttactggcttgtttgcaaaagaaataaaataaacaaataaaactaatcaatgattaattaagagctaaattaatctgcattaatttctaaatgaaatactccaataaaaatgttccctagggtgccgtaccactttccacgttggattttttctgtccaggtggcattcaatccctacattttggaacacgtggaaagcttctttccctagattctactaagaaaacccaagggaatcaatttgttcccgtagaatgcttccctatgggccattccctagggttcactgtagggaaacccgatccctagagtttttggctgttccctagggtttttagctctagggattactggaagtgacacagaagattattagacgaaaatggctagaagtactagtaggtttattgtgatattacagaaaactatcgtgacttaacgtcagtggcgtatgtatgggtggtctaacttatataattttttaaataccctaaatataactaagttaaaagtataaattgatcaaatatacatagtaatataataataaaagagttttttttaagatttatgttctcatatgcatatatataaatatatatgtattgggataggattttttgggtggtactgggaccacccctagaagcgcctatgcttgacgtggctatagtagtgtattaatactaatatcttagggattaaggtagatcaagttaaaagaacaagctagaacatctgagtacaggtcgtccatgtgccatgttattctctgaacacgacagaaacaaaatattctaaccaacttcaatttaatttctgacatcaaaacagcacacatgcacattgatttgttcaacatggaaataaggatcattaaacaaataacgccggcggtgtctgttccttgcaggccattacgttgctttacgtagtattactggtaaaccagggaagaactttctccatgatacgccatcagaaaatgttattttcatcgctcgtaattgtcaccccagaatctctctgttcagaccacgagcctcattttattttatgcttatacttattaaacaatttaattttttaactttaaatttgaagctgattttaaagtttttcattaaagtttatttttcaatcatctttgtttttgtttttggattgttaggaacacatacataaaagttttatttataaattattttttatttacaagtatgatgtttggcgatggggcagtcgcaggaatactcatctcatattctcatcattgacatgtataactacttttccatgtttgacacttcacaagtacaaagttatgtagtacagtacttcgtactactcgtactatttttgtcgtctgtcaatgtgttttgatactgcagtaacttttgcaaccatggatattggatttagtattttactccattgttcaatgaatgacaacgttttattgagcatactgacttcaaccattgttttttttttccgaaagctaatatgagtcctccacgctgttatgaaagagaatccaacaacatgactattgtaccaacaaaacataactctagaccaatataaaaaagtactatcggttaaagttgtgatatgagagttaaacgttgttattagcactaaattgttagtataaaggtggcgtttgtttctactaagggcatgtacaacgatttttattagtggtctctctctattaccatgcaagtaaatttggtgacatgtaggaaagagaaaggagtatggttgttatgcatgacaacgactcagagtcgactcttagcatttactaaagcaaattttgttgcatggtggtgaaagaaagaaaataaaagtaagaaaaagtattttgatacattaatgattagagaccatattgtctctaactgttgtaggatgctagtctctaaataacgtagagctcatatccgactctaaataacgtagagctcatatccgactctacctttgtacatgccctaaagataaagatggagttatctttaaaaaaaacgagaaatccattagcacataatcagtagtgttttaattattataaacttggaaacatatttatctgatattttatagcaacatttatatggaaagttttcacgcgaaatacatggtttaatagtttaaaaacgtgctaatgaaatcgaggtaaaatctatattttactcgaaaaagaacgggacctgagtacacttttagagaaatattaagctcatatgcggcgcagtaaattactactggcatgtttggtagagttctaacttttaaatttagctctgaagttgtggagttgtctaaacccagctctacctctttagtttattttgtgtgagaactctatccagctcgttttctttttaggtagagttgaaactaaagctgaaactgttttgctgatctagaccgtgccaaacataacctgcattgcgtgcgaggcgagagatttgagatattatgcgctcgtgttgtggtatgttgatagatgtagtgatgagagttgtgacagttgagagcgagacgaagaaacgcgtgagggaattaatgcatgtgccagaatctacacgttcacacttcaacaacactatcgagcttgtcgccgaaccttgcacgttaagatcgacacggaattgacaggtacggaataatgataatagtgtcctactactgctattttcctgctgattctgtgcagcaaccaccagcaactattgctatataccacatgaggcgagaaaaaaaaagatactatgccataccttgcaagcaaaagcaagcacttgcagcagcaaggagctgcgaccatggctccatccaagcagaagccatactgctcactaggctatcagaagaacatttatccaacgaggtgttggaagtatacagcaaaagaacttatatttacagagagaaaactagtgtgatacagggtgtataaatatgtacgggatgtatgcacatacatacattcatattaacagtccatgcccctacaaaactcgcttcgtcatgtcctgatcttccaagctccccataaatatccaatggtataggatgtaattatgggcggaaaaacagtgttcacctgaatatcttgttgcctgatactgtgatctgcaagctcaaaccttgaaaagcccacgagtaatcgggctggtaggttgatgctgtagccatcccaggattcctgaccatggtccaggatgatctggtccaacagctagataaaacattctgaatgactcttcaccagcatgagctctcacgatctcagatccctaaatcaaaggggagaaggcttatctctgatgcttgcctagttcccaaaggatctctgtgtggattgttctttcttgagtctccagagttcggtcgcttgtgcttcgattgcatcgagatcaaggctctcgaagaaatcatcgtcgtcccaaacgaagttattgttgactccagtagtaatgtgtgaggaaggttgtggtgccggtgccggtgccagttccggttcaaggtttataacagggatggaggcagcttgttggaaacttagcttcctctttctgcagtctaatgtggtggatgactcacaatgggctagacttgtttcaccttgttcctttattgagctggccctagccacaaagctttgttggtcccctagaggactagggccaatggtgtggtgtggttgatggatcccttgtggagtctccatagaattgtgcaagttctctgaagaacagctcgcacttgcgcttccgcttcttgaagcagaattgtcagggacatcttggtaccttgagggcagcactattggggtctgagtaagcagcgaccgcctgcaaaaaacatcagatggaaattgagtttcaaagtttctttcagcaaatttaatcaaaagtacagaaacatgacacaggccacagcgatgctcatctatacaaaaatcttggctactgttgaactgaaaaaggataatgctcactccacatttatctggttccgagtttccaacatggctgatgtacaaacttcttacagataagatagctagtttgtgtcataatagccactttgtcattaggtattcaatgtacaaaaatttaaataaatttatatacttgattacaacttcagaacttctaggcgaacatagaaatgctgctagttttttgcattatatactgagtagcttattcaaattaatctaatcgcagatgcgcccaaagcccaactggcaattgtacagctccactacaaccaatcggttgtaaagcaatatactgtaatttgggactgtactgatgacttcacagatatcgaacatgaaaagttgaaattgcaaccgcacaagggacatgtccaacagcacttttttggggggcagaaagaatgacacaagcaggattgttcaaaacaaacacatgggtagaaattaaaaagtgttgtttgatcaagtaataatacctgtagaaggccatcatgtcaccactgttttcaccatgatgtacgctttgggtaaattggcccgtaggagtagcctggtcattaataaaactgtcttcataattatcttcactatgatcattaccctcatccgctgaaacatcagcatcttcagacaccctagtgcatgtaagacatttataaattaatctaaacaatgattcatattggtaagctctactaatagttacaggaccagctttagtttgtttgctaaatattatataaaagattttagaaatcatactcagcttcatcatcaataaaggtatccagacacatcttggccctccttttgtttcctagatttggaatcaaaaggaatctatcaaatatatgcacaaaaaaaagagagatttgaaagttgtgattatagtataaggttaagaagcctaaatagaaacttgcaaaattaaagagaattacacgaaagaggctcaactcactaatagtgtgtaaggtttaacatacttttggtagcaaaattgtggtttcctccagcagcaatatcatatctgtcatctaaagacatggaggaaactcttttgatcttgtcagcatatttgcaaagtcttttgtacttgggtgcttcccggactgaccctggtgtgtcccctcctgacctaagctgccaatcatcagagaaactatcacatagtagatttgccattggagtatgagcagctggactatgtattttcacatttgatggatgcatccgctcttctttgtttgcttgagtctgatctagggcattctctcctggtgagacagcaagtttggatatctcagaaaaaaattgccctttcccctcaaagttcagaggtccatttctagatttcaactcattggcctttgctccctcactgtgtgattttgaaaaatcaaccttttgctgcacaaaatcagcatttgcagcactgtctgtctctaaatgtttgtggccaacttcaagcatcggagactcaggaacaattccttcttcaatataatatgttagtcttggactaagctccatatcttcttgacctgacagacctggctcactggtttagaattgcagggtttgtggcatatttcttttggacttaccaatgttttaggaggtggagttccatgtacatgtctgtcatcagtgcggccatatctttcagtgtattcaggtgaatggggaactaaaccaaactcatctgtaaggataggtttacttgaataagcaaaacctgcaaggcaatggaattcaatcgttggtctactgatgtcagcagccaatttgacggacgtggtcttgttctggaccttttggtgccaatttacattcctggcatccttatggaattcagatgtcctcggtagagcaggtacaaaggtgattgagacataaccgctaacatccatggctactaatctccactgaagaaagagtggacaggatatttcttaatcggtaaacttggtacgagaacatttttactccatgcagcttcaccggataaaacttccaaaccacaatattcctggggaattacctctttcgatccatcagcaccgaataggcctataaatggttcacaggtttagaatgtcatatatcaatcagaaaagagcaagcttaaaactctgcatgcacaataataagctgagtgaataaaaaaaatcctttttttttttgccgggaactgacagaatgccatcgacggtggaagaagaaccaaccacccaaggaaaaactacccccaacctctataggaggctactcggcattagttttaaacagccctgcttcctttcaaaattgtaatttcttctttgatcttctcaaataaaaaaaatgattttattaaagaaaccgtaggcccaaagaaactatatatggaaccagtaaaccatttttagaatctgataacattgcaaaattaatatcatgaactgagtaaactaaaatgggaaggatatgacaagcactgaccttcgggtgcctcatccattacaactggtacatcagcaggtccttccaaagggcttgcacactgaaaaggtgttcagaaaattttaggacttctgttttcatttctaaatgactacagagaagtcacacagatcttcaatgaatctacctttgtcctagagaaagaaagatcttgaagttgttgcatagcatcaattagcatgttcgttgttcggaacgaatgtggcactctgtagatatcacatggtgaaacctggaagctaggaaatgtaacaagagatggcttccagaaatcttctttgcatgcaccaaagtaccgagcaatcaatcgaccatcatcctctgacatcttattaaagattggagatgcgacattcacatcaactttgcttttctttgagcaaggaatatacttctctatggataattcaacaaacttaacttctggattataaacatgtggaacctatagggtgcatcatgaatttacgcaattagctcctccagatttaagaagcaactttatgaacacgatgataaaaagaattaccatcctaggactatcatggtattcaaatctgcgacgatcacgcaataacttcttcatagttttagtatttccttgcttacttaagtaccctttcatctcctgtccgctacaagccaaaaccagtttgggaagttaaggtaaccaatgcctgagagagaaatacatttaaaaaatgcaatttttgcggcactttggcaattttcaattttcaccaaccaaaaaaaggatatcaactctcccttcgttcttccttccagtccttcccatacgttgaatcatccttaatgcggagatgttggcatcaaaacaaaccacaagatcaacctccataatatctagtccttcctcaccaattgatgttgccactaaaatattgtattccccagaccggaatttctgtaaacaatttacagtcagatagaagaaaaaaatgcaaatcatggatgagcagagtatatagttcaatacatgcaaaatagcttgttgcattttctgtgtctggcccttcagttgatcacctaaaggcaaaaaacttgaaataaataaacacatcatatgattcatatgtttaaatgcataaatgctccattcatagaatattactaccactaaactacttggataaaggaaaatgtaggagaccactatgtttatttcgtatggtcattaccatccaaaatgctacaaactcctggagaatgaaaatcagaccagaacacatattctaattgaagaacttagcatattgaaataaaaagtaaagaactatagatcatatgtttcaaaatcatacttctatgaaatcagtgatctacaattaaatctcagctgatcaccgataacacattatcatacctgtagaactttgaccaatgaatgcagcaggcctcacaagttcaccatcaatatttcttagggagcacaatatttctctgtgtttcacagtataacaaaacattcaagccatataatagattggttctgacagacaattaagcaaagcacgaatgtacattgtttctgatgcacagctaaaataacaaacagattgtttgctggagcaaggagatatacacaatagcacagaaaattcaacaaaattatagggcatcctgagtcttaaaaacaacacagagaaactaagacatgaatgctagctatagttgatagggaactgtttaaaagatgcaagacccactaactgacttaaaaccaacccctacaaatgaaagtaaaatatgcatatccagtgcatagtgacatgttcagcactagtatgccttaattcgccgtttataaattatagctggttgtcaagaaaagtaaagaaattggatcagaagatttaagatgttgacaaaaagatgtaaagcttagttttcccaagctgacttgcctccaactatccatttggtgtccatgtttaatatgagctattgctgttatcaaacacaacttccttctgtcctgacattgtaggtttccatgtattaattcagtactccctctgattccatttataaattattttatacttgtgcacaagggtttagaatatcacactggaaatgtgaatcgtgtattcatgagtggtatcatttatgtataaacattatgaaagtaactattggagtattggtcaatgctggcatgaataaaatgaacatgtatggtaatctgactagcatactactagcattctctacatattgctctttgacaatttcatctagtactcattctgttaaaattggtacaggataatcagtggttccatagatcaagttaaaccccatgacatacattgcattgaaccntgaaagaccaatgacctgtcagtccaatttcactaagaacgcgtcaataccattctcatgataccttcagtaaaagttgtttaagagaattgctaatagattaacccctgtgaaacacatggtgccaaatggcttctgccttcaacatatttatcatcggataagctagtaagctacccacatgcaaacaataacaatgataataaactaataacaatacaaaaccaaaaagaacagccagaaaaattatgcatgcatcaaattttcagtgtaaaataagaatttgcaaattgatataatagagaaaaagactactgcatagtttcttacttgacgcattctcggtaatgtgcaaagataatgacccttgagtcctttggatttttgcctgtgtcaacataacagtatcaaagttgtcataaataaacttgaaacttcacaatgtttgccctggttttgttcatgcaaggaaatgaattccggaatgatattgaagtcaatcaataaaagtttcttcctatagggtgtgtgtatcttgtgatgcaatcatgtgaatgaaaaaaaataacatgtaacatccgatcagtgtgctctatagagaaataat

SEQ ID NO: 62011 - DNA, 1414 bp, Oryza sativa
gagcgggaggggaagaggccgacacagggagagagcgccccgacgccgggggagatgggccgagagaaattcggcccatcgaccccgggggaggtaaaatagacttttgcggagggatttgatttggaaggatttggattcggaattgaactcgacgatagatcggggatttgagatcttgagatggcacggacactagacaacaagcaaagaaacaaatttcgcaattagggtttttaagagataattttcccgctaggtgccacgacggaacgggcgctacacccatgttcctgagctaggacctaatgcatttcacccatcaaatcccaactgactgacgaataaatctcaatagttttactaaaaccctagactgactcgttttgacaaatctcacttaaacgagcgaccaagatttttccccttgaaccacaagaacagatcccaattttcccgtaacaaatccaattgcaaagaacatatgcaatgaaaaggattcagagggctcttaggtttttccatttggcttgtcctacggtcaaggtcggctctgataccaacttgtcaggcccagaaattcccgaatagaattccaagcagaatgtgcattaaaatccccgtccaggaccggccgggtacacaaacgacaatgttgacattcagatccacgtcacagggcccgccccgctcctaaactatccaaaatcaaaagattacactagggtgagactaatcacggtgaatctggttgaccgcccataaccgcgggcacggctattcgaatagttttactctgatcagaggtgtacaactgtacccacaagacacagccccacgacacgttaccgtgcaccgacatgtcaccacgacataccggaaagaggccgtgacaggacccttcgcataaccccctctaaccaagcataccacacctcaggtttcacccccactcctcgcaaggcagcgggcagtcccctctcgtgcctaggtgaatccggaagcgacagaggccgtcacagggcccgccccgctccatcacgcccacccttgcctggatgagttgactagaggaaagctacactacaagcccagccgttgcccacgctggcttgtggtaagtatgataagttcttccagggcatcctgcgaaccggtccttaactgccatgggtgcgaccagcaaaaccatgcacccacagcccaccatgtgatttattttaattaaccaacaccaaagcggtggcactaatccaacaagaccattagaaccaacagtctaaacattaaaaggattctccccattgtgcactagttgaactaagcatggctaagcaatccctagtccaatctctagtcatgttataaccccaagctgacaaagaaacatggtacaacaatagggctgcaggaa

SEQ ID NO: 62012 - DNA, 1270 bp, Oryza sativa
aatcgaaatcggaatcggaaaccccggatacgaaaacggaatcgaatattatcgaaatcgaaagcggagcgaaaacgaaccggcgcgaatacggtaacgaaaatttatcggaataaaaaacccctcaaactaataaatctaattaaataaattatctatgtttaaaagagtaatgttgttgataaatcccaatgtagcacaaaaaatattcttatgtaattttagatttgcataacaaatatttttttaaaaaataacagccaaacaccatggtattcactatttagtgcttaaaaaaggaattaagggtatttcagtcacaaaatttatggtaattccgaggaaatttccagaaattccgagaaaatttccggaaagttttcgaccgattccgagttccgatggaaactgcccttatcatttccgattccgtttccgagaaaatatttccaaattcgtttccgtttccgaaaaattccgaaaaaattccgaccgacatattccgttttcgaaaataggtccgaaatccggaaagtttccgtaccgttttcacccctagatgtatgtatgcgtttacaagggtgagtgtgcttacatgtttaagagcatctacgaatttgtacaatgttttaaaaaaatatttaaattctcaaccatttccattgagcagaaaattcccactgaaattctagctgggaaatcctactcctaataaatcctagtaggccaacaccaagtcaacagtcaactctgctacctcggatctgagtgagtgaagaggtgagcagcagtagtatagcaatagcaagcggattaattatattaagaggacgtgcaaattaattaactaattaattaaacacccaactaatctccactaataaaaccgtattactcccggccactgacaccgcagcgcagcataagaagaagccactcgccgccgcgctctctcgtcttcctcctcactctctccagcttccctctcctcgagctcgagatctcttcctcctcctcgatcgcgtccatccatggcggcggccaagaaggagaaggaggaggaggaggaggcgtctaagctccagctgaagccggcggggagcaaggtgttctccaagctgctgtccagggagagcgccgccgcggcgccgtcgttcagggtgtactacggcgtcgcctccgcgggctccgtgcccttcctgtgggagtcgcagccgggcacgcccaagaacgccatgtccgacgccatgctgccgccgatcacgccgcc

SEQ ID NO: 62013 - DNA, 3608 bp, Oryza sativa
tattaaaaaacggaggaagtatttgtttttttttgcacggagagagtatttcaaagagtccaagggatgcaaatgattttgtaccgtagcagtacaatctctgcttcaaggtcttgaataaacaagcggtaccacgctgtatcgcaattgaatgctactcatctgcattgcatccacgtacgtggagatgagcaaaaaataaataaataaatatagtaaaccgctccatccatggatggcaccacccacaacaagctagcccattaatttcccctgtttttctgtttggtccacaagtagatagggcacactcttgatctggacattcggtagtactaccgtttaattgcctgaattgaattttgcttaattgcctgaattcaattttgcaaatggttggatgtagtagctgtgttattgggcttcttttactctagctatgagcagtagtgtacatctctatgcaaggcattattttatatttcctgaaaaagatttatgcatattacataagtagtatctggacctatatatacatattgcagaggtccctgcaaggagtaattaatcaaggctgttttactcctatcacaattattaaagaatcatcatgaagtgcaagtctgcaggaactaaaaaaaaaggagaaaataaattgatatgtcctcaagatgatcatgtaatggcagtggcaggtatgaccattgaccaactgccttgatagttgataatgatcacacatacacagagggcacaaggagtaaatcataagataatgatctcaccactttctaatctttctaggaaccatgcattaaaaagagccaagcagaagtggggtttaggcattctgtacatgaacattgcacatgtgggttgatccattccatgcattttgattgatgaatcgtgttaattaaccccacaagacaaggcaattaagatcagtgtgtgagccatgaaggtcttaacaaaacacggcttttgtttggttttggggtagctggagtgctggacctctcaccaaacggcctgcacgctttcaatgtctcagggtcagggcgctcttggacagtagagaagaagaggctgtcagtttcagagttaattaattgcaaaattaagtactctacgttgtttgcctaaatctttgatgtatttggcattagctagattgttaattgtcgttttcattctgaaagggttggcaagtgacagcaaatgttgatcaactgaatatgtacttgtagtagctcggcttatacatatcaaaaagaaaaatggaaatcagaaaggaccaagatcctggacatgcattgggttcttgtctagctgctgcttcctacctacgcaagatttgcgtactgttgtgttgtggagtttggacaaaccatgcaaatattattctaacgctgaaactctgcaagtgtgccttgatatgtttgtaattctttaatttctagtggtaggatttggacgaagaagatggcgtagaatcaggagctatacatctactgtagaatctttggtttgagtgattcgtgactatcgatgcaagctaaggtaggtcgtccatctatggtgcgttcatctatatactcctatagtgtagtggtagcagatttccttagcctgcggataactgaatattaattgtgttcgttcagaaattggagagttccttcaggcttcaactgacctaggtaggattcatgcatcgagacgatcaccaaaccgatcgaccaatgatctctgtcaattgcccatccaaacaatgaacggacaacaagttaatttactgtaccttgcatttgcactgcacgtctgcacctagctgaagtctgaattctttcagatatactagctgggttgttctttgcacgatcagtcgggtagcacataagatagctggggttcactcaatggctctcattgcatgcacgccacggcagagcaactgctggctacgagctatcactatcatatgttgtcagtatcccgattcgtattctagtatcttacgatactacgatgttaccaagctgaaacgataccgatcccatctagcatcctaattttcatagtatctcgatcctactattcattactacacgatcctacgaaatcttaggtggtatcccgattctacgatccctacgatactacaaaatactacctacaaaatacgatccctacgatccctacaaagtattatttaaaataacatggtttgaatataatgtaactaaatatgctcaaatttatatgaaaatcagttaaatatatcaaaactaacgtgatttctcttgataaatgtctctatttgcatgacatatatcattactatatttttttatatagaatggctatatataatcaatataaatattaattaaacttaaaaaaaagaaaatctcatagtatcccgatcctacgatacgatattactttgagcaaaacgatactagctaatatcccaatcctaacaaacttacatcataccatcagtgcaagtgttctgaacttctcggcgagttcttgcggccattgccatgaaatgaattcgcagctagctgctatcgcattgggaagagggagcaagatagcagttgcagtttgggcggttgattggttaccttacctatgcatcaccaattcgccatggtcggcaattgggacttgggcggttcatcgatcaatactgctcgaccaccggccggctgctcccgtcacttcaaaatcccttatattagctagctctgctgctagtatttcttttgtcttgaaaaaaaacttttaaagatgatctgaacatatgcatacctttcatattatcatcagaacttgacttttttggacaaatgcaagttcagatttattcccagaagttatactccttgttgctactgctgtcacctcgtgtttctctcgtcttgtcatggcaacaaccaacgctaagtgcaggtgcagcaagcaggaatgggggagactggtttgccggttggtgtcgccgtgtctgcggtgatcggtgaggcgcagtaattggatactaccaaacttgatgggccgagcccgtgtcagcctgtcaggtcttggcctttttacaggcccgcttgcttgcgtgccctgacattcctttcggcccatcaaggcttacatttatagtattaaatagctcaattgtgccattcatgcaaagagtcgatatgtccgagtggttaaggagacagacttgaaatctgttgggcttcgcccgcgcaggttcgaaccctgctgtcgacgcatttttttccccttcccgtagtagggtcttgtgctgttgtccatatttatcccactttattatcttttttttcctttaactagacatgaattccagtcttcgtgtcatttatccttttgttaatattttttccctttaactacacagtaattctactcttgtgccatttatccatgcaatttattttgcttggactatatctccttgtattcttttttttttctatttcacttgcgatagatgtttagagtcttatttttagattttcttttcattcatagaatcttgcatcaaagattcgtgtacgcatagatctaacttgcaa

SEQ ID NO: 62014 - DNA, 11750 bp, Oryza sativa
agaaacatggtacaacaatagcatggctatgacaacaggtaaacaccccatagaaacattataaaacaatgcaatatttgaaagaaaacaatagagcatttgcaatataggatcaacatgttcaagtgacaagcatgacttgccttgctctgctgctggaggaacctcggcgactatttcgaaatacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggagctcggatgaattagttatgagttttagaagattcactgtgtttattactataaaagaaaaaccttaaatcatttattgtgcaataaatcccagggctgacgtcagcacggaggggggggcggcgccgacatgcggggcccaccggtcagcggctcgggagagggaggaaggggcgccggcacgcggggcccaccggtcagcggctcagggggggaggaaggggcggcggcgacccggctcggcttggctcaaggccgaccgaccggccgcggcgacggcgacggcacgcgcacacgcgaacgcgttaccggcgacggcaaccggcggacaggctttggggtgccctaaggaaggaagagagagagattagagagagggagatgaaccacggcgaccggtattcatggccgaaagcggcgatagcggttgaactcaccggagcgcgaggggatgcgaattccggcgacgaaactcgacggggaaggggcggccggggtagagcttagcctcgcgaacccgacggcggggacggcgcggtgcggcggcaaccctagcggcggctagcggcggctggagtagtggaaacggcggcggtgggtggttgcacggcgcgggagcgatggggagctcgggagagttcggcgaaatggggaaaaagcgagagggggcgacggggaagcctaaataggggaggagagccccggacgtggccggtaggggcgggatttcgccggccaacgtggggagtgggggaggagagagaggcgggattcgaaaatcgaatcccggccatctcgggcgcgggcgcgggcgggagagagaggggagtgggcgccggagatgcggcgcacgcgcggacgtggctgacgtggcccaaaaaaagcggaagcgtgggcgcggcggcggttgctggcgcgacagcgccagctggaggaaagggactggtccgacaggtggggcccacctgtcggcgtcccggggagagagggaggggcggcttggctgggcctcggcctgcggccggcccagcagggaggagggagagaaaaggagagaatgggccagtggcccattcgaaaaagggagggaaaaagaaaaagaaaaaggggaaaaggatttcctggaattaaaatattgcttgctcaattttaattggttaaaattatttctagggctctgaaaattccactaaaaatcctgttagtgaagttcgacatgtagaactcaagaaaaattccacatgccaattccgattattatttgcattgatttaaaagggtttactcttgctttgcactggtattttcttagggtcgcttataaattaaatttttggcttgggaggagaacttcggggtgtgacaaacctaccccccttaaacggaatctcggccccgagattcggaggagctggcgaagaggtgcggatgggcggctttcaactcatcctccctttcccaggttgcttcctcttctgaatgatgactccactgaactcggcaaaacctggtgaccttgtttctggttcctctttcgctggtatcaagtatacgaaccggcttctccacataggttaggtcctcctggatatcaatgtgttccgaatcagcttgttcttcaggtacccttaagcacttctttaattgggacacgtggaacacgtcatggatgccgatcatattggatggaagttctaactgataagcaacttctccccttcgttccaagattttgtagggtcccacgaagcgtggtgccaacttgcctttcgtctgaaaacggtgtactccccagagcggagtgacacgaagatacacgtaatctcctgcctcaaaagtgagctcccttcggcggttatccgcgtagctcttctgtcgagactgggcaatcctcaacctttccctgatgattctgactttctcttccgcttctgttaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagtttttgtcccaagctccaccaaaatcaagagcgcaagctctcaacatatcttccaggatttgattgactcgctcggtctgaccatcagtttgcgggtgataggccgtgctaaaatttaaacgggtccccaattcttcctgcagcttctgccagaattttgaggtgaactgactccctcgatcagatacaatctttttgggtactccatgtagacatatgattctcgagaggtaaagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtagacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcatggaaatcccgggcttttccgactctcatgttctttttcagctctgctatttcagaatcatttacttgagctgctctgacttgatccacgagcgtaggccgtgcctccagagcagctacgaacctgtgttcaacaattcccacgttgagatgctcaaactcctaccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagtcggataattcccttcgtgtggacgcaactgccgcgaggcatacgcaaccactctgccctcttgcattaggacacacccaagtccgtggcgggatgcatcgcaatagacttggaagtctttcatctggtcgggcagaatcaaaactggtgcggatactaacttctttttgagctcctcaaaactcttatcgcactcagctgtccatttaaacttctcatctttcttaagcaaccgagtcatgggtcgggcgatcctggagaagttttcgatgaatcggcggtaatatcccgcaagtccaagaaaacttcgaatctgtgacacggtcttcggtggggtccatttggtaactgactctacgttcgatgggtcaactgccacaccctgagctgtaatgacatgtcctagaaatttgacttccgtcaaccagaagtcacacttgctgaacttggcgtatagctggtgctccttcaacttctcgagtaccagacggagatgttgctcatgttcttcttcggtctttgaatagataagaatgtcgtcgatgaataccacaacaaacttgtccagaaattccatgaacactttattcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcggtaatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtatggtctcttgtaaattggagcgattcccggtgccaagtcaatccggaattcaatctctctcttgggtggcatggtagtaaggtcttcggggaacacttctggatactcgcagactatgggtatatcttccaatttcctcaacttcttctccacggtgtccactgggatttccgcctcaatctgattcaaagagaccccttgctttggtgagtctggtgatttgtacactactgtttctcccttctcgttggtcaaggtgactgtgcgattcgcacaatcgatgactcccttaaacttggtcagccaatccatcccaagaatgacatctaggtctttggattcgagaagaataaggttggctagaaatggtgatctttgaatttctattgttatagaagggctgaattgaaccgaagtggagctattccctggggtatgaacccgcatcagtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgtgccctgaactgagcggccttcctcttcctgtccatcttgttgcgttgatcctcctgacggattgccttgtcaaccagcctctcaaagtcgacgtagtccccagatattagttggttggtcagctcgtcatccagacctgccatgaacttttcctgcttctcggcgtcggtgcggacatcctctggtgcatatcgcgtgaggcgattgaactcatggagatactccgtcacagtcctgttgccctgatggagtgcccgaaattccctcttcttttgtgccacgaccccgtctggcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagctttttctctatggcatggagccagtcattcgcctccatagggttggtggtgttggagaaggtgggtggcctgacacgtagaaactctggcaacttggactgagggggagggggaccaaactgctgatgctgctgttcggcgtgctgcagcatccgctggtgcatctgctggtgctgctgctgcatctgctgcatcatggatgccatcatctgagtctgatgtgccatcacttggggtagcgtcggattctcgggaagtggtggcggaccattgccggaatcgctgtggggatgcaccccattagtgcgctcttcgccgttgctgccctcgcctgttgcgcggctaccattcttggtgtaaaccatctggagggaaaatcagacgggggaaaagaaggaaaacagatgctcaggaactaagctttattatataggaatttaaactgcaattgttcggatctgaattaaaacacttaaaaagcaagcaaaaatccttattaagacagccatatcataggcgcatgatatcgaccgtcgactgaccccaagcaagcaacctaaacacacaaactaacaagcagaaactagacagtcgataaactaatggaaagcgagcctaatgctcggaacggctcctgcggtcggtggagtcgaaggcgtcctcctgctcgtcaccaggtccctctgagcgactcctggagcctggcagataagtctcgccgccgcccggctctgagccactggagctactgctgctgagatcgcggctgccactgggagtagcagacaaccaacctccgttgccactggctggacccctggcggctgatgctggagcgaaggagagagcggacgcgggagctgacacgtgaacgggagctggagctggtactggagctgcaggaactaccggagctgcgggcggaactggaggtgctgcgggagctgctgatggaggtgggttcctgggcgcaagctggatgcgcacgggtgcagtcgtcgtcttgcggggcgtagtgcggatccggactcctcctggcgcgggaagaccctttaactgagcattctccttcttcaggcgcgctatctcgtccttcagagcgacgatcctcatgagcttcccatcattcaaggccttggacgccttgtgcaggtccgagtgcatcctatccaatcccctcatcatagcacacatgtgaccaaaggtggtgtcgttctcgccggctgtcgaacggaaagtactgacatcatcaccgctggctcgacaagggtgaaatcggtacgccgtgtcgtggaagataaagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagcttgccactgagtggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatcaatgcatgctcaaatccaaatttaaataaagcaataaaagactcaaataagagaatcgaataagagcgaaattttatgcatagatcattttgcatgagagcgaataaataagacagactcacataacgataaaataatggggaaattagatacatactaataataacactaagagcataaataccttgcaacccattgtcacgccccgaactagtaccgaccggaactagcccgtgacgctccaaattaacctgttaatcgataccagtcccaggaaacagtgctggtatcacaggaagacagattatcacagcaatagaggtctctttattatagagtagaggtacagtcatgttgggctgcggacaggccccgagctcacaactgcattacaaaaggaaagcggaagccaggactaggaccaaacaacacaggcgcgacttgggaactaggccgaaaccctaaaactcatcgtagccggcttgctcctagaagaactcctcatcagcaggatccgcttcatcttcttcagcaactggggggggggattatttatatagagcaagggtgagtacgggagtactcagcaagccaggggaaataagtgtttaatgcaggcttcaaggagaggctgttgtttttgcaattgattttatttgaactcttttctaaaaacaactaagtgagtgcttctcaaacgacacggatgagacagtgcgtctcgtccggtcagagtatgtgtaatgtatcagtctttagaattgaaacaaggttggcacccggccaacagcttttcaaacggccacccgggccaacaactttcaaacggccacccaggcctagctgattctatcagctacagatttttcaaacatcgaacccctttccacaacagcaatttcacaagcagtagttaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgtcataggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcaggttttccaagtcttttgtaaaacccaagttttacccaagttgttactcaaaattttaagtttgaaggcgtccgtcgatactcgtgcagggtgcacgaatatcgagacgcaactagatggttacaagggggacatggtatcacaattaacaaaggaaggatcaaatgcaacaaattgggtaggtccgccaatctgccttgcagatgggacaagcagcttaagtgcagtcctatcaatgcataatatttttcaagcaacataattaaatttcaaatataggctcaagatgttcaaaggtggcttgccttgctcgagatctggagcttgatcctcgaaatcagcgcactgcgggtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgagtttctaagattattggatttttggtctaaaggaaaaggatttaattaaatcctttttgaaaaagaaaagaaaagaaaaggaaagagggagggaaaatagacttccctcgggcggctagggcgcggcctgagagaaagggtggctcggccgagcttaacgagccggccggcccaagaaggcggcccagagcggcccaagacgcgcgcgcgcgggagggaggagagagagagcctgtggaccgggctcaccacgcgcggtcccgggtgggacccgcttgtcagcggctcggctcaccgtgcggagggagcacgcggcacggcactagggtgggggagggacgcggtgcacgcgcgcggttcgcggtggacgcggatgcggcgggcccacgcgcagcctcacggctcgcggtggaatgcgcacacggggagggactgactggggtcggctcgacctggtcttggctgagctggcgccgatgtggcgcctacgtggctgccacgcgggccggcgggaggtagacgacgacgccggccggaacggacggcggacgacagcggcgagcggcggagcgaaccacggcgatacaggcaaaagcgagcacactgggtagttgcacgagacgaggggagacgagccaacggctcggattcgccggagggagtccgtcggcggcggattgcggcggcggattacggcggcggcaaccggcggagagaaaaggggaaaacggcgacgaggtcacgaggggccaattcccggcggagagagcatctacgcggctacgggaatccgttgctagcgtcggattgggcggagctacgccgagcgaggccggcgacgagcgggtgctacggagctcgggcggcgacggcggcgagcacacggcgagcgacggcaatggtcggggcggcgccggctagctacggggaggctactcgcgctaccaccgaaaactaagggggggaggtggagcgaggaggaagaacggagggaggcactaccgtgcgggcggggcgcagtgacgagaggccgacggcgcgggagtaatctctccggcctcgggccgaggaagaggaagaagagggtgcgcccggagtcctcttccgcgtccttgctcgtgccggctcctccgacatgcgcaacgacgaacggcgacggcgaacagagcacgggggcggcgacaatggcgtggaggcgaatgggagaggaagggaagggggaggcttgggtttatgggatggcaatgtcggtttgagaaccgacttagggtggtcaagacgcgagctagcgctccggctagcggccaaaacggcgacagaggtgacgccggcgagagggaaaaaggggaaaagagggagagaaaaggggagctcgccccttgcctctctgggaaaaggaggaggggagcgggggcgtcgcggcagtgggaggaggggctctgcctccgtcccttggcggcttgcgcgcggagaggcggggccgaggcgatgacgacggggatgacggcggggcggtttggagcggagcggcgacacgggcgacaggcgcgggcaggcgctgacgacggcggcgaccaggcggtcggccaccacggcacgcgcgcgcggaatgcaacgggaggcgcggcggtttgagtggcgcggctcgagcacgcgcgctggctgcggggccgagcggctgcaggcgtggcagggcagcggggccgggcggcgcagacggcgcaggcgcgacgcgggcaacgaccacggggcgcgcgcgcgcgaacgacgcgcgggggccgacttcgcgggtgaggggctttgccagggatggaggcggggaaggggcgctcggcgcggcggctcacgcgcacgcgcgcgcggcgcgcgggcggagcggagggggaggggaagagggagagagagggagcgagcgccccgcccccgggggagatgggccgagagaaattcggcccatcgaccccgggggaggtaaaatagacttttgcggagggatttgatttggaaggatttggattcggaattgaactcgacgatagatcggggatttgagatcttgagatggcacggacactagacaacaagcaaagaaacaaatttcgcaattagggtttttaagagataattttcccgctaggtgccacgacggaacgggcgctacacccatgttcctgagctaggacctaatgcatttcacccatcaaatcccaactgactgacgaataaatctcaatagttttactaaaaccctagactgactcgttttgacaaatctcacttaaacg

SEQ ID NO: 62015 - DNA, 45146 bp, Oryza sativa
ggaactgacagagtgcccatttgcaagaatactagtgaaaaatattcaggtgtcactgtaatactccctccgtcccaaattataaggcctatattttttctttcttttacgcggtcttcaatgacatactttgaccattaatatattacatgtatgtttccaacaaatataaaattagcatcacatgaaagtactttaaaatatgaatctattgatataacatgcataatacttagcatatatatggttaatatggttattagtcaaaagttaccaagtttgattttccttaaaaagagggcgccctataatttgggacggagggagtactaaacagaaaagtttcaccaacaaaacacttctatactacaaaagagttactattcttacaaaaatacaaatccacggaatgatgcactaaactttattctgatagattgagctattagttgtcctacagaatgagtaggttgttgtatagcaagcagtatacattatagaattattgatcaactagacaaagaagatatatgtaccacattacgagaaagttacttacggaagtgatctagcaacacttctaccaatgtccgaacttttggactgagaatgccttgagataagaagttctccatagttttctttacttccaaaaatgtgttatttcttgtaagcaccttccatgatcttcattacacaaaagccatgataaatttgagcacgcatggaagactttcttgtaaaactcggtagagcatgcacagaatcaagaaaaaaaaaagggtgagatctctagtctagtgtatcaatcaattaatttatatgagatgtgggtgtgttcactgctcaagtgtagggatggctcaccggaggatgagattgcctctagcagatggtgcagtagttggtgagtagaaggtagcaagggtaaataaaagaatctagatgggatgggaacaggaactggaagaatgatattgttgagatgtacaaggctacaagcttcattcaggtacttatttacatataccattcaacctaccaaaaacagtactatcatcagaagtgtatatggaacagctcaaatacaacgaactgactaagctcctgaattctcactatattggtatattatatcgaagttctaaacagaatggactagggctgctactgctttgcaaaagtataatcagtaaaagtgtaaaggatattctttcatgctcaaggggatgatgctcagaagatccacagttaggagcctaattatgcactatgatgacatgcaagtgaaacattgtaatagaagtgtttgtagagtgtaggcaatacccttctttatatttggcttcgattgactgatgtgctgccttgataccatagctcaaaagcattttcataatgccataaagtaaggttagagcttgaaaagatataccaatttcctttttgtctgctaaaggaatatttggcgggggtgcttgatcaaatttgtcctttaacatgcgcaactggtgtggactccactggaaaaaataagcaattaataatgcacatgagtagcaaatcagaagtgcctgagcagcaaagcatcaggacagaagtagataaattcttcacctaaaatgaatgcatctagatgatcgatgtattaaagacagcatgaaacatacatttgaagcatccctgtgatcaatgaccctagcagaacgcaatttaacaagatgtggacgtataacatccaaaagcttatcattgacttgttcagcctcatcgccaactggtatctgcattgaaacaagtgacccttcagaagagagaaacagcatagacaacttacaaatttatcactgtccatgcacacctctaaaggttcaactgtgcgcctctgaatataacggctgacttcaggatcactttcatcacagtgaaccaactcagaaatgcgcaaattgttgataacattttgtatagctggttgctttgctgaataaaacaggattgaaaaattagcaagcatctccatttttcagcacttctatttaattttgaggagactaacatcctggtgtagcagtcagagctaaaatccttaacggcacacgagctgcctccaactgtcaacaaagcagaaaagtagaaaaataacaagcaggtgtcagaacgactcattcatttacaccctaccgatatcatcttcttcaaatgagcttgatatggaggaaacccatgaaagataaccaacaaaagagattgcttgggtatcaaatatacctcacggactacaacacagtaagcataatttcgcgaggctcgatgagcttcatctatcaccaagcaaacgagttgattcaccatgcatatccctgccaaaagccaaattaacaatgtcaactcagagaaatggtagcattaaagatagtgggaacaagaagaaactactgtggtcggtccatttctgaagcgggcagtccaaacataaaattgaggtaataatacttaatgaaaggtggaagagaatggtgaagctagtgtcaaatgggagtaaattatatagctgagttgacacatgatttgcaggggcgatatgaactacaagtttggacatgacttcttgtcatgtgtgggcttttatatgcatctgttatgcacaaaatttctgccttcttttgtgctgactccatttcaatggaagctctagtgcaactgtgtttttactatgcgagaaaagaagtgatgctgtttcttccagaaataaatcaatatttggttgccacttgccattctaaactactcataaagcaacacatggaactttcaaagacaaagtacaattgtaaaatatccaataaaaatattaaaagcataggacaattggacaaacaagagaaataatcaccagattgtatatcattctgtagaacttgtggagtgacaaagaacactcttttagacttccaaaagcatgatcgctttgaggggcttagattccccttcaagtcaattgtccactcctgcaacaagtaaaaagcaatagttccaggtactggtagagaagaaaatttgatcttcaactgataccagataagcatgaacatctacagaaagaaattaatacctgtggtattcccactgtattatggcatgcctcaatttgctgagtaacaagaggacgtgtaggtgcagtaaatactattttccctttattttttcagatttacaagataagaagaccaactgtcagaaagggtttttcccaatttacaacagaagaggaaaaaagttccagcatggtacaaaaaattaccttcaggaaaccatctaaagtagttatacatcactactgctgcaataaaagttttgccaagccctgttggtaaagccactagtgtattggtaaataaagccttctctacaaattttttttggtactctcggacttgtacattagctgcaacacatgaacaaaagccacttaaattacacagctgacacattgataccttggttagagagctaagttattatgtgtaacctctaactatttacaaagcaaacatgattacagcagaagtgaactacaacaagaacagaaatgagcatttgagtggtgtttcagaagttattttttgtttcgcttatattggaatcgttacattattaatcactgaggaacagaatgtttgcacatctatgttggagagtggagacagggagtccaggagagttccctggggagttagaaggctatacaaaaaaaaaagattctgaggtccaaatgagcaatcaaaatacttagtacaccaatactgaaacatgcactaattaattgtgtctaaaccaggttattcttgcatgccaatgaaaatgctctagaaaactactgatgacggagtgattcttctcgaaatgcaggtagaaatggagaacactcacttggataaatccaagttcgcgctgcctcgtggtccagagcaacgccgcagggcttaggcacgacatcctcgtccgctctacgcgagcacccctcaccggcgcggtcactggggcgcccccagccgccactcggcgggaccggcgccgctgcgggcggcgaaccaggcacaggggggcccctggcgccactcggtaggatcggcgccgctgcgggcggcgaagcaggcacaggcggccccctctccatcgccgccatctgtctcctcctggtgaaggagtcgacgaatcggtcgagcgtcaactgccgcgtgccggccgccgccgagggctccggcggcggtgccgactccgacgcggcggaagaagacgcgagggcgcatcgcctgtcgatctcctgcacggccgcctcccagtcgaagtcctgcgggggggaggttagggtttcccggagcaaaggtgaaaacgcgagcggagggggggtgaccggaagaggagaaggaggcgcttacgtcgtcgtcgtcatcgatgatgatggcggggtgcagcggcggcggcggaggcggcgcggccattccgccgcgcgcgggagcttcgagaaggttgcgggttggggaattttgggagggggaggaggcggaggggatttgggcggggagacgaaaagttttcggaggcggtgcgcgcgtgcgatgctggtggtggtgatcgcgacgaaacgggcggcccgtgtgatttgggcctcaaagaacagtactgctagtaaaattacggcccatatgtatctgagaaatacggcccatataggataggatggaagaggattgtgggctacgtgacgcctaaataagaaaaagtacaccgaagatctctcaactttgtcgtcgggataaaaccgttctcgaaccacaaaaccggatatcacggatcccttaactatataaaaccggtcacaatttgttcctcgacaattttgatcctggttttgtcctacgtgactgctgagtcagcgtggaacccacgtagaccccaaatgtcaggatgccacgccaacacctttctctttcccctcttctctcccttctctctcacttctctacgctgcgcaggctagccgacgggaggggaggaggccggtggggcgcggtcccgcggcgccgcccgccgcgcgctccgcgaggtgggccgcgacggcgtcgtcgtcgtcgccggccgcgccgtctccacccagttcgccaccgctggtgcagacctttcctctggcgctgcggcgccggcgccggcggcgtcggcggcgggaggcgggtgtacgtgaggaggccggtggggcaaggcaccacatcattgcagccggcaagccaccgtccgacgccgaccaccgccacctcgccgccgccgtcggcccccaccacctccacgaatctcccggcgaacgggtggtactccacaagcgccttccccagcgcctccctcgccggctcgccaccgccgccgccgtttccgccgccggcctcgaacacgtgcagcgactgcaccaggtggcgccccgccacgcggtcgagcaccgacagcggcagcgtctccgccggcgtcggcgacgacggcgccaccagcgacctgctcgtcctcgtcaccgtgaatcccatatatactgtgataatctcgctagcttagctagcttagtttttgtatgtgaattgaatgtgtgtgtgtgtgtggagatgcaagagccagtgccatgtgtatatataggctagctagctcgagcttatcattagttaattaagctaagctatgctcgtcctcgccaatgtggttcctccattgaacaacgggatcaatgctgagcctgagaacctcgcttctgggtgttcaccatggtaacaaatcggtttgattgcccagtggcggcggtcctgcactcctgcctcgccccaccggtgaccgacctcctcacgtacacccgcctgcccgccgccgacgctgccgccgctgcggcgccagaggacgggtccgcgtcctcgccagcagtggcgaactggccggagacggcgcggccggcgacgacgacgatgccgtcgcggcccacctcgcggagcgcgcggcgggcggcgccgcgggaccgcgccccaccggcctcctcccctcccgtcggctagcctgcgcagcgtagagaagtgagagagagaagggagagaagaggagaaagagaaaggcgttgacgtggcatcctgacatgtgggacccacataaggtcccacgctgacttagcagccacgcaggataaaatcgggatcaaaaccaccgagggacctattgtaaccggttttctatagataagggacccacgatatccggttttgtggttcgatgacgttttttatcccgacgacaagttgagagaccttcggtgtacttttcccgcctaaatatgacgggctggaactgggagttcggctacgtgcggcccatacaggatggaatgggctcgtatgcaaagtgaggcccaagtgattcggtccggaaggcatcacgaagagaggtccatgtaatatgggctgaaatggtgctgtatccatgggaaacaatgtatcccgaggtcaaggtgcttcatggcttcatgtcccatgattttatcatgctcatattttaagtattgtagtataccgttactctaataaaaaataatattagttggttacatgcaacatatttaatgatgtgaatttactcttcgtttacataaataaacgaagatacatttattaaatgatgcccattttggaaaaacctcaataaccttaggccatgtttgacaaatgggatagagaaatgatttcccacccactaaaagacatctttaaatcctaaccattcattctccccctttcatttaatcctaacccttcattcatttcccaatcccaatcccacctctcatttcccattatccaaacacacccttagagaatgattaaaatgggatggaggaagtattttgatgttattgatcttgttaacctttactagaggatgatcaaattgggatctagggattgataataagcattcattcctagataaaaaaaactaacacttgtaatgcatgcaaacgagcacggatgcaggtcctctgcagtactgcatgtgcagtactactcactgacatgtgggcccgatgtgcagtactactcactgacatgtgggcccgagggcctgtggggcccacatgttagtgagcagtactgcacatgcagtactgcagaggatctcaattggacgagcacatatgcctctacaatctatatgtgtggtgggaccattctacattcgattggaccattcaacatatctacatagcagccatttactactccaactttatacactcttagggtatccacaatatagcattttagcaggtaataagcattaaatactcacttattacccggtagtaaccattgtaggactagtaagtagttgcagcccggtaacacggctacaatcgggtaacaggaattaaactatcttatttgcacggtgtttctgataaaatgcatggaaataagtcacggctagagattgccatcggtgattttttctgaagctggccctaccttgtttcctactgatatgctgatacattgtggagtgcatgattgcttactactacttgtagacctggcccatactactgacacactactaccaagttgggcaagtaacattgatgttgcccttaggatgggtcacatctcattttaggttgagttattttgggatggagggagtaagggtgtttagtggtagaagagtggttaaaaataatatatgaagaaatttaaattagagatgattgatgttaaagcagtatacattctaaaagaatgatagtactgaatgtgctccccaccatatcgataatttcttcatgtactttaatattacaaaataatcttgcacagttctatcttatttcatttctaaggctcccatttgtctcggatgaaggtgaagattttttttgcgcacataaaataaggcaagccattaacacatgattatttgagtattaattattgcaaacttaaaaatgggtttatttaatattttagagcaacttctatataggagtttttacacaaaacatatcgtttagcaatttaaaaaatgtgttaaccgaatccgatgtataatttgcatcttaataataaacaatcggggctttggcctacaataacgtattattctaaaatcagtaaaatcaaagtgtttgattgttattttgtaatgaacaattggcatatgatattatcggttttgatatttggagattattgacgaagtggatttagagatgattggaattttcaggtgatgaacaagaattactaacaaagtggttgcttatcagaccaacgtatgtgagcggtctgaccgaccgacgttgtgttggtttcagtttaggatcgattctttagatatccatggataattcatatttatgatttctagatagatactagtgtgtaatattgttatttgctattagtgagtcaagttggtgagaacttgcactcagatatggtttcttggttggtgcatgtgtaagtgatttgcctcagaagagcgttgccaatgatgaatcgggagtcaacttgggagaagatgacgtccagacgatcaagatataatgcaagatgcttaggctaacgattaatgcacgtggttagtgaagattccatatggcatatgatggagatattgtgtaacttttagttctgctaaaaatttcagttttttggtacttcaaccattcacctcttctggttaacttagttcttacagtccgatcctacaaaatcctcaaaactaatactccttctattctatatcaatcatcattcatcatataaccttggactcttcgtttgacatgtagcttatattgcatttaggcatgcatgtatgcagacattgataggtagttaagtcctcgttttctatgcatgtgggacttaaagtctgcgtgtttcttagttctcttccaccatatatgctcacattaaataaatactaggacttttaggcgcgcttcgcggcgccctaccgttcattaattaagagctatgtagcttatagatggtaatagggaaacatttcattaagagctatgtagcttcaaagcagagcaaatagcatgactatgagagagacgctgagagcacctaatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatcagatgcaaaataagaacaatataatggtgtgtgccaaattcacttgagtttctagtttcaaaaaatcaattcgtccttacaaagcaaaccaaacctctgactgcacaggatctacagagcaacagatcacagctccaaagtatattgacctgcctgcaaccttgtggctccacgcattcagctcttttggtgtaactggcactcaacgtatgaaatttcagcatggaaaggaactgaaaggttcatttttctttcgaagaacaaataaaaaatgtaatgtcaatcaccaaagaaaattgtgtagaaagtgaaagagtatagcaattagcccacttagcagtttgtactgatttcaagttctactggagcaaattgcagtgtccctaagcagagcatgatgggtgtaggaatcttggtagatatttgcataggccatatcattaatctccgacctctaaccattatgtgttcaattcatggaaagaggattttgtgccatagctcaccacaacacgtttcagatccaatttatagtatttatatattaccaaacatgttcttaatttcatcattgtaacagaaacttccacacaatttcttcaccaattgctataggagcactaaatatatatcagtttaaatcagcatggcttagccctaaattagtagagttcattctgcatcttcaaagactaccaatgctgacttgcatcagcaccacagtgaatcatccaattacttagccagacctacagtttgtaattttagtcaatgatttttgcctctcaaatcctaaaggccaaatgaagaacagagttaccttcaagtgcttgtaatgatctcaccgagcccaacaacctaaatgctattggttggtctagtccaaaaacctcaccagaagcatcacaagtccaaaaacgtacttctattagtaaatgttgagcttctctgaaggtttttgttctaacacaatctgccacataacttcaattctgatgttaaggagcagaaatagagcctgaattctgcaatataaaatcctttagtgagcaagtatcaagtccagaaacctttagtaagcaagtatcaagtctagaaaccaatataagtgtatacttgaaaatgcaattaatggaatatatcaatgtatacgaaaataggtctagcccattcagtttctttaggaaaaaaaaagagccaattcagtttcattatgtgcaaggtaatctttatatgttgtcaaccatgtagctagaagcatcaacactaataaacatttgcttatgtaaatgaagcacaaaggcatttagaaaacaactcccccctaaacaatctctaataaacggggacattcatttctttgaaagaagcatatatgtaatgtgaatcaacaaataaaatgtgtagtaagtgagagtaaacatcaattacctcgatttgcactgatctcagttctctactgtactaaaataaagaatccctcagcagagcaggatagattcacagattccttgtagtcttgcagacatttacataggccatagcattacttgtaagaggcatgcaaaatatcatacctccgaccactgtaataagcaatttgagatagtggctgagatgatggtgagcaatcatatcagaacatgcagtgaaggtttcgttaaatatgattgtcatttagaaaaagagttcaaggtgaaccattgtggaactaaaatatcacctagtaaaattgaagtggaagtaggaaaaggcaaaaaaaaaaaggttcccaaaatacctatacatatggattctcaattaatgatgaagttgcatacatccattgcccctaagtaaattacaccataaataacaatggcaaggcaattgcaaatggcccttggctaggcgacgacagatggttcccagattacctgttgctggccagatctgcaattgcgaaacagtgtcggcgccgcacggcagcggagcttcaaacttgagcagaagggcgccaacccactgtggagatggagaaggattgcatcggctgaagagagcacaaagcaaaaggaatcaaatatgaattacagagacaaagaactactaaccaacggagaattcaacacaacaatagcccatggcaatgcaacatcactgatccagaccttcatggcgagcttgagtgcatgtacccaccggatctagcgataggccagcagatcgatcacctcgttgtcgttctccatcaccagcagccctggttgatctccatcaccaccacccctacttgaactgggaagagagaggagtagtattattatggtgtgtgtgtgtgttgggggaagggagggcgtcggcggcgaggagaagcgcaggagggggaggccggcgtctacccaccggatcgagtggcagggccagcagatcgaccctctcgccctcgttctgcatcatgaccactctccctgcttaactgggaagagagatggagagattgggcagggggagggcgacgaagcgacgacaggcgtcacggccaaacctcgccccgagccccacgtggtctggtccctccgcaggttcaccacggcgtcgacgattcaccaacgaccacagcagcgcctggacgaaggagaacgcgcagaggagtttgtgaggaggcggcgacttcggtgcggctagggtttttggatggcagtagagggcagccaaaagttaactcccccgtccaccctcgcgtgatggacggcaaaaaagctcgaggggcaagccgtcgtcgccggcgaggagaaggcaaagcggcggcggcgcaagggcaagggaaatgaagagaagggacgggggaacagtagtggctagggtttcgagggaatggggggattgggtgttctttttttttcataaaactcccttactttctctttttcagggcgctgtcctatacttggacagtcatatagagggcctaaggcagtgaacttacattgaggacttaagaaagattatcaaggtaagagaggatttttttgcaaaattaccagctccagcgctcttcatcgtagatgcttgatcggacgacgctgctggcgagtaaccagagcgcaccaaaatcaacagccttctagcgcgcggggggcgacgtggatacacgcgcgtgcgtccacgccgtcccaaattctctcgtgcgagcacttcgcccttgcttttaattaccccgattaccccgatatggtagttaaaatttgcttggttttgataaaaatttatatggggatcaatatggaatagacgaagtatattctaaacaatactatcatgtgggcaatttatatttatccgtaacaaagcataactatttagtaagttgtacaaaatctgatttctacccatacttatttttgcaaatataggctgtgttcggtggtgggtgttgggaacccatcacccacgcatgaaaaacggagcggtccattaacgcgtgattaattaagtattagtttttttttccaaaaatggatcaatatgattttttaagcaacttttgtatataaactttttacaaaaaatacaccgtttagtagtttgaaaagcgtgcgcgcggaaaacgagaggggagttgggaattcctgtatcaaacacaaccataagagcaagtttaatggtctatttgatgagcttctaactgctgcagcttctcatagaatcagaagctccccaaacagtccagcttttgatccaaattatgagaagatatagttatataatccagaaaatgaactagaagccagaagctcagaaacccagcttttccagtttctcagaagctggcttccaactagctgctttttataatcttaagctcctccaaataggctctaatactatagacaacaactattagcttcaagttatctataatcaatctaatagccaattcatacaatagttaactacaaatatatactacatcattaataattggtcccacatgtcatacacacgtaacgtttcagagttcgtgctgcagctggctacaaatttgtaacccgttttttttctttctcctctcttgtcttctccatataagtttatagctgacttatagtctattattgtacttgctttaaggtgtaatttaacttcaagaaaagtatgagcattcgtgtcgatacctcgaacgggtcggatatcaaacttggtgaacaggaaccaaacttcaacgcaaggttcttaatcaatacaagctgagctaggatgcaatccccacttcgcataatttgaattaatttgacgccaagaaagtttgaaatccaacttgcacacgttagagcagatgccaggctataagccagctataaatatattttaaagagataaaagaagagaaaaaaaagcatcgggctacagatctgtagtcagttgtagcacggactacaagacgtaatgtgtgtatgatagtatgacgaggtattaatagtatagtaatcaactattgtatgaattagctattacattgactatagatgatttgaagttagtagttgactatactattaaacttgctctcagtaacactcttaacttctaacttaaaatcactaaaaatagactagtagtactagttaataaacagtcttttgtcgtttagaattgaaaaatggctgggtctactgtagcattcctcttcttctttttttaaaaaaagagaaaaagttcaccgctcgaggagcgggcagttgtggactcttggagtttgtttgctaaatggctccgtctctttcttacaagttacatttgaattaacttttgttttgaagactgcaagagacggccatatattataattgcagttcacaatttgatttgacgacggaacggtcaatatatactatcttcattttaaattaaattgactataaaacagactagtgccccggtctatgttttgtgtcactcgaaatcaaaacaatggctagatccatcttgcgtaagcagtggttgagcaaaataaatgatgaatttaaaactatatgaacgcaattcacgtgttcgtttgacaaattagttggataaatggttcccgaagctaggggggttttcttataagtaatccatctagataatactctacatcttactgcaactccacgtatagtattcaacgaattaaaaaaaaccaatgaaccactgtcgccgctgtcatcgaatatacgcggccgtgggcaaccgcatcggtccacgccagcggcgaggcgcttaagcccgtctgcgaccatggcgtcctctgccacaggcacggaccgcacatcaagccatttgacgagattgaagaagaaaaaagaaaaggcaacgaagaagaagggaaacgggaaagcagctaacaacacaggatcgccccaccggtgcgccgtccgtcgcgctgccctcccgctacttaaagatacttacttcatcctagaataaatcaacctctcgtacaagatatgatatactctctctattctaaattgatctatatataattttttttagattattcctaaatgatctacgtatttgtgttgattcattaaatctattcgttatttatgcattggagtaaatggacattaacgtatgtatccatacacacacgtatttataacccatatgtaatatcttgattttctattggctaggaaatagtggagatggtgcatgcatgaagtttgttgctagagtgaatataacactataaaagagttattagcttttcttggtcttggtatacctataaaatatgtagatcaatttagaatggagagagtatcctgtaactatgaatctaaacatgcatttaagtcttataatgttttcacttcatcaatttttttattacacaacactaacatttactccctctgtccaaaaaaagacaaaccgtgggtttccgtgccaacgtttgactgtccgtcttatatgaatttttttataattagtattttcattattgttagatgataaaacatgattaatactttatacgtgacttatctttttaattcttttatattttttttaaataagatgaacggtcaaacgttgaacacgaaaatcagtgtttgttttttttttacggagggagtagtatataacaacactgttttacgacaatcccattgacttggttcgcggtcaatcacaaattcgcaatcataacagacgctccccaatccccagttccccaccccccacggccccacccacacacaacaaaaccaacaaaaaaaaatcccaaaaattcgaatagtatctgccaatcgtcctcatcgccggccatcgccgccgccgtcgccgccggccgaccaccgcgtccgccattacctcctccgcgaccggatctgctttccccaccccccctctctctctctctctcttcccctctgcacctgcatcgccatcacgattcgtcgattgctcgccaagtcaagtccactttgaaaattccatcccaactgcctccggcctctcccctcacccacctcgcggaagcgcccttatataccacgcgcttcgcccgccacggcgaccccgacgacccgccccgcctcgccccccaccgccaagcgccgccgcgtgctcgaccccgaccctgacccggacgccgccgccgccgcagccacggggaactcgccgctgggcggccgcggccgcggcggcggcggcggcggcggcggcggcccccgccaagccaacacctcggctccaccacgcggctcgcggctcccgctgccttcgtctggatcgcctccgcccgctccgtttgaccctttcgtcctcttcgcggatccggcgccgcggccggcgctcacgcgggaacaggtgaagtactgcaaggaggcgctcaaggtgttgaagaagaagctcaagcaaacagctgccattgacatttccaaggaattccatgctctcccggtaaaccaaaaaaaaaaaaaaatctccccccattttgcgctcgtcgtttatttcgtttactcgcttgataaacaattgcgaactggttcggcactaggttttattttagggtcgtttactcgtccttgggaattgtcgaattaaggaatgaactcagtagctagtcgaactgtatgatgataactacttaactagtgctattttgtcttacaagtttggttggtctgctgcatacttgcattgctttgaagtaaagcatcagggtagaggagaattcatgtgattgcatcatacggaaataagtgcattgtttcagtgccttttcagcgggataaaagatgattgcagtctatctttctcgtgggagaatggagatagctaacacgggccgttgtcttagcaatatcagtatgatccattcgatacgtatggactttagaacaatatacttttggttttgtggagtttttgttgctagtcctatgcttcacccaaactagtacgtgatgatgaaaaaggctatatttcattttgagtaatactttttatgtgtaattctagtcccgtggtctcttcaccaaaactggacatatttcttctcatttagttaactactgcatcacatgtaccttgatgcagtaaagtagttcattttgggggttgcgtaccgtgtaaagctattaagccatcattgttggaaccgattgtgatttgatattacaatcaacaatcacttatatggactagggatatgtatgctccatttcttacattatcttgggggtatataactgtattcttcatgtctctaaccccttacaatgatcatatacaggttatccaaatttatagtagtttttatgagacgagtagttatccaaatttatccaactatgaattattttttctagtggcatctcaaccatatcaaatgttgtatgaaccaactgattagacactcttttctgtacggagaacaaaactcatgaagatgagaagtcttatgacaatttcattcaaatctatatttgtgtcgtgttattgcacatttcaaaatccatactctacccaatgtaatggaaaactggctacactttcgtccatatatatgagaagaaacatgtattggactatgtattgttcagatgacctaatgtactgagaaatgttggaattgatttctcaattattattatttctttcaaacttcttatcaagtatgagaaatcttctgaatttcttttgaaattgagtgatataaagttgcaactcatttctccttaataaaacatttgaggcagcaagcattggttaaatttttgaatcctactattttttttttgtctaaacatgctctgcatttcttacaaagtctgtgaaagactgagagtagttcatatctggttctatatttcacaggacatacagacagcattccagacgggaaaatttactgctgctcaaaatcctgctaatagggaaaaaaaccgctacagtgatgtcatgccatgtgagcattatcaacttgtgttggctgctgtatgttagccaagagacctccatgacgtattattagtttgacttaacttctcttctttagttgatgaaacccgggtacgtttaaagccctcagcaagtgatcacccttcaagcaatgaatacatcaatgcaagccttatagaggtaaaaacacaggggcatatttcctggtgtttatgttatacacgagtttccatctttttcaatactgaatgtttcaaatcctagatgggacatgggacctctggatttgttatagccttataggttatttatgtggtataatatttacagactgatgaccaaggtcaaagtcatacaaagttcatttccactcaaggtcccttggtcaagacatttggggatttctggcagatggtctacgaaaaccagtgtcctgtgattgttatggtcactaaatttgatggtgccaaggtgctaatgttgtacactcctgaattctcagtttccaagttttatttacttgtctttacaacatattattgggttgctctttccctgcattatgttgaggctaccccaactccacttatccaactatgtcctacatgttttaatatttttattatcattatcattgtcatgctgaagtcttaatttcacatctccatggatccccctcttttgctttgttcaaatgggcatgaatttttttgttgactgttgcaaatctggatgcggctgttacatacttgcatgtatgcatcatctcagatggttttattatcatcatatattgatatgtaatctggccattggaagatgaaatagcttgcatctctatggagggcacatatacatcacctagattgtcatatgcaattgagaacataaaatgaacagaaaattaagatcttgaatctttatgcttgcgattgacacatacagctgtcaggttcagaggttctatgtaattcttaacccaaatacactcatgattgcttcgcatatgcatattttaacttgctaaaagccaattgcagtatgctgatctcaaccatgagttgatcctgcctgctcatattgcaatactttgatttctaccgaagtgcttagtgtaatctgatttggatttacaatttacttttggttgtctatttcatgtttggaattgatgtacagaaaatagcatggcatgtaagatgattgctgtgttaacaaattgtccttatgtaatcgattcaatattacagtagaatgagtactgtaaatacttgcatgacaattacagtatgatgattggatagtattttctgtcttagtttatgtttttgatataattgttttgagattatgactttgagaactactccctccttccctaaatgtttggcgccgttgacttttttaaacatgtttgaccgtttgtcttattcaaaaacttttgtgaaatatgtaaaactatatgtatacataaaagtatatttaacaatgaatcaaatggtaggaaaagaattaataattgcctaaattttttgaataagacgaacgatcaaacatgtttaaaaaagtcaacggtgtcaaacatttaggaatgtagggagtatttgtctattactggatgataccaaaaaatgtattaagttcattgatgtagacatacaacttgaatttccgactattttcaactaattactttaataaaattttattaaattattaactttgaaaaaatggcagtgtgacaggtatcttccaacgaacgaaggagaagaaagggattatggaaaattcagtgttaagatcacaaagttcaaatgcgatggtgtcttagaattgcgtggtttggaggtacagcagaatgaggtaaagattttcaaaggccatcagctacgttttcttgttgctattagtgaagtgtaaggtaggttatacttctgttcaaaaaacaggtaggttatactagcaaggcctattcctatgttttgcatcataggttatcaatttcaagattacagttgttcgtagatggatatatttaagctcctctttgcggcatatcttaaacaaatgaagaattacatctatatgcttgtatcatagctcagagatttccccaggttagggcctgcttggaagtccggtttttggcctaatgtgagtacaacacttctgaaaacttttacattctggacttggaagttgaaataggtgcttttatgggtcagtaacccattaactatccctatcttaggcccatacgactggaaaatggatgaccttggaaggccacactatttttcacacattttttctgagaaatctcaggcttgccttgagctcgagcttgctccaccctcctcgcctcagtgcctcattgccactgccacttctacagtaaccaccaacatcctcctggcttgaatgagcgacgcgggcctcctccagcttgaatccatgccactgcccccctcatattggtgatccaagttgtcatgtcgtctgttctcgatacagccctcctggagataggcagcaaacccattagcaggtgcagcagcggtcactctgttagttactctagagaacatgggcatcaacaacagatggcgatgccagtgacctctgccagtgctgagtggatttcctctgcctttgatagcatagcacacgcctcatcctcatcacccctgtccctgaatgtgcatagctttttcaatgattcggtctgaactttataccagtgagtataaattatgttgtgttgttgcatgtatagattcagaatttgctttccttgattctaaaacatttgttgtgtactcgcttctaaagcatgctattgggcaatacacagtcaaatttgctcatgatctgtgctcgatgcattcaaagtactccgtatatgactatgacttgtttgcttggttcccaaacagtattttacaaggtaaacaatcatgttaaggggggtgctactgcataggaaattacaactgtaatattttgtcaggtgtaaatatttaccaaacttccaagcaggcccttaggatgctcgtgtttaaatttgctgagtgagacgacaaattatccatggcatacaagctgtatttacctttagttgaatatattatcaagcttccttctgctatgtgtgttgcatattctatagctggaaacaggcaacccatcttattttcttactttttttttcttctcattgcttccatgttttctcctgtacttcttcctccatgtttgcttccctctctatttccttaagatgtcatcataagaaatgttccattgctatgctgaagagttatgaccagagtatctcctgactgctaatttctgacatttcagtcacttacagttcgccatgttctccacattctgtattctgactggcctgaccatggggtgccacatgacagtgcttttgtacgaaaaattttgaaaagattatatggcattccaaaagagcatccaatagtagcacattgcaggtttgattgaaattaatgccattcttccatgtgcacctatccctatacacaaactcaatactattgttttttctttctgcagtgcaggtattgggagaactggtgcttatatcaccatccacaacactatagagaggattttacttggtgacatgtctgctttggatctttctaaaactgtcaaaaaatttagatcccagcgacctggaatggtccaaacagaggtatgtgtggctctttatttctctgcctctgctacaaaatcctctgaatttgacaatagtttctgtatagtggagctggtatgtaccttagaagaagtatgttgttatttattttatgtactgcagttagtgaacatgtgactcgtgaaaagtgacaactgtaccctaaatctgacgcttagcctttttttttattacaaaatatggtgctccgttgatcttttgctttgtaaggacagtacgtataaagcagcaatcggtgactttcttgtctttaaggcttagttgggttttctggattacggatatgctttagttggattgtcagaatattatccatcgaaataacagtgcctgaggctacctaagagtagcacagaataaggatcactgcagatactgtcctaattcaacattttactctgcaggatcaatacaagttttgctatatggcaattgtctctgagctgaacgacctgctatcaaattcaaaacactgaatcatttctatggtatgtttcttgcacgagggccttactatacgcactatccattacgcggtatcacaagctgtacaaacatatgcttgtttgcatcagtaatctcgaaatgttgcatatctcaattctcgtctcatatcttctcctctgcaggaacaatcagtgccctgggtatctctgacagattgtcgcccttcaactccctcaattctttaagcctagctaacagcattcatgtatgctgatgatgtacagcatgaagactgaaaaattcatgcttcagcaggaagctttctctaacttctccacaccaagaaccacgtgtatgatcccaggttatgcctggttctgtatccaaagctgatgatgatgatacaaggtttggaaatttgcagcggcgcttctcctgcccacccacctaactttgtgattgtttggtagcttctcctgcatcatgcatatgatgaaatttttcggaagttttaagactcagctttgtcacttttcaagcagtagtgacgctgcccccatttgtttgtgtgtgtgaggtcaaatgtctggagaagattgaaacggctgttgctactgcaaatgcagccacttcttgatgatgctctgttctatctctagactgtctgtttctgggggttgaggagttgaaaccggtgttgccaagcagaatggcatcagacatctggagatgattttgttgttatctgtcagtggagttttcgaggggaaaatggacggtagcggaatgggctattggggttccagcccaacgcgaaaaagaacacgagtttttcagaggtgaaaagaaaaatttaccatctaaacgccgtaattagtactaaaacgtaaggggacgaccgaaaagaaaaccattggatcctgtgctttacgctagattgacatccctattctaagtggtatggtcatattgcaatgtaaaataaagacatgttcctaatttgtgtattaaataataaagacatacacgcaaaaccatcaccgtgaatgtactcatctatgaatattcccgaccttgtcctggctatacgtttattgtgagtgaggggatggatggtctatatgttaacgaaagagaaaaacaagttagattggtctactagtttctaagggataatgtcaatatgtatcttagaagaatatttcatttcaagaatgatcccgttccacctgttctctaaccaaatactttcattcaaaagtagactcacctgttcatcttataaatcaaacacatgcttacatgcccatatcacaggagcgactttctaatgtttgtaggagtatgtacaaaaattgccaaggtcgttcatgtaatgcacagtgaatggagatatatataatgaggtttattttaggggtaattaaatttaatgagacgttccagagggcggcttctgcaaaggagcagcacatgcacattgttttgctcattatattttaccagtcccctgagttaaaaggcagtgacgtaatccagcatgtaaaattttaagctatggcgatcacttaagctaaaacgtcattatgcgagttgaagtttaacaaagacacgaaaaaactcaaggtatttaattaattagacccactgtccattttgtctaacagttgacgagaagcaaactagattagattgctagtaaaaaaatatttgacattcaaattgtgcaaaaggggaaattaatctagcatttgacttctgctcataatgtgaaaggttccgttcagatcagggggtgcaaaatttataatgaattcttcgtgaaaaggtgagagtaccttcacgaagggagtacatcacatcacaagatgtgtttaggcaagtaatacaaacatgatgacgcttatttaataactaagtccattgactgtgaaaagcacatgggaataattccctattgatccctacctagtttattttccctggtataagtaatcaaaagctagctagcacagtactgcaggtgcttctcaagcaaagaattaagtaacctactatggatgaaagaacaatgagatgcatggtgtgcatgttagtgcaaatataaattaggagaagtcataaggttccatatatactactttggaataatggaataaacttagggatcttctttgcttttctcctctaatttcattatccacacccagccaattcaacaaacaatgggtggcaaaacaacatggtttttaatttgcgtgtgtaagaaatgtgctaatttcactcaatgtttcacaaggttggcacatgcacattattttcattcttcttccgaagtgctaatcttggctatcagtacattatttaatatttaatagcatccatcctattgggtactttccataaatacagtatacatagacctactggatttatttttataaactcttatacttattttagaatgtaaacattttatatttcctcaagactttgaagcaaaaaagaaaatattttctttagctaaatgtttcatccaaatcaagtaaattgtatgtagatttaaattacaacaaagctccaataaaatgcatagatgatacaatggcagcgctttaacttttaggaattgtttcttggtgatgaatatttacaggaacatttcaattatgggttgtatttaattctaaattgtgaactagtgcatttcacataatgagattactaaattggttgaatgatttctgatttgtctcatttagcaccgaactggaatacaggatgatgaacgggaaggtgttaatttatttcattttagacatcatttaccataaagagcacaattctaaagttagaatgttaataggcaattttgtgatatgaaaattgttattattttcttagaatgcacatcatgaaacaatcctaatttttctttaaaattaaaagagtacttacaattgctggaagttgatgtgagtctatagaatcatgtacaatggatataggaatttagtacaagcagaaaaggaaaggttagctaaaaataaaatttacccatctgtatttttatttccatacccatataaaattttacaattaattaatacgaaccttcaaattctgtgttgattcagtggacaaatcaaactgatttccacgatcattgggttcattgcaactagtttgtataatagataatctaactatctaattattgtatcaaagaaaatgttccaccaataaaaatgattagaattggggaacttacttccatcaccttaaaatgatatgagaatatggaatatagcatgcttagaacttttgttacattttatctataaatataagtctttaataatcattatctcatcaccataaaaatcgttgttttttaatgcaattgatttcctttttgacaacaacccccctcccctattccacccttggcaatccacaacatatcatttcctacaaccacattactactcataaactggatttatttttttcttaatgtgtggatcagatttggaattcaaactaaaattgtgtcggatagttgatgctagttgtatcgacttcactattttttcataaaagaattcaactgtgtttaataagtgggaacataacatacattttgtgcatttatatgtggcaaagcatccttcgctattaatatttggtgcatttagatgcaacgaaacatcccccgtgattaatgtttcattgtaatctttgaagtatatttgatcattaattgtaacaagtttttcatttatgtgtctcaaacatttaatgtcacatttttttcaccttaattgttaccctaccaagcattcggcacgtgactattaaatgtattgcccgtccttcctcgaccctcaccgtgacctcctacccaactctcaccttatagacacttatcatcaagttgtccatgccactatatcctcaccttcccaaacaaagtgttgctatctccatcacgccgcacccctcgtccagttgtccttgccatcgcctagaccatgagctttgccgcccctgtttggagagaggtaaggtgcggcaaagcatcctccaccattaatgtttcatcataatctcggaggtagatttcatcattgattgtaacaaggtttttcatttatgtgaccgccagccctttctcaaacatttaatatcattcaagtaaaaaatatttaatattattttttacttaatcgttaccctaccaagcattcggcgcatgcctattaactgtaacacacacccttcctcggtcccaccaccgcctccttcctcggtcccaccaccgcctccttcctcggtccccaccaccgtctcctaccccacctaccatcaagttgtccactccatcatatccccaccttcctacacaagtgtagctatctccaccgcgccgcacccctcgtccgacaatctttgccgtcgctttgaccacaagcttcgccgcccccgctcagagagaggtaagatctaggcttcacaaatcctagagggggtgtcgaagcactaatcccgaagaattcaccaatccacaggcgtggttttcacggggaaaacaaaaggtttcttcgatttttctaaatctagtatgcactctttcgcaatctagtatgtgtacctttgttttgcttagaaacatgccatgggtagtacaattttttttcagcagtgcatacttagctagctcttctggcatatgactaaccaaaactggaaatgatcagagaagtatgctcgatctactcatatatttttattcaggagaaaaatagagcagatctgatatgtgtgtgtgtgtgtgtgtgtttggggggggggggggggggtgttgaccatgtcctgttctctgcctgatacaccagcagtcaaccattaaactaataagagagaagaacacatataataaacctggatttaatttttcgaattctttactgagtagacttttttgccaccaccctgttgctctacattaaatcgcctcttcaatcgcttcctcctttttgctagctgctccatttttcctccttcgatgttcatctctgaacatataaacacgttcttggcattattattcctggttcttgatataatcgatccgagctgtttttatgatcattttgcatgctctccatggccaacctctcgtgttcgtccatggtcagataggatctcgtccgcatcatcacacggtatagtttttgagttctttgtgatcagatcatgaagatgagtcgtttctgctctgtggttggcatcgtttgcggctccccgtcgtcttcaggcgatgaagcttttgcttcccatggcgagcagcagcaggcgacgacgacgacgacggcgcagtcttctgggaagagctcgagctcgaggaggaagacggcgccggaggcctccggcgagcacaaggcgggcggtgaagcgccgccaccggcatccaagaagacagcattgctcgacaagggcaaagagaaggtatgatatctataggttactactcatgttcgtcttcatcttcttgtttgaagagcagatgctactctttcttgatgcttgctaattttgtggttaaaaactggatttgatgcagtggttttatgcattgatttgatttctttgggatgaaagtttcagaaatggtggtgttccagggagaagaatatgctagggcatcatcatgcatatgctgggttgagataaaaagaaacatcataaatgtgggatttaggatctacgttttaaacatattcacattttttttttgcggggaagacacattcacagttttttaatttgtggggaagacatattcagctttgtgtgtgtgtgtgtgtgtggaagacatattaatagattttttttttatttgtggggaagacatattcacagtttggttatgtttttgcggatcattcatgaaaatgcaccatttccttttaaaaggaacctatctatttcaatatttgtgatgtggctaatcaagaacaatacatcgtgcatcaattagactaaatctttctttgatcatttaggtatcagaaatggacacttctgtcaggagaaccagcaaaggaatatcaggcaatccatcagaggattccaacgaaccagtggctaaatctccgacactgaagaccgtgatcggcagcataaggaactatattgctaccaaaaagggtagaaaaataaagatcctggcctttgaggtagccaacacaattgccatgggttccaacctgatgaacttcctctccgaggaaaacataaggtacctgaaacgtgttgtgcttcagaaccaaggcgtccaaagtctgatctcagatgatcagagccagttgcttgctcttgttggggatgaaattaggtaattaatgactttttctataaatttcaatgcttttactatttatataaattattacttatatgtgtttttcaagatttcttacattcattgggcttggtttatgcagacaacagttcaaagattttgcggcatctgttgctaggcttgggaacatgtgcagggatcccaaatggcacaatcttgaagggcatttctctgggtaaaattttagctgccaccacattactgttcttgtataattcatggctcaatcatattttattctatctgagtgttcatttgtgtgcctcttgtcactgcgcagattggagtatggtcccataactcaggagtattcccatgaaaaagcagcatccaagatggaggatctgatggaacttgtgactaagacaaaggtgtgttagtcacatattttctaatgtcattaccactgttggttcaacacattttctttttaggaaccactgaaatgatgttgctgttctattttcttctgtgcagatactgtttgaagcattgcgccgattgggagtctccgagaagatgtacagggaagccaagcagacaggtgcttcccaaaaccatttgtgtgatcagcacaactaatcagaaatatgtctatttatgttcttcacatcagttcttaacatttttttatatgtgcaggtatgccacttgagactttccaaaatgcggtgaacattgaaaaagaaatcgtgcaaagcgcaaagaagaaagcactttgggtcaagaagattgaaaaagtacgtaaaaactgtgtgatatgatgattaatgtttatcacatttttcaataacgaatttatgttaaatacacaaatgctgtttctgttgcagattgtggaggaacttgtgtacattgtgcattacttgccttctgagatcaattgtgtcttctacaaggaacatgaagaggatagatctgtgaaggctaatgggagccctcagcaaactttagggtctgctgatctccagctgaattacgcaaggatcgttatcgccatacaagttttggtaagattctttgacagtcattaggccattgttctaggatcttggtcattgatcaagtgtagtcgtgcatgatataaacatatttccggttttcagttgatttggcacactaactgaaatgtcgaaactgattttatttgttcataaagtttcaatcgcaggtatccgtcgcatcatcggttccgcaatgtgctgtagattcattgttccatgcactgccttatagaatcagatcagttttgctacctaggatgagacacggcgattttgacgaccaggtgaccactcttttctgtcaattccgattacctgacaaaaatgtgtatcctgtatatactgttcatcttcatttctttctgaactttgcatcttcttattgcagaggacagaaacgcagatcgccgatgagatgaccaggagacttgaatggctctatccaatggcagaatttacaataaggtactgtaatctcttgccatatacaccaggttcattcaatgaataataacctgatgctcaccttgtacatatctgaacatcaggctgtctcagcacactggaatgatcagagaatgcctggtatcagggtatataactatgactgtcgtgtctattttgtcatgaacaatatgcaaaagcacaattgctgatttcactaataattcctcatgaaattcttgtaggagcctcagtgaccgtgatcaacgtaagatgctcaaggttcagacactgtaccatgctgataagatgaagactgatggctgcatcattgacatggtgatggaccttcatcttctcataaaagccgcgagactgagggctgatgcgccgcaccatagcggtcctcttgatcaaccagtgagtaccagtggatcatcaaccagctcggctagcacaggcatcagtggatcgaccagcttcggtaacattagcaccacttggtcagatattgatgaagatttcatcgccgtgatcgattagattcaaggtgtagattccctgcaaattctgatgtagggagagggatgcctgaaaatagagagggttttagctgagaactgagataatgcagaaatttagtttatagctctttagatactagacaaggttggtttaatgttcgcgcaatatttgagttcatgaatctgtatttgaggagctcacatgtacattttgtgcaaatggttggaagagagaagaaaatgtgctgaacatttttcctccaaataatcagaatttcttctccaatatcatatatactagtgtgatcaataattaaagatcatgcttaagcagggaagcagggatgcttttttgggccacttcaccttaagatcatagtggggatggcagaaaggagcagtcatgcttaaagcaatagctagtgctcttttttttttctaaaaaatgtcaaataaccttgataagatttctgaacttttgtcatggatgttgcacgcgtgcagactatacgattacttgtttgcaggtaccatcattggcaaattatttttgagggtaacaccattggcaaatcgatgagtattttttcctcaaaattgacacttgcatcttgcaggggcttaaattagcatgaacactttctcaattgaatggtgatgaacaacataatgtgtctacaacacatgtgctgatgctttcttgtttactcttctactcaatgagatactagtatatgatttcaccattgtttagcaatgagctgactaaccaaaactgcatcaatgcagtctctgcagactgaacttagtttgtgaagtaaaaatgtgcatcacacattttcaggtaaggaaataaataaatgcattatgcatcacaaacaaagctcccactggtttaagaaatcaggattatatgacagaagtttgttaagcctgcaactaaaagttgtctgtgttcttcggtatagtgtgttactgcaaccaagaaagttattactgaaagactaaaccaagaagaaccaccttttatagagattctagaactccattttttttgtatcaagatcaacactgcagcaactaaactcccctgtgttcttgagtgaatcactttcaacaagggccattattttcagaggagaaggcaaaaacactcttgtgaaaaattcagagaaatgcaaacgctttgtgtgaagcatcatctccatcttgttgtgatcagtgcatgacgtagacgttgtactcgacaatggcgtcgccggtcttgaggtccagggtgtgcgtcctggcctgggcgtagccgcgggcgaagcggaaggcgccggtgccgccgatcaccggcatctcccggacgtcgtcgaaggggcagttgcggccgagcacggtgaccacgctgccgttgtaggtgccgtcggtgaacaccaggttcattgcctggaggaagcccagcttggcctggtctgagcccatgtacagcccctgggcccggcccatgggcttggactcgggctcgggcccctccgtcagcggatcgtccatgacgttgatcatcccaaagaaggaccgcgatgacgggtccaccgggtccaccacccgcactgccgtcggtgatggcttgctcaccttgtcgtggaagtagaagtgcaggtgagtcgtcggtgaggatgctgacccgcggcgggccaagcccggcctggtttcttctgggcgggccgccctcgcaaccgccgcaagtgtgaccacaagggtgatcaccaccactcccttggcctccattgttgagctcaatgtgagcaaccaagctagcttcttgctatcgtgtgagtgagtgtcactacttgatgtgttgttcaggtgaagctcatgagctacttatatagcagtgccaccatggtcttggtgtgatgagctctatggcgtgcaagggaaggcgacacgtggcgggcggcgattggtctcaaaggctggtgattccaggtgaccttgtagtactggaagcaagagaaaagatcacaagtggtagggttgatgagcacagatgcaatgttggctttacctttggaatggcacaaacggaggcatcgattggttgcctgtggttgtggagcaaacactggaaaaagttttgtggttggtcggcttctagattgtgtcaaagaaactgatcaccaagctaagatcattgtggatcatatggattattttactagtagaatttctttgccactaattgcagagggaccagatgatctgggttgaagctactggtgtacgaaatcaaatcaaatcagatagtttgcccttcttgttgacggagacatcttggacatgatgacttggatgttggtttcagatgttggtagaagtagtcgttgaagcttgaaagcagctaagctatactacctccgtaaaaaataaaaaatccaaactgtatgggatgaaatatttttctagtacaacgaacaatcttatgctagaaaatatcccatccaatattagttgttgtttttttttgacggagggaatagactatagggtgatctactactactgctctcctatctctgtcagacgctcttcatgcgctctgaggcgcatactagatcgatcactagatgaatttgttttcacaaaatagatgaaacaaaattgtactccggaccatcttggtttgaagccaagtcataccaaattgttgacccttttaatagtactttgttagtatttgttttgctatcaaaatgtgccaagaacacacattttgataaaaaaaatggtgttggagcaaatccaactagtgtattctagccttttctgttgcgttcctcctcttcaatttggggattatgtacacatttatagtctgtacaagacatgggaaattacattcataaccctacagacctaaacccttcccagtgagcagataggcccacctagggggtaactgagtcatttcctgggagacaaatgcagggatggcgcccattaaggcggcatcttggctcactttggggttcccctgatggcccggctacaggctattacttaggtaatatccctcccccagtccatggcgagctctggtctctgcctcaccagccgcaccagggtgtccgagggtggttggcggctactagtgcgctttaatgaacgcccatccttgctgatgcctcgggctccgtcaaggaagggagatgctccgaagctggtctccctcagagctgttgcgaagccctaatggagcctcacctccggctcggtgacaggggattcccctctggagccagtcagccaggccacaatccttagacttggctccggtggagagcccgaatcctccttttgggtcccctgaggatacctccgaagcggaggcccccctcgacgcattaggaggctctccggaagttgctgaggtcgaagctacttccccaacaatggcactaccaaaacataccacattgccatctttttggcatagtaccaaatcaaacaaaccctccctccgtaacacatgtcaggtattagctttttacacggtttccaacatatactatgactattaatttcaattctactatcatgatacttctatatatattatgcatcatatgaaaatgtatttttaaatacgaatctaatgatacatgcatgtacaacactattagtcaaaatttttaaacatagacattgttgaaaacatgactttttatattttaggatagaacgagttgaacggatcgcaacgaaggctgaggttgaagataaactttgaaggcaaccggattctgaaattctttgtgtacagatgtaactgatgcttttgaagtagtgtctgttactccttcccctatctgacaacaaacaggtcgatcacttgaggcatactctcaaatgatgctccagctacaacatcaagaattcagctctttcaggagtttgtcagtgtgacacaaaacttctctagagaaattcagctagctgcaaaatactccttgttgatatagttagacctagtactgaacttgtatcagctgaattctgaaatgtatcaacattcaacaacagtaatcaggttaaagagagtcgagcatgacgcatgggttacgtcgtgctgacctggttgccgacatatatctggtaaccatggccatatgggcccacacagacagtgacacctcctatctctcaacgccgtatatatctttttaaaagaagagtaaatttatatagccataaatacttagatttaacgtcaaatttattacagaactacagatttaaaacatcgtatcacaaaactatatatttagtgataaagttataaaaaatacatattttagagtttatatccatagtattattgaggttggaaaaaaattgtagtttatgataaaactgatgttttaaatttgtagttctctaatataatactttaaatttatttttttgtgaaaaaataatgtcaaatatgtagttttgtgattcaattcattaacactcatttagataaaaggaattacaaataaattttgaaggatttcgattcttaccaaaatttccctattagcttcttttggaaaaaaaaaccctttcttaccaataacccctttaactcctaagcaatatactcccttcgttccaaaacgtatgacgccacttacttttcacataacgtttgatcattcatcttattaaaaaataaaatattatttattttacatatatttttacatattatactaaattttttggacgaataagctatacgacatttttttctgaggaatcaatatgatattgtgctatttcattaaaatatagaggtaataaagtaaaacccctaagggttaaaagagaaaactatacatggctgagagcggtctatgctagcaaggtaggaggtctctaagcctctttgggcctgtttgagggagcttctagcagcagctgttagaagctcccccaaataatccagctttttatccagattcttagaatctgtagctgtggaatctgaaaaatgaactaacccagcttctccagattctcatcagctgcttctcagaatcttaaagctcccctaaatagactctttgtcctggctacaaccaagctatatgacaagatcttatatataccccatgtttttttccctttgagaagtcggatgtgttctcgtctttcctctctagtatatctcctacaaaacaagttcctctaaaattcatgtgttttatttcctatggaccaaccaaattcgcgatcttttaatgtggtttttggatcatagggactaattttagtcactgtcatatcggatgttgggacactaattaaaagtattaaccgtagactaatgacaaaacccattccataaccctggactaatccgcaagatgaatctattgagcctaattaatccatgattagcctatgtgatgctacagtaaacatgtgttaatcatggattaattaggcttaatagattcgtctcgcattagcctccatctatgtaattagttttgtaattagtctatgttcaatactctaaattagcgtccagtcatccgatgtgacagggattgtccctgtatccaaagtgccactaaattcatatgttttaaaaatcctaaaaaaccccgatgtgtgagatatctttgtatgttttccccttttctgtgtcttacaagccgtatggtgcaaaagaagcactaaagcagagcacaagacgacacaacccggggactggctgataataaccgcttgaagagaccagcggttaaggtatcttcgtcatcaccggtgagtactgtgaatatgtgcgtgagatgaattgaatgaggccatatatcgcacacaacaacggtgtgacatcgcgatcgaatttgttaggagttaggtggcaggaatttggagcaacttggagaaaaaaaaaggtgaaagaggacacaaggatagatatggtggctattggtcagataccccatattgtcttacaattatcgttcaggtattagccggtctacgggtgtcttaaaatgacctgcccatatgtgataaaaaaatcattgtggccagtggcggagcggcctggccccctccaacaaaaatagtttcacatataatcacctatctataattaggtaattaacctaattagtgtattaataattatataattaggtcccctgcaagacttttaggctcatcctatatatagccaaatcctggctttgtcactgattgtggctcatgagttttcgatgctgcccgaagcatagagtgccgccgggcctgggccgcccatgcatatattataattggttggcctacgcatataattgtgtgaattatgctatcactgaaccagaacgtttgccacaattcagatgtgttgagttgttgaaagtatatgcatgtgacaagttatattcatgatatatatgtgtaccactcttcatgattaagagcaatagtaatgcgtcccaaaattttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagggccggaggcagcgatgtcatcgtccgagcccaaacctctccactgcctccttcgccgtgggtcaaagctgccggagccggagccattgctcaacctcccgctcctccgtgagtccatctccatccctgccgacgagccggacaccaccaagcacaagcgagcatcggggcactgcccccgcagctctagaagcccaaacaacatcggcagtggccgccgccacggccacaacgatggcagtgtagaggagaggtggtggcatggcccaagcggtgacgacgccgggcggggctccacgtcgggcaggcaaaagatgcggacgacggcgccgccgagttacggatctcgggaggctcttctccctctccgtcgcctcccttgtcggctccgaatcgacctcggcggcgcggcctctctctcttcgtcgactccttcttccaccttctatcttcctcattgctgctgccacgcagtggcagcctcctcgagctcacgctgtggcggcggcgacctccccgagcccacacgtcggatctggccgaagaggcggtctaggcggtggcgtccccaagccctcgcggtggttgcagaaaagttggaggagaggagcggcaacttcggatccattgtacccgcttcccaaggctcatctcccttgctttttttgacaatgttagctgaaaaataagtgcccttatttggacgcgtgggcttcaggtgggtagcgccagagatggatgtggtaccaaatctccaacgtgtcacacataggctgaatgcaaacaagaagctcggtgaatggcctaactactcccgccatcctataatataataaccttatatacattttttttatcaagagcctgacgggtcccatttcttttattagaaataaaacatcgagctacagtagtcttcaaaaagaaacaggaaataaaaacggaaccttccacagagaaatgggggttaagaattcaaaagctagccctattacaaggggttcctgactcttttcagaagttttgcctgaacagatatctaacagcaaaaaagaaggagagggaattacaaaacatcatcacttatatctatctcatccctcaatccttttattgttgattctccatccgaactgcgagttgtagacttcatttgccgccctatcttatgagtctggatcccagtagcagtcttcttcgacttgcctcctccttttgcagtagtgcccaggaatcaactcaatggcaagccaaaaagatcacatcagtggggtcttttggataaactttttcaaaacaagctttatttctagatttccagatggcccaaattatagcagccattcctaccataactaagtctttcatgttcttatcaagtttttccaaccaatctccaaaaatgttttgactatcaagggctgggttcagattcaggacacaaattgcagtgttccacattaatcttgccaggggacggtcaaaaaacaagtgttgcacagtctcctctctatcacagagctgacattttttatccccttttctccagcctctcttgtataaattgtcttttgttaagatcctatttttggtgaagagccacaaaaaaaccttaatcttcaaaggagttctgaacttccaaatttttttctgtgggaaatgcacttgttgtagcttcaaagctttgtagaaagagttcacggttccatccttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagagattccatatggcatacgatggaggtattgtgtgcgtatgggatgcggagtcgaatttagaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagggtttcgagtttagttgaaatttttgtaaggagtgttgttggtgcactttgtaaacacagagagaatcaataaagtcatcatctactttaagagttcttcgatttgtgtttcaccgggtttcggcggtctaactggcaactcaccggcggtcagaccggcggcattgcggcggtcagaccggcgggagcacggcggtcagactggcggcggcgacaggcgcagcaggcgatctcggcggtcagaccggagattcaacaccggtcagaccggtggcatccactcggtcagaccggcagaacaacttcggtcaggccgacttccgtcgatttcgagggtaacttttatttccgctaaaagttttcggttttagggtataccaaccattcacccccctctggttggcttagttcttgtgattcgatcctacaagtggtatcagagccttgttttcttctttggatttttatcgatctagagtttttgccatggctactcccgctaggttttcaactaagcctcatgttttcgatggaactgatttttctcattggtgtagtaggatgcaattttatattatggctgaagattatgatatttggagaaaagtttctcatccttatgtgattcctgaagctattaatactgctgctgaaaaaaccgcttttgaacaaaattgcaaagctcgcaatattcttttgagtggtatttctcgttcggattatgatcgtgttgcccatcttcaaactgttcatgagatttggactactttgagtaattttcatcaaggaacaaataatattaaagaacttcgtcgtgatcttttcaaaaaggagtatattaaatttgagatgaaacctggagaagctttggatgactatctttctcagtttaataaaattttgagtaatcttagatccgttgattcttcttgtgatgctaattatccacaatctgagatttctcgccactttttgaatggtcttgacatgtctatttgggagatgaaagttacatctattcaggagtctgttaacatgtctactttgactttgaattcactttatacaaaattgaaaacacatgagatggatgttctttctcgaaaagttgattctaaatcgagtgctttagttttttcttcttcctctttggatgttgatgcttcttcatctaagccttcttttcttgctgtttttaatgccacatccgatgatcaactcgaacagatcgaggaggagaatttggctttggttgctaacagaattgctcgagctatgaataatgccaggaacaggaaaagaggtggtccaaattgttgctttgaatgtggttcaattgatcatctttgttcgcattgtcctaagcttgggagaggcaaaaagaagacaaagatggtgagaagaccaacaacaacaacaagccgaagggttcataccaagggaggaagatggagaatcttaggaaggcttttcaacaagtttgcgccgcgttcgagccactaagtgatgtagatggtgagagtggagatgatgataagggaaagaacatctccgatgtttgcttcatggcgcgtggtgaatctgacacagagtatgaagataatgaggtaagtgcttttgaggaagctattaatattttgagtgaaaaaaaataagaagtgtgagaagatgtatagaaaataggaatttatcattgaatctcttaaatctgaaattgctagattaaaatctcttattcctaatgatgatgattgctcaaattgtgaggttttaatgaatgagatttcaaaaattagagatattaatgctgcacatgatttgaaaaatagatattctcttgcttgtagttttgcgttacacacacgcactttggatgagttgtttttaaccaaaaagttgttgcaaaaatatcgaattgcttttcatgctagtttgatgtttaacatgatttctgctaagaagttaaaacaacctcatgatgttttggattgctcaacatgtaatttgaataagttgaaatcgaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaagaggtttcttatttgaaaaattctttgctaagattttctgatggtaaaaagaacctcaacatgattttggatcaatcaaaggttagcacacataatcgtggttcaggttttaatccttatgctcataattctagacatcctcctgttgtgttatgtgttggtgctagaaggggtgagattttggttaaacctgatactaacaaaactgtttttaaatctgctggtatcatgtctactatgagtgcatcttcttcaaaatccaatgttgtgcatgcaaaatctcatgttgttgcttgtgttgctaaatcttctaattctaccaatgtgtctaatcatcatgaaaaatatacttgttctttttgtggcaaagatggacatattgttggtttttgtttcagattagctcataaacagaaaaaggagagagagattgcttttgcaaaatcaaagtggcaaaaatctggttttccctcgaggaaactggtcagaccgtagtgggtcccgcggtcagaccgacgaccggtcagaccggctgaatagcctcggttagaccaaccaccggtcagaccggcggtgaagcctcagtcagaccggctgcacaccctcggtcagaccggcctcggaggaatttttctgaaaattctaaaattgattttgcatgtggatatatgcctattggatcttctggtcgtgtgtctcagtactggatttctaaaattttattgtcatctaatcccagtactgaggcttcgacttctgcttgtgtgtaggctttggtggcaaggaaggagaacgtgtggatcgtggattctggttgttcgcggcacatgaccggtgataaaaattggttctcctccctaaagaaggcatctaagactgaatcgattatttttggtgatgctgctacgagtgccgttctcgctacaggtatggttaaggtaaatgagaaatttgaattgaagaatgtagctttggttgagtacttaaagtataatttgctttcagtttcacaaaatgttgatgaaaattttgaggttcactttaagaaaactggaagtaaagtttttgattcttgtggtgattctatgttgaatatttctcgctatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcttgtttgtggtttgcctaaacctaagaaagatcttgatttggtttgtacaccgtgtcgtcatgctaagatggttgcttcttcacatgctcctattgtttctgtgatgacggatgcaccgggacagttattacacatggacactattggtccggctagagtgca

SEQ ID NO: 62016 - DNA, 550 bp, Oryza sativa
aaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggggttcccgacgaggtcgtactgcggccccaccatcctccctctccctctcctcgctctctctctctctcgttggggagattggggagcggagcaatggcgggagaagtggtgaggtgaggagggagaggagttatagcgggtggggttttcgcgccactgacgggggcgcatcccgtcgttttctccccctcttcccgccaatgcgcgcctctcctggtacttggaccttggtgcgtctattgggcctaatgggccggtctagcattcggcacgggagtgccgcccgtctgcgggtgcgcgctgctgccgggccgagatgcctccggcccatatgacggctgcttattgggtagcg

SEQ ID NO: 62017 - DNA, 1044 bp, Oryza sativa
aatgtagatcaacacataaatgtattcctttatattttagaactgtagagagtgttatattgcttgccattgcggcgcttgatctacttagaattatcatcagaaacaccaattgatatgaaaataagaatggagaaaatattagtaacattattcattctcataatgaattcatgacttacccaatacattaaatgaatctctgctctccgcgactgcaactgaaaatgctaataccagcacaaaagcaaagctccttatggaacacattttgcctgcttgcagaattgcagattagagaaacagaagctggaaagttaaaactccaaagtatccaactgaaagttgaagctgtgtgcatcagacgaccagaatgcatctcagaggtcaatcatgcagaagttttccccaaaatggttgactagacagatttaccctccggttgcttaactaaaatttctccatatggccaaaagaaagcctcaaatagatcccttcctcctctctcacattccaaatctagtgttagatcttacaggaacgcttcagaatcccaatacagtggatttcagcccatctcaagaccaatttttgcacaaaaaaaatcaacaaactcggtaacgctggattagatttctagattagatctcacacttccacaaacaatgcatacacgagttgcgcaccaaatcagccagattcagcttccccaccgaaacaaacgctagaaagatccaaaatttacttccttttcatcactacagacgctcgaattcgtaaagcataaaactttctcttccgctactaacctaccttggttcgtgggagatgaaatcaacagctcatgatactcaaatcgaaccccccatggttacggaatcgaatcgggcagagaaaatcaagaaacagcgagtggttgctaagaataagctaatatggatcaaggaatcaagcatgggctcaccttgttgcttcttcgctctctgtctgctttgttcttggaacggggtggagaagtcaggagagcaagggaatcttcttgaa

SEQ ID NO: 62018 - DNA, 871 bp, Oryza sativa
tgcctgcaggtcgactctagaggatcccccgtgtatacataaacatacaaggcgtgcaaaggaaaaattacaaattttgcaaacatgaaaataatataacaccatgcatgaatatgtagaatttacagattcaaaatcagttccaaggagatgccatgatctgcaatgcaaggggcatcaatttatatagattctaccattctagcacacccatgcatgctcatatattattctccatatatacttcatacaagcttaattaattaagcatataacactttggtgatagtaattaaactcttccataaatatcactccatgaaaaagccacatatatatgcatatggtaaatagaacactgttaaaacctgcaaattacaccccaagttgaaacagcagccgagtaacagtgacagacagcgtgaactacgaggcaagaagaggagaggctacgccgccttctgcgccacggcggcgctagagccgtggcgccgggcgccggcgccggcggccaccgacgagatggcgctcctcaccgtcatggcgacgcggcagttcttgatggccctgaagctctcgtgccgcaccctgaagcacgccgtcgacgccgccatgtcgtcgtcgccgccgtcgtcgtcatcgtcgtcgtcgtccccgaacgcgcggccgccgccgccgtgcccctgcaggctcctcatcgacgagcacgtcggcgactgcgtgctcctgaacgacagcgagtacgacgagtagaacgaggccgacgacgacgacgacgaggtggaggaggcgcaggacgacgtcggcgagcccgacaccggccggccgcctctccgcagcctgatcttgggcagcacgaacaacctgagga

SEQ ID NO: 62019 - DNA, 7290 bp, Oryza sativa
  unsure (1)..(7290): unsure at all n locations
agtatttggtccaagtttccgctttttggctataggtacatttaccttggccaaacagccccatgttcgtaggtatgagagatttaatttcttcctttcccattcctcgaatggtgttacttccttatgcttcattggaattttattcaggacatgataggtggtcaaaactgcctcaccccaccattccttggaaagccctgaagtgtctaacatggcattcaccatctcagttagagtacggttctttctttcggccaccccatttgattggggtgaatagggaggtgtcctctcatgaataattccaaactcttcgcaaaatgatgcaaactcattggaaaaatactccccacttctatcagacctcaaccgtttgattttcctttcaagttggttttctgcctcagctttatagattttaaagtaatgcaatgccttatcttttgttttcaatagatacacatagcaaaatctagtgcaatcatctatcagtgtcatgaaatatttctttccccctttagtcaacacgtcgttcatttcgcacaaatcggaatgaacaagttctagaggtgccaaattcctcgcctcagatgacttgtgaggcttgcgaggttgtttcgattggatgcaagtatggcacttggaacctttgaccaaagtaaattttggaattaaactcatgttagctaagcgcgtcatacaaccgaaattcacatgacagagtcacgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacccaatagagccgctaacaagattcttctttattgaagggacatgctgcacgttcttcagctgcacggtctttcccgaagtaaacttcagatcgaccgtaccaacaccatgaacagccgcaagcgaccccgtttccatcaacaaggaggaacctctcccgacctgataagaagaaaacagagaaatgtcagcacatacatgaatattagcaccagtgtccacccaccaatcaggtaagtgaagaacagagagaactgtaggtaatattttaccgtaccccgatgttcctccgccctcgctaatgaccatgttggcagactttctgtctttgcgctcaggacagtccttggcccaatgccctgacttgccacacacaaagcagtctccctttgcctttcccttgcctttcttcttaaagttggttgcagccttgggtttgacatcaggtttgactttcttggtgttgtgggatgcatgagggttcttcttctgtaccatattggcactagaacctncctcaacctttttgccccgaacgtncttttgcctcgccttcttctcaacacccaaagagccaatgagatcagaaacactgaactcttgtctctgtgctttagagaagtggcaaagtccgaccaagaagttggcagtttggcaataatgccacccgccacaaacttgtccggcaactcacagttgttggtctcaagtttcttagccagcatctgaatctcatgaggttggtctactacagaacggtcatcgacatcttgtagtcatagaactggtccatgacatacagctcactgccggcgtcagaaactccgaacttggcctcaagtgcatcccacatgtccttcccggaaggcatgtgcatgtacacgtccactatattgtcagcgagtacactgatcaatgctccacggaacaggcaatccaaagcctcgaacttagcctcttcctcaggagaaagaggtggttcacttcgtttgccccgtgaaacatagaagtactgcatcgctgtcaaccacaatagtgcacatgctttccatctcttatagntaagaccatcaaaagcatgtggtttcagtgcagcagcaaagccaactaccgaaaatgacctatcacggttttgggattgtggaaatatagtcatgaatcggcatattttaatcccaaatgtaaaacaataatcatggcataagcggtgtagggtgatcttaacataaccaggagcatactatgcgtatcatgaatgtcaggaacaggaatattacagggacgcaataacatgctagaggcatcatgaagtagcatactatgcgcattatgaatgtcagaaacaggaacattacagtgacgcaataacatactagaggcatcatgaatgtcacgaacaggaacatagcgcacataataataaagcgatagcgctaacaaagggaacaggagaagatataccccaagaatggacctccgctggattgtgaggcagaattgtctccgttgatgttgtcgttcgcggcaccggctccagctcctggcgcaccacctatgccatcttctccagcagcggcggtggcaactccagacatggcgagcagtcgtgcgggaggcactccccaaaaacctgatcacccgcctacccggtgcagatctcaggcgaagatgtggtttcggaggcactggtccttccaatctctcgtgcgcgcaagagatcagaagcgaggaagcgataacagcactggcgcggaggaggaggaactaacaccgagaaagaagcaagcgtgtgcgcgcaagagatcagaagcgaggaagcgataacagcactggcgcggaggaggaggaactaacaccgagaaagaagcaagcgtccggaaccgatcggactcgcggcctccttatctatcaggagagagaggcagtcgtgggaacgtggacgcgctgttgcggagacagtcgtgggaacgtggttagtggctgtaaaagaatagcgacgtgacgcacgccagcctcggcctcggcgcgcgcgcgcgcaagtgtggcattccgacccccacctcaaccagtcaacatggggcctccaataactccctatttaggttgagatattcctcgcttaaatcctgaggtggtattattatgcttaacacttattatgggcctttgagatttaatagggtaagttgggcctagcccaattattctaacagtcagatccccattggaattggttccctcaagaaacttgtcactcttgatttttcccgtaattatgggttatattttgttaagccaagctttcaaactgttatggcaaatctaagcaacctaagggagctccatcttgatgatgtgaacattttaagcagccgatcaagttggtcacttattctagcagacaacactcctcagctagagattcttagcttatctcagtgcggtatatcttgttctattcactcttccttctcaaggcttcgttcattaaagataatcgatcttagcgtcaattgggaactcaacggtaaagttccagagttctttgctgaaatatcttctttgagcattcttgacatttcggacaattcttttgaagggcagtttccaacaaaaatcttccacctaaaaagtttgagaacgcttgatttgtctatgaacacagatctttctattaacctaccagaattcctagatggaaataatctagaaacgttatctctaacatggacaaatttaccttatcatacaccgtcctcatttgccaatctcaagtctctgaagagtttggctattagcacaacaggaacctccaaggagcttcttccctctctaataggtgagcttccttcattgaaagaactggaaatgtggggatcggaatggagcatggagaaaccggtattgtcttgggtaggcaaccttaagcaactgacagatttgactcttggctcgtatgacttttctcagtcaacaccctcctggataggcaatttgacgagtttggcaactttggagatgtggggctgcaatttgtctacatctatacctcatcagattggtaatctcgcaaatttgacaagcttgaggttcgaggattgcgacttctttgggcagaaaataccgtcgtggatcggcaactttacaaagttgagggatttacggatagacaactgtggcttatctgggccgataccctcgacaatagggaatctgacccaactcgaatatttgattatcaggtctaatgaccagctgaacggtaagacaataccacgactgcttttcttacttgattcatatatggaatttcagttaaatacatccataaaataactcacaaatatatctctccacatattatcgtatataaatatcttacattatggctatatacatccactcgtaaatatagagatcggatttttatacattatcttaaaaatttatatcttatattagtgatatacatacatgagtcctgtttacgtgccatatctcctagaggctagagggccttaaacgcagtacgtaaatgataggacatgcgacttctacaccaggtatatatagattgcaagcatatataaaatacaaaaccttatattttgctatgctggcattatttttatacttcctctgtttcacaatataagtcattctagcatttcccacattcatattgatgtgaatgaatttagacatatatatctatctagattcatttacatcaatataaatatgggaaatgctagaacgacttacattatgaaacggagggagtacaaaattatcgctccaatgctgatatcacaccttccatctacagtaaattgatggtgtctattttcgcacttctgaacaaatttcaatctatcatgtgcgtgctgacttatggtctcttggagctaaaacaacatcttttcgactagtattatacccttgcatgcaggaaaaattccacaatcgttgttcactcttgctggattgaaacacattgaccttagtgcaaatcaactttttttgttctctggaagacattgcttcccccttcaacttcacctttgcaggtagagatggcaatgggccccgttcaccgttttcccgcggtgaatttacctattaggtgacggggatggttcatatatatccaccatagtgaatgaaatggttaatatgtattcaccatcggggatgacgggggcggggacggtgcaccattccctgtccccacccccgtggtgacccgacttcactgtatagaggactgattttagactttttagatattttggcccatagtattgaagcccaactaacaggggtatataaagccaaaccctagtcaacatccaatccctccaatccagatcgagaaaaaccacgccgtcggctcctacggctctccgctgcagcctgcagccacgggcgcgctggcccgccgctgtctcaccccttccgtcgggcgtcgacgcgccgcgcgccgccacctcctctcgcgagcgccgccgctgtcttgctccctctgtcgcgcgtcgacgcgccggccccgccggcgtcgcgctgcccggcgcttgcgtccgtcgacggctcgacgcgggcgtggcgccagcagccgcactcgcgcggccgggagctgtcatcgccgggagcacgccatccgccgggagccgccatcaccgggatcacgccatccgccgggagccgccatcaccgggagccgcaacgatgcaaggtgaggaataatagttgatccatgactattattccacggggacggggtcaccacggggaaaaaatcaccgcacggtgatcggggctggtgaaaatataccaccgtagtggttgacgggggtgggacggtgaaattttttcacggcggtgacggggacgcggatgtgacccccgaggtgaattcatcattgccatctctatttgcagggtatcctgttaaattatagtcaactgacagacccgagaaccaaatcatttttccagcttacatatcgtaactatcccagccttaagtcaaataagttgacagccacaatgcaacttagctctatctggaggatcaagagtatctcttacctaagactgtcaaataaattgatatcactcatggatgataaaggtgaaagggtcacatctcttcctaacatcaactacttgtgccttgcatcttgcagccttacaaaattccatgcattaaggtatcttgatgcaattttggaacttgaccttgagagtaaccaaaacactcgaaacgctcgaaataatggactcgtatagtactcctggttggactgttgacatggaaaaaaaaactgtcatcacgccccatttgataaaaaaggatacccacgagtaatcccatttagtcaattcacaagttgctgcattaaatcacacccactcgtcaagtttgtgtactaatgatgcaatttactctaagattcattttagggttaattggatccatgccgctgcaaatatgccaattcgaaaaaatgccactactattcagtatatcggctacgtgccactggaatttggggaaattggaaccatgccactcccatccagttttttttgttaacctccgtcatctctctccctcttcctttcttcgcttctccgccatggatgccggcgagccctccacctcggactcgctggtccttgccactgtagctagccagcgatcccccctctccatctctcgctgctcctccgccagcagccgctgcgacccatctgttcctcgttgtccccgccggcggacgcggcaccctcgccgccggggagcttctctaccatggacgccggcgagcctaggagggcaacggctgaggggaatcggcggccggggaaccgagtgcgaagcgcggtgggacgagcggcacggaggaaggagatggaagcgagcgtgttagggacgacgaccactggtggagaagtgctttttagtcccggttcgtaacccccctatagttccggttttcaaaccgggactaccaatccgggactaaagatcgctatctttagtcccgggtgaaaaaaccgggactaaagatcgatctttagtcccggttgatgacaccaaccgggactagtcccggttggtgtcatcaaccgggactaaagagagggtagcggcagtccatcagctagtccttttttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatact

SEQ ID NO: 62020 - DNA, 47582 bp, Oryza sativa
ccgattaagctgtctcctatgtgatcctttggggctttcttggtcagtgaagtcaactgtttaggttaagatccgtcgtagcaagtcggagctgcttatcttattgtaagcttgataaacaatcgataaatcaagcatgttacaacaacaaacgatgtttaacaaacataaatgtgcttatgtatgtcgctcatcatcttctagctacgccttgacgaagagggtgtactcgacgatggtctcgccggacttgaagccggagtcgacggtgcgggcctcggcgtaccccctcgccatgcggaacttgccggagccgccgacgacgctcatctccctcaccggcgacatcacctcgttccgccccatgatcgccaggctgctgccgttgtggtcgccggcggtgaacacgaagttcatgtccatcaggaggccgatcaccctctggtcggcgaacgtgtacgtcccctgcgcgcgccccaccacctcccccgccgccgccgccgccggcgagctcgtcagcgggtcgtcgatggccaccaccgcgccgaagtaggtcgacgacgcgttcgtcgacgccgcctgcgccacccggatcgccgtcgggttcggccccgccaccacgtcgtgccagtacaccttgatctttgtcatcccggcgccgccgccgccgccgtcgtccatcgcccacgccaccgccgccacgcacagtaacagaagcagctggagagccgccttcgccatggctgcagctggagcttgagctgatcgagcaagctgaaggaggagctagtgagaggatgagtgctgctaatatataattaatgtagctactactgctgtactccttccgtcctaaaaaaaacttaacttagaaggagatgtggcacatcttagttatccaaatttgttatattaaaagagatcatattttttcttaggttgagttttcgtgggacagatgaagtatttaagatgaaagggaagcaatggatataatgcgatgggagtggttggtgtaggagatgaagtgatgaagcagcatgcacgtggtagagctttttcccttttctaatggggttggtatgtgaagtagccatctccttgatttaacctatatttagcatctccttaattagcctatagttagcatttctctgtttaattattctgtctttttttctattatatatactcccttcgtttttaatgagacattgtcaacacctaacaattcatcattcatcttatttaaaataaaataagtacaaatatatagaaaatataagtcatatatacttgagccgtgtatttcattcgtcctaaaatagtaacgtttagtcttcaaagtttatttaaaaatataacaacatccttatccatgttctcttcccaactaattacaacactccacaaatcaatttcctcacttatcttcacttgcatccaatcacaatcttccctatttaattctatctgttttgttaataattgtgttcaaccctaaaaatcctaatattttgggatggatgtggtataaaacaagtcgcaacaaaagaaataatgcttatatagttcttttagcaagataaatagtaaaattctatgttcagaaatcgataattaacgtcacacattagaaaacggagaatgtgtatagactaatgaggtgattagtccttaatagtacactagtagtgtcagtagtacaattcatgccactaccaccaagaagttacccttttttagcgtggactcgtcaggttagtaaattgcattacgcgtgcacatctcattagctaattaagcaagctatactttatagtgctgtaatatttatttagtaagcaactattaattattgttagtgacaggctgatagtagcagggaagaatgttaagcatgtgaattgtttgtacctgaaaactgggagtagtcggtgttaaggcagactgactgcgactagctaagattcttcagacattgggggtggttggatggtggtgacactgaagagaacattattcatgcaggatttcagaaaaggagttaacaatatgcagtggtgattggcctgcttaattacattttgatcaactggtttcattattatagatatattgaattaatcatccaagttatagatatgccacctgaagattttaataattgagaaattaaaattaaggtcgtggtgtcaacgtgtcatcactgcattgcagatctgtagtcactgtttgtcgatatgcatcttggttcttctagtgtgttcctatattttatcatcttcaggtttggtgggtataacaacagtaatatgataaggagagaaataattgatctgccttttgcagataaccaacttcaccaacacagattcgttcttcctaattttgtttttttttataatgagagtttttattgaaccagttaattatatcaattttttttctctccttactatttcagagatttgttattacgaaagctcccagatttaagcaaaacgtaaataaattagtccaattactcatgcacggtcctgtacctactcatgcacggtcagagagtgcacatgatggactcttgcttgcagctaaatttacactcgcagaattaaggagttgtaattaacacagtacggagtttttcatattattaatctctgcttgcgtatacattaacacagtactagtaagttagttgcgtcagaattatcaacttcacccgtaggaattaattcctctcttcttacacattggaagaatcagaatgcaattataaggactagtccaaatacaacaggtcagataaagtcactccaaacaagttatatttagagctgtctcagaggacagatgtgtttgtttgtcattggcacattagtgtgtgtgtatgtgtgagagggatgcatatatacttgaattattagtttcctgtgtcaaggaagagaagctaagaacaagacagggagagagagagagattcagaattttcagacatgagagtgactcagtggcacggtgaaagttccctgacagaagtttccaccgattatgctgagttctttagagctcattgagaaaaaaaaagccgagaaagctattagcatataattaattaagtgttttaaaaaaatatctatttaattctttaaagaaacttgtaaacaatttcttttaaaaatattgtttatcagttaaaaaagcatgctagtagaaaacaaagcactggtcagcccaaaaagctcaaaagaactaatcttaacagtgactcgtttgccaaggtgaaagccataggaaagaagttgcctgcagccatgaaaacatgattgacctgtatgactaccaaccaaggctttcagtgctgatctgtctgtcaagctatgtactctacaattgatgatcttgggagtagtttttctggccatgatcatctgtagaggttcggtggtgtgcgtaaaagataatactcccctgactggccgaccctacctaattttgcaggtaaccagcgcgtacctttgtcccaccatgttgccatcgttgtaaagcttttgttctcgatcgattttcaggttccaaatccgatcgaatttgagcaaacagatcgaacaaattcctctgtgataaagagcataacttttctctacccatttctccatctcgttttgttcagcaaagagtttatttgtgatgttcagtggtggtacagaggttgtgatgatgttccagttgagatcagagtttttggagattcttagttggtataattgcgcagtggcacatatactccctccgtttcaaaatgtttgacaccgttgactttttaagtacgtgtttgaccaattgtcttattcaaaaaatttaaataattatttattcttttcatatcatttgatttattattaaatatactttcatgtacacatatagtttacatattttacaaaaaattttgaataagacgaacggtcaaacatgtgctaaaaagtcaacggtgtcaaatattttaaaacggagggagtaagaaacatgcgcaatacgtacgaattttgtttggtttgaaatggcgaaagattagcacaaattaataagctttgcgcagctgtggtgccactgagcctctgaagactgaaggagaaagagagggtcggagaattaaactccgtacgcactgcgtagtgggccgcagcttcacaattcggcaaattgcaccgcgttgggcccgacccacttcacagatgggccttcagattatggctgcttctttactttggaggcctgaagggcgatggtccaaactgcatgcggcccagtcattttgacaagtgctagatagatgaaatactccaatacattaatctttttttttaaaaaaaaatgaacgcaagcatgtccagactccagaaaccagaatgacatgtgcgtatgaacaaagttattggccggtcgattttcatggagcaggagatatggaaaataactgcgtacggatgcttataatttggagcgagattaattcttctacctgatggcgtacgtttatgtgttaattaatttggatctaatttggagttgatcgttcatgttcgaaagggggtaatttttaaaaaaatggattatttgaatttgaccctgaaagacgtggaatgcattgaccagctgccgcatgccgcgtttctacttacccatcacgtggccatgcttacgttttttcacactatactacatccgccatggaagcttcctcttccgggtgcactgctgctgacctttctactacctcatttcaaaacataaacatttttaaagataggctgtgtttgaggaagagaggattgagaagattgggaagatacgtaaaacgaggtgagccattagcatatgattaattaagtattaactattttaaacttcaaaaatagattaatatgattttttaaagcaacttttctatagaagatttttgcaaaaaaaaatgcaccgtttagtagttttaaaagcgtgcgcatggaaaaggagtcgcaatctcccctgtctcctgtgaacgaacgcagcctaagggtgtgtttgagaagaaggggattgaggagattgggaagatacgcaaaacgaggtgagccattagcgtatgattagttgagtattaactattttaaattttaaaaatggattaatatgattttttaaagcaactttcctatagaatttttttgcaaaaagcacaccgtttagtagtttgggaagcgtgcgcgcggaaaacgagatgttttctctctcaatctcccagatcacctgggaacgaacgaagcctaagagcaggtacaatagcaggctattagctagctgtaaacatattttaatgagataaaagatgagagagaagagcagtgggctacagatctgtagccagctgcagcgcggattccaagacgcaatgtgtgcatgacatgtgggaccatatattaatagtatagtaagcaactattgtatgaattggctattagattagttgtagatgaattggagctagtagtgggctatactattaaacttgctctaagggtgagtttgagggataggggattgagaagattgggaagatacgcaaaacgaggtgagccattagcgcattattaattgagtataaactattttaaattttaaaaatagattaatatgattttttaaagcaactttcctatagaaattttttgccaaaaacacaccgtttagtagtttgggaagcgtgtgcgtggactatgatgtattttctcaccctaacttatcagaacgaacgctccctaaggatagaaacggatagaattggtagcatctgttcgaaaaatattatcgattaatctggaattgaccaactatttagtgtcaacaagaagatcgaataaattagaaaaaactaaaatttatatattgttagagtcggaaacggcaacacttgtgtggatacgacgctcggttagtggggaaaattttccatgattattttgagtatatgttatcttgacgggatggtcagtgttaggtgaaccaaggcgtgcacaaaaatcttggaggaatattaccatccatcaaaataaaaaattgtaacaaaggtaagctaatgaagctctcattattctaaaacacattaagaacttataaacaataatcatcctcaagaatacacccctaccaacaacaacaacaacaaaaatcatagctagcgtttttttacagggaaaaaaaaagcatatgacaccacacccagcttatatattctagtaatcaactggtcaacacacagcaaaaaccggcagtaaaatgaactgatcaacacgatcatcatcttcaatatcatcgtctcaagtaatgagaatgaatgaatgaattaatcgaggcggagatggatgttgtactcgacggtggcgtcgccggtggtggcgttgaaccaccacgtcgtcgcctggcagtagccgcgcgcgaaccggaacacgccggtgccgcccaccaccggcatctcccgcacggcgcgctccgccgggttggcgccgaggatcgcgaggctgctgccgttgtacgggccgtcgccggcgaacacgaagttcatcgccatcatcagcgacagcgcgtccttgccggcggcgacgtacatcccctgcgcgcggccgaccagccgcgaggccgtcaggttgggcccgtcggtgagcgggtcgtcgatcaccaccaccgcgccgaaccccgtcgccgaggcgttcgtcgtcggcgcctccgccacctgcgccaccgtggagttgggcccgccgctcaccacgtcgtgccagaacacccgcagcttcgtctccctctgcgcctgcgccgccgtcgccgccgccaggacgaggagcgccgccgcgaacacgaaggaggaggaggaggcagccattgcttggttcggattaagctagctttagctgtgtgatgtgatttgcgacgacgtgtgcatgggtgaatttaaagggggaggtcggggacgtggttggtgtgtgctggattcgaaggttcttcgatcgtcgtctacacggcgaggaaggcgactgcaaaaatggtcggatatatgcaaacagtcaggttagaaatataatggaggataaattagttaacactagtggagaaaggggttttactccctcttcggaacccctgtactcccggttttacaacaggaaggacgaatccaggactaaagataggtatctttagtctcgggtgaaataaccgggcttaaaaatccatctttaaagatggataggggccacatcccaactgttttttttcttttatttattgtttctttttgctgcttgtatctattcccccagccaaatccacacaaatcatcaatcatgcacaataaaaatttccacaaatcaagcacaacaaaaatcatccacaatacatacacatccacaatctacaaatcttgtgagatcatccccaaatcaacaaaaaaaatatccaataaaatatacaaaccattcatcattcactacaaaaattcacaaaataaaaaaaatccagtcgctgttgtcgccgcccggccgtgggctgctggcctccttgcgcccggccaccgcacgggccaccgccaccggccgccgccaaacaatacgtctccaatccagcgagtagatgaaagagcgagccattccttgccatggcggtatgcactactacagaaataatttttctagacaagatcctctttagattgcagacagaccgtaactagtccagtatgtaaaaaatcgtactccattttcgcatacagctccttaataggaccgcacgcaaaaatcgattttcacaagtggtcctcttaaggattcgcacgctaaaataagcttatttttacaggcgaacctctcaaagagacgcccgtttcgcaggcgggcctcttaaatatatttttgtggcgggcgacgcggctgacaacgagcagcgggctgtgtggttgacggcaagcggcgagcggatccgcctccgccggcctcgtaatgggcggcggatggcgtggctgacagcgggcagtgggtggtagcaacggaccacggtggcgggctcccccgcacgttgaaggaggcaacgacagcttccttgcacggaacagtcgggcggcgagcggcagcgatggagcacggcggcaggctccgtcacacgtcgaatgtggcgaaagcggctcccacgcggatccagcgggcggcgggcaccgcccggatctgctggcagagggaggagcccggcggcggtggctagaatttttttgcgatttttaattttttcagatttttatttttaagtgcggacgatataagcacccgcatgcaaaagttgaattttcgtatgcgggtgctccactagcatagaaaaagagagattttttcataactttcctggtagacgggccagagttccgcatgcaaaaatgatcacttttggcccatcttgagatatctaaattatttacacataaaaattttggtatcatggaatatctagtagttgaagatataccaaattttacataaaaaatacgatatctcataataccttctctaaaagatgaaaaaatatattatcttctgacaccttcttaaggttagctctagctgatcgtgtgttcaatttagactttgattaatttacattgcattcttcaataattcttgcatgcttggattaactacatgtagaaattcttatggcattcttgcgtgcatgcatgcaagttggatatgttaatttattttaaattcttttggcgtgtgagagggtaggaatggactgggtcggtgatcggacttttgaagaagctggcaacagatgcagtaggtgaagtgctgactgtgaattggtacgtatgaactactcgcatcgatctctggggttttcttcttcttttcttttttaaggtgaaattagcacgcgtagccgcgtatataggtatttggtgagatgaaggcatgcttggtttaattaatttccaagcttcttcggtatatatgttctagaaatctattgatgtaattaaatatgctccgatcatcacctttggtctttggaacgtctgtacgtgtctatccaaattgtgataacagaattatagcaaagttatgttgcttctgtatgttcaaaaatcaacagatttttttttgaacgcttagaagttcttgctgacaaggcctctagtttaacttcgtttgtgctaggcttattccgggtcaagtcgggtcaacagaaaaacaaatcagtttatagttcagtccaaaaatattttgtctatagtccaagtattggcaattaaatcgtacagaaattgtaactgtacaatacttatttacagctcgttaaagccaatgtctacaacagacaacactctaaagagaaaggcactcctacagaaagctttttctcaaacgatcatatatattcagctttttcaaacagacgccaaacatgtataaaaatactgattgttatgggctggcaccgtaaccacatgcaaaatcttattttcgtaagcggacatgtgaagatgttctcctgcaaaagaattttagccataaaatctccaagataatttatacccctagccaccgtcaaatcgggtaagcttgaaggctagcgtcgtagctgcccaaagcgaggtatgagaagaggcgatgaagctgtcatcattgtcccccacgtcgagctccaccagatccaacgagcctgaagcgtgctgccactacccaaagctcaaccgtgggaagcgagggacggggagaggcgatggaggtcaccattcctgtgccgccgacggtggatccgtcactcctgaggccattggaggtggatcgactgctctcgaggccagcgacattgtccagtcagctcgcggcagcggctcttccctgtcaaagagccgtagccataaacgttattgccgtcacagtcctcacacaagtgcaatggctcgccgccgccacccgtcgccggccacaaagccattgccggcgacctgctcgccgtaaccatattggtggctcggacccggctggtctggataatattagactacaccgccgctgccatagttgttgtcgccgccgacgttgtattgttgtggttggcagtggcgctgtcaccggcgccggcggcggtgtggtctgggttagggccagagcgctcgccggcggcggaggtggagcaggagggctcctccttgatgcacagcttcttgtccttggccctgggggtggccctgatccgggagagcacggtggcggggagcggcggcgaggtgatctcgtactcgtgcatgacccatccggaggaggagctctcgccgcggcggtggaagctcaggttgcgccgcttgtacaccacgtcgagctcgcctccgcctccgccgccgccgcggacgatggtgaggatcgccacctcgcccttctggatccgccacacgccgccgccgttcttgactgcgcgctgcaccttgcgcctgccgccgccgccgccgccgccgacgctctcgtggtcgtggacgaagaaggcgtgcgcgctggtggcgtggccgtgctcccgcatcagcgtccacggctcgcacctcgacacgtcgtcctggataacggcggcgtggccgcggccgtagagcgcgcgcgggaggaggtaggaggcgacgatgtcggcgtcggtggggtcgaacttgaacgcgggaaaccaggagaatctcgagaacccgaacctccacgcctccatgcccgccaccgcaacccgctcctcgtcctctcgcaccgccgccggcgcctctgccgccgatgaggtctgctcatcttcttgcaggctacgcgccgaacgtttcctcgacgtggaagccatcgaattcgttcggagatcgatcgctcgatgggtcggttgcaaatttaccttgcaaattaaatacagagaggtttacttcgattcctactcggattgtgtaagtgtaatcgagcgatgcgttgctccccacgtcggccggcaatcgagtcggcgagcgcgaggatcgccgcccggaaggagattcttcctcgccgcggtgacgagaagcagccggaacgccggcgagcgcgggatctcgatcgtcgccgcggccatggcggtttcgctagccgccgcgcgcaccataggtccacaggtcaagtgtgatgcaggcgatgattccgagacaacgcgaaccgttcagattagatctaacggctggctgtggtcaactttgagtctttgaccatgacggctacttgatgggcctaattggcccacataaaacgtgagacaccatgggctgccttcgttggtgaaaacgggcggtcgttagcacgtaattaattaagcactactagctattttttaaaataaatgaataagtatgattttttaatcaattttcgtatagaattttttttaaaaaagaacgtaatgttttatagtttgaaaaacatacgtgtggaaaatgagagggggagtcagggactgctaaagctgttgacgaaaaaatcgaacacatcggcctgggagatctgcttaactccagtgcaggtccaaagattggtgagatgcgagcgtgccagtcagtttgatcctgcaactgacaagatatgcaaatagtagattaaaacagccgatcggccgacaagccgatggagtagttccagccgatgccgataatagccgatgccgataccagccgatagcgatagggtttaagcaatcgactatatgtccaatgtagataatgatataaaggcaatcggctgacgatgatgtaataaaataacaatgtaatcaagtataaaccaatcagcaaataatgatatgataaataagcatcgatccgaaggtcaaagcacacatcggctggaggtccgatgtcatgaaatccacaagattagcttaaacaatgaagcctttgttgtcatcggctaaatccaacttatatgtatatgcaatccttatgagccgatgcaacgtccagataactcaccggctgaaaccccgatgaaacacttattggcaatcaagaagcaggctagagattatagttctaagcacgacttagtagatcaaacttaactgatgcagcactaagtatgaaaagaaatataatatctagacaatcaagccgttgactgagttttcagggtggtagatgtctaagctaatctaatctagcaacgcgatttagccgataccggcagaaaccctaaaatgagaagcagccgatagaactaaattgatatgctaagactagattaacagagatatatgataaatagataggcaagtatatcatccaaaccagagcaatccaagaggtcgaatgtactgatgcagccttcaacgacgccgacgtaaacgatacaattgcctgggccgatggaatattggacttatcccttcaccggagatcgaagacgatgcagccccgcgtcgggtgccaagttccgccgaaacgtaaaaacaaaagtagaaataaaaagggtggcgatgctccgaattgtattgatcgtggagatagattacatagaccccgggtgtacatatttatacccaggggttgatacaagtccttgtcggacaagaaagaaactaacctaaagataagaaagaaactaacctaaatataaaaggaaaatataaagtccttatcggacactaaacacactttcctaaagataaaaggaaactaacaaactattcctaattaatagataaactgccatgccgtatcctctttaaactcggtcacttagggataagctccctttaatagattgatttccttaaccgaatatagcaggaatccgactattggcgacttgataactcccatcggctgattccgagatgctgcagccgataatgattctaagcggatggcgtctttaccgattatcaaatttcactgttaacagccgcccatatcgcttgacgtatcttatttgaggccagagttttaatcacgatactcaacggtaaagtcaactataatatattttctcattaaataaaatgtcaaaataatatcaagctcgaagtatgactgacgtgacgtctatgttaataaggagtactcattacaacgtaacatattatcttaatttgttttgttaaaatgttgatggttgttttgggttccatgcccgcatgcaacatgtagctaggatacggattttcattcctcgacggaacatccttcgttatttatataccatctaaatatttataaaattttttaaaaaaatttataatatagattaatacaaaatatatcactccacaaacatgcaagaccaaattcaacttctacaagttgtaacaaaaataacaaattaaactaaaaatagttatcgtatattcgcaactatatttgttatttttgttataacttgtagaagttaaattttaacttgcttatgtttgtggagtgatatattttatattaatctatgttgctaattttcttttcatattttttatgactattaggtggtatgcacgaaactagggatatccctcgagagataaaatcattttccccatgtacctaatactattctcatcctaaaataatttcatttttcatccatctcatgtataccaatataaaaccaagaaagctaaattactcttaatttatcaaatcgcaatgtaactatttttcaccttattttaaaataataatttttattataataaattctaatttaataattactctaaaaataaatttattttatgctaaatagaaggtgctaattaaaatgaactttattacgggatggagaggtagtacatgatacagtagtaattgacacacaacgtatcgctacctggctaactaattactccctccgttttaaaatataaacttctatgatcggattagatatttcatacgtcctatccgatattaattaggttcttatattttgacacaaaggaataataatgaatcagttaatcgtggcggatatggatatcgtacgggacggtggcgtcgccggcggcgttgtaccagtacgtggtggcgcggcagtagccgcgggcgaagcggaacgcgccggtgccgccgaccacggggatctcactcaccggcctcgccgggttgggcccgaagatggcaacgctgctgccgttgtacggctcatcggcggcgaacacgaagctcatcgccatcagcagcgacatcgtctccttcccggcgctcacgtacatcccctgcgcatggccgaccagcctcgacggcgccgtcaggctgggcccgtcggtgagcgggtcgtcgatgacgtacacagtgccgaacaccgtcgcggaggccctcgacgtcggcgcctccgccaccttcgccaccgtcgagttcggcccggtcaccacatcgtgccagtacacacgcatccgcatctccttctgctgccccgccgcctccgccgccgccgtcacggcctggaggagtagcgccgccgccgcgagcacgaaggacgacgaggctgccattgcttaattagctagattaatgtcgaaacaagatttcggcaataataaaaggggtggctatcaagctaggaaagtggatgagtttggagacaaggaattttatataggttcaggccttcttattcaacaagtaatatcctactcctgtccggagatgattccgccgagtacgttattgattgtataaattggaaaaaagaatcgcgccccgagaggcacacggaccctccttatataggggaaggagtccgctttacaaaatacagcccatatcctaacggaatatgggattatagataaaatacaatcgtaaccgactaagatctcgggtatttccttgacatacaagtaaaaaactaacccgagtcttcataaagatattctatctatatttggtaccgtatatccgactaaattataactgtcatgtagaaatgggatatccatattctccacagtagcccccgagaccttcgcagttgacaaaacaaccttctcgaaacaaaaaacagcaatccgagtgcttcaattcaacttgctccagtttgccgagtgctaaaatcaaagactgcgaagggcgaaaataaaacatggtgcatcgagtagatgcacctaattaggtatagcccccgactatgtaattagttgaaaaactaaacacgtagtcaagaaccgagtggttttatcaacactccttgaacatatcaaggataaaaaaatatgaaagggccgagtgataaacactcaaaaggtccaaaaatagacatatttgataggaatccgagtaagaaactcttaaaatgattcaccaaacatgataaaaaatcacggtaattaatgagtctaatagcctaggctgtgacccttacaataaccaaaataagcatataacatgctaaaagaataactattagtaaaccagtcatctcaaatcaacccaaacagcttttgcagcctaataaagcttacaaaaatggtataacacctttctgtcgggcaccttttgtttgcatcgtgttaattccaaagaattatcaaaccgcattaaaaagggttttaacagcattggaccacatcattgtgagcacaaattgccaaagcaaaaagtgcctaagtccctaaggatcacaatgggccacgctggaaataaaattgggctgaagtactgtgccggcccaggcctgctagcgctcccgatactctaatatcaccgaagtgaaaaatgtctcttcgtcttccccgccgagactctcaccattttccccatttcctgctacagtacaaactgcgccggccaagctagggttcagcaatccgctccaatccatcctcaaacactccacaaaatttctacccgcatccaccgctccaattccccatccctttccagccgtatctcggaccaaatcaaaccatccagtccacattcatggcggaagagagagaaagcttcgagagccagtgggcgtcctccgatgtgacggaagataatctaaaggagatggtggcgcacggcgttcttccagcaaaggagatcatcggatggcgaccagcattcggcgaagcattcccgacccccgatacacacgaaatcgtggtatttgctcatttcttctatggcggattttctcttccaacctcaaggttcttccggggaattatgaacttctacaggattagcttgcatcatctgaatccaaactctatagtgcatatcgccaattttattcatgcctgcgaagcttttctgggcattaggcctcatttcgccttgttctgccgcatcttcttcctcaagccccagccaaacaaaagcaaaccatgtgttgttgggggtgctggtttccaactccggggaacgctaagccaaaaatacttctccatgcccttcaagacctcaaacaaaggctggcatgcaaattggttttatgttcaaaaccctgagcctgctctccccgagtactcctgtcttcctccagtttatcgggatacttggaactcactgccaatgggagacgaagctgcacaagcagtggaactgatggagcgcatgataaagctgaaagaacaaggccttcagggagaacagatcacacggcactttatcaagtgtcggttagctccaatcaaagagagatctcgcacagccttcgaatttgacggcaagcacgacccaaatcgtgaagatccagattctcttgacttcaaggtcatgaaggaaaggatgtataagatcttctctaatgctatcgttgtcagctattcacacttgctgccagtcgtgccattcaatgcctttaatcctcctccaccggtatgtaaccgaacacttcaacttttcacagaatacggtcttatctgtttgttgaatcagttaacaataaaggatgtcacgcccaggaatttgctctgatgaaatcggatccgccaatcgctcaacgccaatcacctcaccgccaaactggtcagggaagcggaggaccaagaatccggtctgaaactcaaccaagtgctcctgatccagtcggccagccaaattctcgcaagaggaagctggttctaagtgacgacgaaggcgacactgctagaaagcttggagaccgagaggcaaccaataaactgccgaagcaggctactccaaggaagaaaacatccagtcgtcttgtgccaaagatcaggaagtcttctaggtgcaactcatattacgatcttcattgcattgatgcgtacccattgcgataatagtactgacaatcaaacttgcaggaaaccatctgatatagacccatctggaaaagactctgacccgaccaacatggaggcgagttcctcaaaagaaaccgggccgactgcaaaagatctcccgagtgataatctgtaggccagcaacaatgtagaacccagcgacgaacccccgactggaaaccagtcggccgaagccgaagccggagttaatcaggagcccccgactggaaaccagtcggacgcagggccaagccaagagattctagaagttgaaacccaagcagacaaccctcgcggacaagacgccagcaatgactggagatctggatctcctttaagggcatccgaatccactcgtcctcgtccagaaatcattacgggtaaacactttgtctgaaaccatgttgacccaaataactctgatcaattgtctaacctttgtcagtggatacattaggaccaatgattggtgatgaagaagaaattcaccgtggtcaagtggatacactttgccgaagattcgtgctctcccattctggtcaagtggtgggatgacaacttgcaacctcaaggaattgtaataaaccggcaaaaagaagatgaagaagtctgcctactgaagaaggcactcaaccaagcgacttgcattgtaaatgtaagttccttgacacctgacctcagccatcatgtttgccgtctggctcgagcgctgattaaactgctctgcagaggattcatcttagaaacgaggcgaaaaccgcaacccttgagaaactagttcctcatcttggaacccttgaaaccaccaggagtcaactgcacgaggccagagaacttgccagaaagaatgaacacgatctgagggatcggattgctaagctccaggaatccaattttgaactgagtggctcatccaaaggttcgcgcaaactctgcccaactgatttgtgctgttatctctgtaatcttgattaaccgaagttaatgtagtgcaagctgccaagatatctcaactagagaagcagatccaaactctggaaaatgacaaggcagagctggcaagacagtgggattcggctttaaaggaggttgaaggtaccaataatcaatacctcaaaagccattatcttctatatgctgattcattaatgtgaatctgttgatgcagaccgcaagatcaagtctcaagcacagtttgatgtcttagttgacaagatcaacaagcttgaaggagccagggataaagtcgctaatgccgctactccactcatccaggcaatgttcttcaataacgccggttcgagtacacttgatactgccgaaatcttcgacaagctgagagtcgctccagatacttatttcaagaatatcaaagaagctggaagtatgggagcaagtctggcattggcgatgaccaaatccctttatccaagggttgatatggatgccattgatggctttgcagacgggacgagcgaagaagctgctcttgacctcattaacgatgcacagaaagccgctgacaagattgctgctgatgtggttgaaagattccaagaagtcgaccttcggccgactggatctgataagtctgatgatgaaaaaactgatactgattgatataacaatgattttgataattaatgatgatggaggctcaatttgtacaatactgatgaatttatgctatgcttggtgttccatacttagcttttgatttcttaaaagcctttatctagccttattgagcctaaaacccgcaaaagctattaaaaaccttcagtcctcattgactaagtcgaaagaccaaacagggcaatgataaatcaagtaagcaaattgaattgataaaaatcacactcaattattatcatagtagccccccgactgaaaacttcaaggaaaaacttgaggttagcagtcaaagaggaaagatacaaacgtaatgcctaagcataaaattgatgaaggtgttcaatattctaagaattgttgatgggagtaccatcttcgcgcttgagtcgataagaacctggctgtcacgcccggaaattcactagtaatttccgaacttatttgtgcattaaaccctcgtccaggaatcagccgaggtacacaaactgacaatttaatatatagatttatcacattaactaaaacgataaatacttacttaagaggcacttagtcctcaccatgaagaaaactgcagcggaaaaataaaatctagcgaagctccggctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccagttatagcatccataattatcgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccatgctggcttgtggttggcacggtaaatgtttcacaacagtagctcgcgaaccggtccttaattgtcatgagcacaaccatcaaaaccatatgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgtaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttaccatgatttagttatgaatttccgaagatttaatctattagaaaaacaggaaaaagaaaaacgatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaacgacgacggccggcgactcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaggcggcgcaaggtggcggctcgggctcggcctggctgcagccggctgaaggttagggacgacactgtagcagggaggcaaagtagacttttgacgggcttcattttcctcggcccgattgaaggagggaggcaaaacagactttgacagagagagagaggagggggcgggcggcggcagctgggccgattgggccgattcggccgcgcggagagagaaagagttgggccgaaatcggcccaacgacttagggaaggatttaaaaactttttccaattaaaataatcacttaaatgatctttcaattgttaaaaatacttccaatgctcaaataatttcaagaaaaattctgaaaatacttggacactcaaagtacttaaaaaaattataattagaccatttaatgattaatttaatatgtgggtaattactgaaatgctctttgtatgattaaaattaagaattgagctccgaagaatccgagaaaattccagagagtataattaaccatggagaatttaataaaaattaaatccaaccatgctttatatttaggaaattttatttcccacatttaacttcacttgtaaattaatgaacatttaatataaattctattattaatttattaaataatttataaatcctgaaacgaaaatcaggatgtgacactggccgagtaacttcagcaattataaacggtccttcccataagggagataatttatgccgatcctgtgtggtttgaattttcctcagaaccaggtcgccgactaaaaaggctcgcgatcgaacattccgattatgataacggcgcaacccttgcaaataccgagtcgactgaattaaagctgcttcacgggcttcttctaatcgattgatgtcgtctactcggccctcttcataacgctcctcgttgaagttccaaaatcgtagtgattcaaattccacttcacttggcaacattgcttctgcaccataaaccaaaaagaacggcgactggccggtagcccgactgggagtagtgcgtaaagaccaaagtacggacgacagctgattgacccacttgccagcatagggacgtagtcggtcgaaaactcgtgcttttatcccttgaagtatcatgccattagcacgctcgacttgtccgttactcatggtgtgtgccacggtggcatagcaaatttttataccgaagtcttcacaaaagtctttaaatgctccgccagtgaattgagtgccattatcagtgatgatccgattaggtaccccaaaccgatgcacaatgttaatgaaaaaatatctagctttatctgccgtaatcgtgatgaccggtttagcctcaatccatttggagaatttgtcaatagccacaaagagatgcatgtaacccccgactgcccttttaaacgggccgaccatgtcaagcccccagaccgcaaacggccaggacaacgggatggtttgcaactcttgggctggtaggtgaatttgtctggcaaaaaattgacaaccctcgcacgtccgcacaatcttgtcagcatcagatacagctataggccagaaaaaaccttgccggtaagctttgccgacaatagtccgtgcagcggcatggttaccacaaataccagaatgtatatccttcaacaattgtcttcttcttccaaagacacacatcgttgcagtattcctgatggacttttcttgtacagataagtttcatgaataatgtaaagtctgctgcgccgagaaatccgctcggcttcatttttgtcttgaggaagttcttgtttgctcaaaaattttatgaacggttctttccagtcggcttcgatcatgctcacgccttgagtatccatggcttcaattgtctcttttctgggcacggttggttcgtaaagatgttcaacgaacacatctgatctgaaggagctgcttcccgttttgaaccaaaattggccagcctgtcggctgcctcattgttatgtcgaaggacatgggtgagctcgagtccatcgaatttgtcttccaacttgcgtacctcttgtcgataagcggtcatagtatcatctagacaggaccactctttcatgacttgattaacaaccaactgagagtcccctcggacaattaatcggcgaatgcctagagagatggcaatccttaatccatggagtagcgcctcgtattccgccacgttatgggacgcagaaaaatgtatccacaatacgtagctcaatctttctccaatcggggagattaaaacaaccccagctccagtgcctgtaagcctcttcgacccatcaaaatgcatagtccaatattccatcttttcctctggcatgtcttcttggcactcggtccactcggcaaggaaatcagctaaagcttgtgacttggtcgaagttcgtggtttgaacgatatgtccaaagacatcaattctaaggccaacttcgcaatccgtccgtttgcttcgcgattatgaagtatatccccgagtggaaacgatgtgaccaccgtgaccgagtgactttgaaagtagtgagataatttcctgacggtaattaagacaccatataataacttttgaacctgaggataccttgtcttggagtcggctaaaacctcgctgacaaaataaattggtcgttggactttttgaatatggccttcctcttcatgctcaacaaccaggatcgtgctcacaacctgggaggtcgccaacacatataacagtagcggctcttgtggatgcggcgaggccaaaactggtggagtggtgagaagtctcttgaagtctttaaaggctttttgtgcttcgggtccccactgaaaattgtcagtcttcttcagcagcttgaaaaagggcatcccccgctcgccgagtcgtgagacgaaccggctgagtgccgccatgcaaccagtcagcttttggacgtctttttgggagcttggcggtttcatgttaaggatggcgttgattttctccgggttggcctgtatgcctctttgagatatcataaattcgagcaacttccctgacggtactctgaagatgcacttttcagggtttagtttcatcctgaaagcatgaatgcttgtaaaagtttcctctaaatctgtgatcaggtcatccttctgcttggtcttgacgactacatcatcaacataagcttcaacattgcggccgatctgagtcgagaaatatctctgaatcatgcgttgataggttgctcctgcgttcttcaatccaaagggcatggtgatgtagcagtaggccccgaagggtgtaataaacgaggacttcaagcagtcggattctttcagtcgaatctgatgatatcccgagtagcagtccaagaaactgagtaactcgcagcctgccgttgagtcaaccacctagtcaatgcgaggtaacccaaaagggtctttggggcaagacttgttgaggtcggtgtaatcaacacacatgcgccattgccccgtctttttccgaaccaggactgggttagccagccagtctggatgaaggacttccttgatgaagcccgctgctaacagcttggttaattcctccttgatcgcatccttcctgtcctgtgcaaaatggcggagtcgttgcttgatgggtttggcgtcttccttaacatgtaaagagtgctcaatcacctctctaggaataccaggcatatcggatggtttccatgcaaagatatctttattattttgaagaaaggtgatgagcgcgcattcctatttacaatctaactcagcgcctattacagcagtcttatcaggattagagggatctaagggaatctttttcgtcttagcattgctttctccgcttttgagcatcttggttgcgggcacttctccttcgcttgccatggtcgtagccagtcggatctcttctcggtcgagtgtaatctcgcgggtctgggccatctcgcaacgttctttgtcacatgtgacggcttgcttgatgtcgcttcgtagtgatatgactcctcgaggaccaggcatcttcatcatcatgtaggtgtagtgtgggacggccatgagtttggctagggccggtcatccaagtatagcatggtacgctgtctcgaaatcagcgacttcgaaacaaacattttctatgcgaaaattctcccgagtgccgaaagtgaccggaagagtgatctggccgagtggtgtagctgataatcctgggataacaccgtggaaggatgcattactcggctttaattccgtgcgaggaatctgcatatcgtccagggtcttagcgaaaaggatgttgagtgcactgccaccatcgatgagagttcttcggagcttgacattgcgaaccactgggtctagtaccagggggtaccgccccgggtggaccactcggtcgggatgatccgagcggtcaaacttgattgctatttctgaccaccgaaggtattggggcatgttgggctgaatcacattgatctcccgttctgttagcttctgctttctcttagattcataagccagaggtccaccgaagatgtgattgagttctttgcgatgatcttgaaaaccagtcggggcatcgtcttcatcgtctttcttctttgatgtgccttgctctccgtttgaaggcttaagtgcattcttgacgtattgctccgcaaattgtttgtagacgaagcagtctttggccacgtggttggagttaggatgatgcggacattgggagttcattatcttgtcgaatgtgttgacgcggggacgttgtcgggaagatggagaggttgttgccacaagttcttcgggcttacacttgcgatccttgcggttgttacttccactccctcctgcggtcggcgtgtccttctttggcttccaagtggtgcctgactgcttggacgccgtaatagcatcttcggctttggcatactcgttggctttttcaaacatctgcttgaccgtcttgggaggtttgcgtccgaacttgccgactaggtcctcgtggcgaatgcctttagtaaaggcggcaatgatgacgtcgtcggtgatgtcggagatcttgttgcgttgctcggagaagcgccggatgtaatctcgaagggattctccagacttctgaacgacgttgtagagatcaaactgtgtgccggggcgttcaaaggtgccctggaagttggcgatgaagtgatcacgaagttctgcccatgatccgatcatgccacggggtagtccgtggagctaggatcgggcggaatccgctagagccacaggcagatagtttgccatggccttgctatctcctcctgctgcgtggattgcgagaccatagacggtgagccaagactcagggttggtggtgccgtcatatttctcgatttcagtcggcttaaagccggctggccaatccactcgacgcagatcgcttgtgaaggcagcaacgccgtccacatcatcgtcataacgatctggtgaatggtggcctcttgctgcgcggcgctggttgatggtgtcgcgaagatcgatggggcgccttcgatgtggggagtgtggtcgttcaactcgacgctccctatatcgttcgggaggcgaacgaacagaccgttcatcatgtcctctgctcctgcgactagatccggcgccggcaatgctgaggcttggctggtgatagtcttgagatcgaagatgagggacttggctactagtcggggtgcgggtgcttgcagagttggctggaaccgaggcagcgatcatggtcttcgtctggttcaagatgttgacaacatgatcagcttagttgagtgcgtcttccttgaggagggtgtcgaggagagtgattgctgcaaccgcgttctgctgggggatgcgaaagaccgctgttccgtcgacgtcttgttgcccaatgagctatctcgctcgccgcccggattccaaggcgcgttgccgtcgatcttcagcctcctttgcaatcctttcgtgatcttgttgctcacgctgtagtcgttctcgctcctgtcgctgtcgctcttcctccagtcggcgacgttcagcttcttgccgtgcgcgatcttggtccgcttctcgggctcggcgctgttcctccgtttcgttggcagccatgaatacgccgaagaagaggggcgtgtagttatcctcatagctgtcgtcgaagttgtcgaggtcgccgtggtcatagtggtagccgaagtcgtcgtagtcgaggatcttggttggtcaagaactgacgccgggggagctgaggtagccatccatctcttccgtcgagactgtcccaagaggttggagtataacgccaacctccctggatctagactagatcggggccgatgccggagctcgcctagatctccgagtgggagatgttttggctgtgaagacggcagccaagtcatcaggaagtttcatcaagattgaaggataggacccgtcgtcttgatctggtcgcggaggagtagattggatctcgtccgagtggtttgaagccgactcggaagatatgatcttggagtaggcctcggccgagttcggaataccaaacggcacggggacctggtctctccccgactggttcgaatccgagtcaaggagagagatcttgccgaagtcgttggtgatgaagttgaggctgccgaaccagaacgcctgcccgggagggaaggcgaagttgtcgatgccagaaacggaacccatcgcacttagtcggcaaaaacttgacgctgcccctacctggcgcgccaactgtcgaaacaagatttcggcaataataaaagggggtggctatcaagctaggaaagttgatggttttggagacaatgaattttatacaggttcaggccttcatattcatgaagtaataccctactcatgtccggggatgattccgccgagtacgttattgattgtataaattggaaaaaagaatcgcgccccgagagacacacggaccatccttatataggggaaggagtccgctttacaaaatacaactcttatcgtaacggaatatgggattatagataaaatacaattgtaaccgactaagatctcgggtatttccttgacatacaagtaaaaaactaacccgagtcttcataaagatattctatctatatttggtaccgtatatccgattaaattataactgtcatgtagatatggaatatccatattctccacagttaatttatcgatataattaaagctaggtagctatagggtgatctacataaaaaggcaagggggtggtggtggttgtgtttagttcgatgatttcgtcgtcgtcatcgtcgtctctactccctagacaaatctctagacaaagacgaagacgaagacgaagacaactagctctgcaagctagcacatctgcacatgcggcatgcaatacatctagctagcaatggaggattagttaattgattttagctgatcttgtgtgttcatcagtttagtattcactttacattacaattcttttaagggaaaacagcacgagattgtgcctttacattacatgattacactgatcttgcatatgatgggtaatgggttaatttgtaatgaagtaatccatagtccatactagatacttttacggcatacacgctgcaagttgggatatatatggactctgaggaagctgacagaagtagtagatgcagtaggtgaagatcagctggcttggtttagatttcttcaatcttgtttaacacttattttctccatcccaaaatataaaaaggactatgatattcgatgagacacattctgctactatgggtctgtttggggagcttttagcagctgtagcttctcctagaatctccagtacttaccacttgccagaagctcaccaaaacagtccagctttttatccaaattctaagaatttgtggttgtagaatctggaaaatgaactagaagacagaagctgggtttcccagcttctccagattctcactagctagtttctcagttgctgcttctcaaaattttaagctcccccaaacaagccttatgaatctggacaactctctattcatattcatggtattaggatatgttttattcaccaaaatcttctgccttatattttaggatggatggagatacttggtggaaatgcatgctttagttatttaaattttgatgcctcttctacacgtgcctccattgatcggcaggggtataccgctatatatgatatatctgtgggcttgattataacaactcaccttctcatgcatcgtacgtgctgtcgttacttctttttttttgtttttttaaaaagatcaagattttgtttggtttaaaattaagctgccgttgtaatgcttgccaaatagagattattatgtggtgtgtctattccagccaacaactcttgtctcgatcacagatcttcctgtaacagtaatattaagctaggtaaaaaattatctaaattttataaaaccccacttatcatgagccaatttacataaaaccatagattttagcatgtgacacataattatggtccaaaagttttctaaaaccacactattagtgttaactgttaaggataagacatacctcttatatttgggtttgtgctatatgaaagtaccacatacctaataatatacaggaatatatagtcaattaaggtaatacggtgatccgaaaggaaattgttttctagggatagaagatgtcaaagtcatattcagagaaaataaggtcttcttggaccatatctaattcaggttctctgatttctactttgagaaaaagatgatcatccctataaatacagggtcccaataaggggaggatattgaattacaagccataacaagagcaatatcgagatacaattcggaggaagccaaagccctagtcgttgattgtaatctactttttccctgatatacatataaatggaagtagggttattagtcatcttaaggccccgaaccaatataaacacttgtcccttgtctgctagctagatatgatctcaacgtttttcatactctacaaatatcgtaggtgggcaccatagtccatcaacacatggcgttaaccaaatcgacatactcctatatcaaaattcaaaattgtatgtttacatgtatgtaacacttatataaggaataaatagcttataattcaaaatgatcaatagtgtggttttgtaaaacttcatggccataataatcaaggttatgtgttacgtgtcaaaacccacgtggttctgtacaatttagaccataatagtacatggggttagttgaaatttactctaaattaatttgagtcttaattcatgggtaaggtaaagatcaaatataaaacgtacttcctccgtttcacaatgtaagtcattctagcattttttacattcgtattgatgttaatgaatctaaacatatatatatatctatttagattcattaacatcaatatgaatgtaggaaatgctaaaatgacttacattgtgaaacagagagagtaccgatgaaacggcccatatctcgatgggcctatttacggcctcttctgcaccgacgagcaagacagaccgtgcggaagagggccatgctagtgtcggtggctgtggcgctggcggccgccggagatgggggcatgaatacaagaaaaaaaaatccaagcaagcaaacactttaaaatttgtttgcatcttatgatgaactgttttcttgtgagattttcttttgtcgcttcacagtttcttggagacggtcacccgggccaggtggtttccaactgaattaagctcgatagatccatgtgatgtgccgcagtcactgcaaccagctgcaatagatgcttaaattcgtaagtgaactcacaataattcttttcttgagcgaacctttcaaactatatcatgttgccattggattttaattaagttgtaatgttaaggtactgcctccgtttcacagtataagagattttgattttttttaatcatcttttatatgtgcaagttaatttatgtccatcctgctaattttttccccggttagatgtgcaagttaatttatctttctcaagaaaacgagataaattagaacaaacttttgttaagccacttcatcaaagcctcgttgtagaaacgggtacaaaatgcatatgtaaacaattatgaaacctgaatgtgaacaaactgttttttttagaacgataatgccaaccatgccatattacagaagtttttgtgattgtctcgagtagtctgaaaacacaagtttttttttttctacagaggcaacaagtttgttaagggccttatacagcaatttcatggatgtttgttgccaaatgttaactatttcctctgcatactactacacgcaagtataattatattgcttgatttttatagaagaattatctccgtcccataataattgtatttctaccattcaaattttatcttaaaaaattgtatttctggtaagatgggacacaacaacaaatggaatgtgtacccccaaccttcattttaattaagtttacatatcgaatgtgttgctcaactttccttttaatcaagtatagacatatagaatatgcgcatgcagtgtagttattaaatatatatggttattgtgataaattgtgtttgatgttaatctatctctaatttctagaaatgtaattattatgggatggaggtaatactatgtgagaagtgtaacgtagtacattccacataaataatatcttcacaattgtcaatgtttccatttttttacagcatgttttttttgtgcttaatttctttaccattgcttcctgttcatttatactacattgttggcgctgaaaatcttaatgcatcacgcaattcattttttttttctaggatttggttcaaacatatattttttccctctaggagcatatttttgtgcacaactgatattgcaccgtgtggactttgggcattgattgactagctatgatgctgctggttaggaccttgctttcagtctttccttgtacgtataatgtgccaaattaacttaacgcatccttcagtttggagaactaaaaatagccaactagtttggggtattttagtgatagtaacatttttcatatatgtacctcaatactgtccacacatatacacaatttaaatgcaaaacattacaatctcttattctctttcggttgttcactcggtctacaaggacaggtcaatgaaatatccattgctcatgaggagacaatagatatccatgattccctcaatcactgcttcacacttgtcctatcccttgcctccataaataggtcatgagtatatcatccactcaacacaaattaacacaaattcaattctaagatcaaaatggcaagaggattggcggtgatgagtgtactcttatttgtgttggccactactactaaggctgacatggaaggcaggtctaggcccaacgccttaggcaacagtttagtgccgacacacctacacttctacttccatgacaaggtgaccagtccgtcaccgtcagcggtgagggtagtaaacccgccaaacaacacatcgttgaccttcttggggatggtggttgtcatggatgacccattgaccgaacggcccgatcccgcatcaaagctcgtgggccatgcccagggcatgtatgtctcgtctgaccaagcccggataggcttcttgcaggccatgaatatcgtgctcaccgctgggtcgtataatggaagcgtggtcatagtgcttggcagcaaccacatatccgacattatccatgagatgccgattttgggcggaaccggccactttcgcttcgctcgtggctatgcccaagcccgcacctactttctcgacccaaacggacttgatgccattgtcgagtacaacgtttatgtcttccattgatcttcatgctaggttggcttaattgttgatgctattattccctccgttccctcttacttgatataagatactattcatgtataaacttggaccactcatctttatgaaaaaaaaaggtataaatattctattatcaaagtaccagtcccgacattccatatggcttaacagtttaacatgcactgtgttgactagtgcaagccatatggaatgtcgggagtactaaatttctaccacatatgtgccccgtgtaataaggaagacttaattcatgcaaggtttgctttaattactaatcttcaaagtttgaagattggtctacgacaacgttgtccatttcgggccaacgcactgtgacaccgcccatctcgcgtcccacgagaccgtggcgctcttcgtcgactcgtcacgccatcgttatattcgtgcaaagatttagcgatatcaatggtatatttgtgccaaaaaaaattacatcctaatatatttccaaatttaatcatccttctagagcgtatagattaatttggaacaagaattgtacactatagaaaagggaccaaattaatgctagccccgcgacaccgccgcttgtcgtcgcgcgcactgcgataccgcggcgacgaactcaggtgggtttccatcaattaactactctaattgatatctgttctgaaaaaaaaattgatatcattagtaattaattcatttatattagttaccgatgacatcacgccgcacatatggcgtggctagcgccgaccagctcaacacctcttgtttggcgtcgagaacgacccgtgcggcctcgccatagacgcagagctcgggcaccgcccatgcgccttggctcctcgcctcccttcaccaccgtggagcgggtgattgagctccttggctcctcacttccgatgacatcgcaccacgcacatggtgtcaccggtgccaacaggctcaacacctcttgcttggcgtcgaggacccacacggcctcgccgtaggcgctaagctcggctgccacccatgcatgtacaatatcgtcccctgcctccaagaagaccaagaagagaagaggagggaggagagagagaaaaatagaaagaagaggaggatgcactgacatatgggtctcacactgaatcagccggtcaaactaagtcaatgagctacattagcaaaaaaaccgctctcaaaaccatcaagggggtcattttgcatcgattttaataattagaggagcgattgagagataagaattagattaaaactatatatatttgaggaagccaatgtgaacttatgccaaagtggaatatatttgattgggccgcatgcgtagcccaaaatgtgtggcatctgatgtgggttagccatgccggccccaagctgcagcaattgtagtagggagtacctatgcatctttcgaaagatttttataatcatatcacacagatttttaatccttggattaaaatccaatagacacagtaaaatgcaaaaaacaactaagaaacaccataatggacactatatttccatatcttcagaaaaaaaagaccaaatccaatataaatttcaaaacttatatgcgaagattcaaaaattacactgtaaattacaaaagttacagtgtaaatttcataaattacattgtaacttacaagaaaacacactgtaaatttgagtgagaaaatcgagtgagagataagaaaaaatctttcgagtgagagataagaaaaaatctttcgagtgagatatagcaaaatcgattgtagtaagcaagcgaagcaactgtggcatctcttcttatattcttagagcaaggctaatagtatagccaaatactagcttcaaattatctatagccaatttatacaattgttgcttactatactattaatacttagtctcacctgtcatacacacattatgtcttggagtccgcgctgcagctggctacaaatctgtagtccgctgctcttctttcttcgcttttatatctctttaaaatatgtttgtaactggcttatagcctgctattgtacatgttcttaagttagctcacagtaaattgtttccaaggaaacccattaaactacaatatttgatcttgatttcttaagttataattttatatattttttctaaataaggaacatgtgcaatatacttagaaaaagggatttataagattatttggcgaaacttattttctttatggtgctctctatcgatagtaaaacttcatccaaaccgttaatttattttctatatgaaaaggttagatacttttattatactaacacctccattaagtcgttaacggtagcagaaattatcaacggaaaaatcgttttaacaaataacggcatggaggggtaaaatcttttgtcgctctcgttcacaatcacaactcctggggcagctctccgccactcagcaaatcggaggggactcgactgctgtattctctctcttcagccatcggaaaaatatttttcccaacaatagtctatactaggaattttgaaatattggaagctataaggtatttatatgtggctgtgaaaaatgatttttctctaaatatattacaaagttatataaaccttccaaacgaattgaatttttttccaacaatttttttacagcataaatatttttcctacaattgttttatacaacttctgaaaattaaaagataaatcacattttcattggttctcttatagtaacttttagctacacaggggcatatattggtttttgtggacaatatgatggtcaactgacattgaccaccagaatggcaaaagaggatggggcactaatggagtagtggtaaaagagagaaatgcaaaattttgatggcgggacgaaaaatacggtttcaataagtggtagaagaaaaaaattcccaactttaatcgacatgcaagatcttgaggcaaagggactgactatgtaacattcacaagaaaatgcttcctcatttcagtcacttttggatgccctggattgctttaagattcgtactattacagttcttctactttatcatcttctctgtcgttctcctttacacaatgcttcaaatcgcgcctaatctcgacgataatgttgcctccctcgccgattgcgccttccccggccttgccctcatcagaaggcgccaatggtgccagtgaggccatgtcagccatcatgcaccccatctccccctctctccctctccttcccatcatgcggtggtaaggtgccccaccccattgttttccacacctcctaactggtcaggaacccacacccccgctaccaatgttggccaaccacctgctaacgatcccgtggctttagctccacccacatgttctgccacccacggccgtctcgctaagccctgtgaacttcccccgtcccccgtccccccccccccccgtccccttccaccccaacttcgaaccctaaacctaaatcggttgggctgtcgctaatttcttgagtaagaggagaagaccccggcatgaatcttgtggcgaatgggacagcagagaatctgcaaagattcctctaaaaaatctatcgaattaagtctaacaaatattttttaaaagggttaattggatccatgtgattacgagtttgccgtattaaatagggttaattgatatgcttaactatcgtgtaggagtatttcttagctcagcttcagctccaatatttgaaatattcacgagcatccagtattcactattcagatcgtatcgtgtgttttgtgaaatcggatgattggcgttcgttataccatatccccatcgattctccaaaagaaaacattaatagagcattcagaattctttaaaaaaacagagcattcacaagcaaaggatccccttaattaattctttcagatataaaaacaaccagcaacattcattgggtcatcagagtagaggagggtttggttttttttcaagttctagatttgaatgatagacgatgacagcgatgcgtctacgacgacttcatcaacctcaagatataccagtcaaatctctcagaggtccttcaagggatagagtgtgtatgtgcctttataaggctaagtgtgtgtatgtgagcgcctaatgtgtttttagaaaacaattatttgaagagggaattgatacaatttgtttcagtgtcttcgaaaattgatgccatccttcctctttcaccgaatcatcttttatatatttggttcccttccttcgtgtgcaacttaattatttgttttcctgtttagaggtgcaagttagttagtccatctttctcatgaaaacaagatgaattagaacaaattggttgagttgctgaaagatatccactccaagctggctgagctgcttcagaaatgctggcaaagagatcgattgagaggcattggagatccttcaagactcctcaaatgtgccatttcttttttcttttaacacaatatatatgtaggtgcttataacacgcacatactctcatttcaataaatgcacatgcacatattctatctctgtaagcacatttaaagactgggttagtatatcttaaaatcgataaagtcatatgacatatgtctcactgtcgatggtatgttttaatgcatgtgtatcttaatttgttattactccctctagtcatttttacttcatgttgggagagttaagcttagctttccccgcatcaaattaaagtgataggagggagtatctaattatggcaaatatcatcaagattgtcaagagcttcattttttttacagtatgatatttttgcgcttagctccttacctttgcttgctcttgagtatattatgctccagaaatcagaaatgtacattctgttctagcgtccgatgctggcgcttaaaagcttaattcatcacgcaattcgaaatttttttctaggacttcgtttactctctccgggttgataatattagtcgttttggacaagaataaagtcaaactttaaaatctttgactacaaataatttctaaaatatttatcttaaaaatataaaaaccatatgtgtagattagtcttaaaaagtacttcaataaaaccatatatttatattataatagaaaatagttgtcaaagttactttttagagaccgtgtccttgttcaaaacgacaagtattatcaaatcggagggagtaatttagttttctctaggagcacattgttgtgcacaagtgatattgcaccgtggactttgggcgtggttgggcccttgctttcagcaaactacaaggcatcgtccttcggtttggagaactaaaaattaattaaccaactagtttggagattcggggtactttactgaaagtaacacatatatttcttatatgtgcctcaatgttaaccacacttaatcatacacaatctaaatgcaaattaagtaagcattacaatcttttattctagtctttcggttcagtcgatctacaaggacatgtcaactaaaatgtacttccaattggtcatgagcaacaattaatagatagccataattcctccaatcgctgctcgccacgtgtccctcctccaactcatatatagagccctagagctcccatgcctctataaataggatgcgagtgttattcactcaacacaaactctaagatcaaaaaatggcaaaggaaatagtagtgatgagtgtgctcctttttgtgctggccgccactactaaggccgacacgcaaagcgggtatgggcatgggtgtagctccttatgcaatagttcagcgccgacacacatacacttctacttccatgacaagattaccggcccctcgccatccgctgtgcaggtggtcagcccaccgaacaaaacatcaccaacctctttcgggacggtgtatgtcatggatgacccattgaccgaggggcctgacccaaggtccaagcccgtgggtcgagcccagggcatgtacctctcatcagaccaagtccggataggcttcctacaggctatgaacatcgtgctcactgctgggccgtacaatggcagcgtgataaccgtgctcggcagcaaccacatatccgacagtatccgtgagatgccggttgtcggtggcaccagtgctttccgcttcgctcgtggctatgcccaagcccgcacctactttcttgactcaaatggacttgacgccatcgtggagtacaacgtctatgtcttccattgatcttgatgcacgcttaagtttgtcttagttaattactgatggtgtcaagagagaagctttatttaattctaccacatatcttgtgtaataagggagaattcatgcaaggttggatttaattgctattctccaaggtttgatgtgtatagtaggatatacatttggttccttttctatggactggtacaacttttgtttcaaattgaaccacatatatggtacagaagtactactagactagcttctatctcaatagttaggttataagtgggtcaactcgtgaatccacttataggctaaataagtagtaaccctggatttagtctataagtgagtttacaggttgaccctgttacaatcttaggtctcagtctttgacagatcgacagtatagggtgtctgatgtaatacccttgtgtttgtttctttttcatgttcaaatatatatgcaaagaaaaaccattaatgaaacaaaatctgagaaaaaatagatattatgaggaatttataagtggccatagccactagcaacttgccaatagataaagactctgaattaatgcttgcggtcaaatctccaaattttaattcacggtaaataaaataattccttcttgtaattgcttaaatatttcttttatagtatatgattttcttaatagtactgggacaattgctagctttatcttgtgcatcaatcttgtgttctaactaatacatgcatgtatgatgtatgcaagttcttttatactctctgagactctctgtggctcagcgtgcatttaactttgggtgtggttaacagctcattagcaacttgcttagaggctttccatgtccatgtaatatttgacgaggaaaacaaatactccctgttttcaatgtttgacgtcgcttattttttaacttacttttgactacctaatcgtcttatttaaaaaattttgtacaaatataaaaatataaaagtataagtcatacctaaagtacaataacaataaaataaaccgtaacaaaataagattaattatatttttttaataggtcgagtctccaaatatatgtataaaagtcaatagtgttaactattaaaagccagacggcatactattactcctatacttaagtaaccaaaccaagtgtatcggagtattttacctatagtcaacactgtatggatcgatgtgcctcaatactgtccacatgtatatacaatctaattgtaggtttatatttaaatatcactcgatcgatctacaatagttacaagtcaactagaaaacttccatctatcatcgtccaaccctctagctcttagagctccccatgcctctataaatagctcatggtcgagttatatcactcagcacaaccactctaagatcaaaaatggcaaagagattagcactaatgcttatgatcttccttgtgctgggagccagttgtaagggccacacacatggtgggcctgggcctagcccctcaggccatggctccgagccgacacacctacacttctacttctacgagaaggtcagctgcccttccccatcggcggtcacgatggtgaacccgccggacaacacgtcaaataccttgttcgggatggttgtggtcctcgacgacctactaactgtggggcccaattcgagatccaagcccgtgggccgagcccagggcatgtacgtctcgtcagaccaaacctggatcgggctcctgatggcaacgaacatcatgctcaccacctgtcacaccccgaagttctcctcccaagccaaaaatttaatttataagcgaccctaagaaaataccagtgcaaagtaagagtaaacccttttaaatcaatgcaaataataatcggaattggcatgtggaatttttcttgagttctacatgtcgaaattcactaacaggatttttagtggaattttcagagccctagaaataattttaaccaattaaaattgagcaagcaatattttaattccaggaaatccttttctcctttttctttttatttttccctccctttttcgaatgggccactggcccattctctccttttctctccctcctccctgctgggccggccgcaggccgaggcccagccaagccgcccctccctctctccccgggacgccgataggtgggccccacctgtcggacccgtcaccttcctccagccggcgctgccgcgcccgcaaccgccgccgcgcccacgcctccgccttctccgggccacgtcagccacgtccgcgcgtgcgctgcatctcccgcgcccactcccctctctctcccgcccgcgcccgcgcccgagatggccgggattcgattttcgaatcccgcctctctcttctcccccactccccacgttggccggcgaaatccctcccctaccggccacgtccggggctcccctcccctatttaggcttccccgtcgccccctctcgctttttccccatttcgccgaactctcccgagctccccatcgctcccgcgccgtgcaaccacccaccgccgccgtttccactactccggccgccgctagccgccgctagggtcgccgccgcaccgcgccgtcgccgccgtcgggttcgcgaggctaagctccaccccggccgccccttccccgtcgagtttcgtcgccggaattcgcatcccctcgcgctccggtgagttcaaccgctaccgccgctttcggccatgaataccggtcgccgtggttcatctccctctctctaatctctctctcttccttccttagggcaccccgaagcctgtccgccggttgccgtcgccggtaacgcgttcgcgtgtgcgcgtgccatcgccgtcgccgcggccggtcggtcggccttgagccaagccgagccgggtcgccgccgccccttcctccccccctgagccgctgaccggtgggccccgtgtgccggcgccccttcctccctctcccgagccgctgaccggtgggccccgcatgtcggcgccgccccccccccccctccgtgccgacgacagccctgggatttattgcacaataaatgatttaaggtttttcttttatagtaataaacacagtgaatcttctaaaactcataactaattcatccgagttccgtttaagcccattcaagtctcagtaaatcatgaaaaatgtgtagaatccattaaaaatggttttgttccctgtttcagtagtcttatagcctgtttgcaatgtttgctttgtatgtcgctagattccggttcctccgacgctccggtgtatttcgaaatagtcgccgaggttcctccagcagcagagcaaggcaagtcatgcttgtcacttgaacatgttgatcctatattgcaaatgctctattgttttctttcaaatattgcattgttttataatgtttctatggggtgtttacctgttgtcatagccatgctattgttgtaccatgtttctttgtcagcttggggttataacatgactagagattggactagggattgcttagccatgcttagttcaactagtgcacaatggggagaatccttttaatgtttagactgttggttctaatggtcttgttggattagtgccaccgctttggtgttggttaattaaaataaatcacatggtgggctgtggatgaatggttttgctggtcgcacccatggcagttaaggaccggttcgcgggatgccctggaagaacttatcgtacttaccacaagccagcgtgggcaacggctgggcttgtagtgtagctttcctctagtcaacgcatctaggcaagggtgggcgtgatggagcggggcaggccctgcgacggcctctgtcgcttccggattcacctaggcacgagaggggactgcccactgccttgcgcggagtgggggtgaaacctgaggtgtggtgtgcttggttagagggggttatgcgaagggtcctgtcacggcctctttccggtatgtcgtggtgacatgtcggcgcactgtaacgtgtcgtggggctgtgtcttgtgggtacagttgtacacctctgatcagagtaaaactattcgaatagccgtgcccacggttatgggcggtcaaccagattcaccgtgattagtctcaccctagtgtaatcttttgattttggatagtttaggtggatggttgggcctgttgcaacgtgggatagcgttggacagtggatagttaatgttaattaattattacaactgtttaaatctttcaacttctgtttttaaatactcgctttatgcaaagaaccactttagctcttctttgataattccctgcatcatgcctctattccggtatgacttgctgagtacagtgggtagtactcagtcttgctctattttccccaaccccagagtacgagtatgtgtcagatgaaggtttctccgaggagtaggctttgtccgtgccgtcgaggatgcctgtggagtggtgttcccgctgcagatctagtcaaggcttagctcctgttgtctttcgtttttccgctgcatttatgtaagacttttaagatgtttgtaagacgtggatctgaatgtcaacattgtcgtttgtgtaccccggccggtcctggacggggattttaatgcacattctgcttggaattctattcgggaatttctgggcctaacaccaccgggccgtacaacggcagcgtgattaccgtgctcggcagcaaccacatagtggacgatgtccgtgagatgccgatcgtcgaaggcaccggcgcctttcgctttgctcgaggatatgtgcaggcacacacctatgtaggatcaaatcacaagaactaagccaacaagagagggggtgaatggttggtataccctaaaaccgaaaacttttagcagaaataaaagttaccctcgaaatcgacggaagtcggtctgaccgaagatgttctgccggtctgaccgagttgaatctccggtctgaccaccgagatcgcttgctgcgcctgtcaccgccgccggtctgaccgccgtgctcccgccggtctgaccgccgcaatgccaccggtctgaccgccggtgacttaccggttaaaccgccgaaacccggtgaaacacaaatcgaagaactcttaaagtagatgactttattgattatctctatgtttacaaagtgcaccaacagcactccttacaaaaattttgactaaacgcgaaatcctaactcaaaactcaactcaattgctctcaaaagcgataccgggaagcctcacgctccccctctatttatacatgaggtaggtagcctaaaaccacgaacaaaactcatactaagagtcctaaacacattaggaaaccctatagtataagaaagaaactttacataaccaatcgtatcaaatttggactccttccaaattcgactctgcatcccatacgcacacaatacctccatcgtatgccatatggaatccctatcaaccacgtgcatcaactctagcctaagtatcccgcatgatctctgaccaccacggacgttgtcttatccccaagtcgactcccggtccatcaccgcaaatactctctcgagacatcgagtcacctacacatgaaataaacaaagaaaccatattccaagaccaagctatctctaacttgactcattagtagcaaacaacagtattacatacgtatagtatccatctagaagtcataaccatgaaataatcacggatatccaaataaacaacctgaaactgaaaccgacacagcgtcggccggtcagaccgcgggccggccggtccgaccgctcgatcaccgccggtctgaccggcacacactgcccggtctgaccggtaagatgaaataacataagtatcctgtagattcacctgtgaaatccaatcatctccaaaaccacttcgtgaataaattccaaataacaaaaccaataatctccaatgcccaattgttcatcacagaataataatcaaaaacacctttgatcttacaatctcccccttgatgaacatattggcaaactcataaaaaatgttttggtgtttggaaaaataaaaaacaaaagtggtaaaaagcacacttcgtacaaatgtacacatcgtgcttgaaaatccaaaagaaaacttctccccctttttaaaagaaagaaattcccaattgaaccaaaaacatgctcttctcaacaactcttcaaaaattttccttgcttctccaaaaatccaaaaatccaaaaaaaaatttcacattacttcttccccttatgacaatgatttcatcaagcataggaattatgttcattaatgtataagagcttagcatacatatagcatatcaagtcatgtgttgcaattaaaagaagatgaacccatctataatagaacaagcatgcattaaagtataaccatgaaccaaagattttacaattaagcttaaatcaacaatcaaaattcatgatttcatacaatttataatgcaacatcttaacaagcacataggttgaaaaataaacactaaacacatatacctattgcatttatcactctttctcaaataacctttagcacaaaataaccaagagaatttttgaattttttcttttcttgagcctttttgctcatatttttctcttttattccaggtacatccctgtcgtcaagactgtttccagggattcagcacccattattttgctcacatcgaatacgtccttgtcgtcaagactgtttccaaggattcggtattcatttttttcatatttttattctcttttcacaatgagcaattaaagctatttgaggaataacaattcaataaagcatatatatatatatatatatatatatatatatatatagcatttacaaatcaaaccatatgctagcatcaacattgcatatttgcttaattcaagtatagaatttaagtgtcatgcatcatctcctttaaaagcgaaatctaaatctcatgaaaagactagaatacatacaagctatgctatagacaaataaacctttaaattattgctagcatgcacaagaaaataccatatgcataaacaaagctctcttttatcaatttttctcattgtcatattattgcttgataaaaccacgaggtacaaactccccctcaaaccatgccaaaaggatgaattatgcccaattcaccacgaagaaaagcaaagcgattagaatccaaaggtttagtaaaaatatcagcaagttgtaactttgtgtccaaaaactgcaattcaacatctcccttctcaacatgatccctcaaaaagtgaaaacgaatatcaatatgctttgtgcgtgagtattgaacaggattcttagcaatattgatagcactagtattatcaaaaaagagaggtactttctcaaaagtaagaccataatctttcaaagtagataaaagtcaaagaatctgtgaacaacaactagcagcagcaacatattcagattcagcacttgattgagcaacactagattgtttcctagaagaccatgcaatcaatgatgtaccaagaaaatgacatgttccactagtacttttcctatcaattctacaaccaccaaaatcagcatctgaatatccacttaagcatatataagatgaagtagaataccaaatttcaaactcaagtgtatgattcaaatacctcattattcgcttgaccgcttgacgatgtgaagcacgaggagaagcttgaaagcgtgcacacaaacacacagcaaattgtatgtctggcctagaagcagttagatacaacaaagatccaatcatacttctatactctttttgatcaacagcttcaccatcttcatcaggacccaacacagctgtagaaccaattggtgttgaaattggtttgcaattctccatcttgaaccgtctcaaaagatccttcgtatacttcgtttgatgcacaaaagtacct

SEQ ID NO: 62021 - DNA, 44253 bp, Oryza sativa
  unsure (1)..(44253): unsure at all n locations
atctccggccgtgaggccaaagaaaaccaaagctaaaccgtcatcggccaggactccaaatccttggcagttacgagtaatctggatgaagtctatatattgctggtcatgcctgtgcatcgattatgcaatacggcgcctcaggtgtttaactccatcgcaggtatatatccattgtcgattctttagccgccggaattaggacgcttcttgatcatcctgtactttttcatcaggaaccatctcgagatggccagggaagacggagcatccaggggtgcaggcgagcgtggcgccagcgaccggggcggcggagagcgtgtcccgcgagacgggcggagaacgggggacaggcgagtaacatgggacaggcgctcggcaggagatagacacactgtcgaagataagcgcccgggaggatccggcggcaagcaacagaaggaggccaagggtgacaacccttcccagcatatcgcgaagatcccggtccgtagagatgatcgaggaggatacaaacgccacggcgagtcaatcgaattcctgcgtgactggcgtcataagaaggagagaactgctcgtcctgacaaaccttcattgccgaaatcttctaaaaagggtctgcgtattgaagaatctccacatcccgagctggaccgcaccatgcgtgagaagcgaggaaaaaccccggtagtttacaagagggtgtcgtccacggaatcttcaagcgatgatcgtcgccgctgccgccgctctgtggttgccgacacggagcttgatgctgtccagttgagcgactcctcctcttcttcttcttctgatggcactggcaaggtattcgtgtttccccaattcttttttttcttaaaattctatgtcatagtggtttgataacctgtttctttaggacatacttgcaactcaggatacgatagagcaggcaaatgctttgggtgggacctaaagctactgcctcttccgatgttgctccggtacctattgacgatgtaccttcagttgtgccggctgctaatgctcctgtccgctcttctccggtgatgccggcggctgatgccgcttcagctccgggaccctcgactcaaaagcatcaggaaggtaaggatgactagactcctaatagaggtcatattctcctttgctttctcttgatgtattttcttctttctttggttcttctgagaaaagtgtactatacccattgtagaaacttcaagcaatcctttcggcacggctcgccagatgaacgagttgatggagaagacgtcccgttaccttgctgagttcgggacgggtggtcgctatctccaacttaactctgtgagttccgcgactgacgaattgccgacgctggagcttccaaagtccacgcccactgaacgccggaacgcccgcatggtggaggaggatctatttagcatccaagattgtttgatggagaaacctctgaacaaggaaggcaccatagagtacattggtgctgccaccgctgcatgggaaaatagttacgagattggacgccccacagacttggagaagttgatgtcttacttgggagcacttgtccaacgtcttaagggagagctcccggtaacctttgaagggagaactttagctgctcatgaaggcgaggcgcgctcttccttagcaaagctagagagtgcatgttcagacgtgctaccagaccttgacctcctcaagagtggccatgaagacgtggctgcggaccttcagaagtccaagcaagcaggggctacctggaagaaagaggcggaggaacatgagctgaaagccaaagatgcgagggagaaggagcaccagtgtttggaatcagaggaggcagccgccaagaacctgcaagtttatgatagtaccatcgacggcgtcatgcagctgataaagcgtcgtgacgaggcgaaggtctatttggggcatcttgctgaagagaggaaactccttgcagtggccgcgccgccagaggtggccgccattctatcatatcgtagagaatcggcgcctcggggtagtacgtcgaagaattagaatagcctccatatgcttctccttggtttaccttaattaggattttttttcgagtcatgtaaagcacattagaagcgctcttaacttagatgatcagctagctagttttcaatctttgaataaagttggggcattatcatgcacccattaattaggagtacttgttttattatttgagtctgtcatattgtcttcatcgatatatatggagtgcttgtgttttgtcctctttgtttttttttttcaacttgctaatatgtattatcccttctgtatccgaatactcggcactgcgcgcatgcggccaccgtcgcatatagaacccgccgaagatcctgccgggacccgagagctgatatatgggaatatatggctgtaatctataagtgcatgaatacatatgaacttctgttgattatcacggcggcaacatattgagccaaggccagccagcagtttgcattgttaagttaattcctttttaacaaacccatcttgtggcaatgtggccgagcaatcagagggcgacacatcatcaccatgctacagtgtcatgcacaaattctgtactcacgcagctgcatgcatgatctcttccatcaatttctggtttgccttctgtacaagttgcttcatataatacatcaacccatgtggggtagtagcaccgttcagaaaatctggcgctttgaggataggtgaagaataaaaataacttcaggcataaactgtcctcctgaagtcttgaggcgaagacctatgccttcaaataataattaaaggaattttgtcgggaccaagtataggtgccagccaacaaaataacttgaattcgtctcctactcgcagcgaaaaagacccatgccacaattgagacattttatcagaccgattgagaccgttgatatatcacggtgcctgcctcatcagcatgaagggtttcacggcttggcgctgaccgcgttggcacgccgccccgctcccaagaaaaacatcttatcaatccggacgcgaccacttgactgttgtggtgccgacccgtcaggttgaaaggtgtatagcccgatggcgacttcagagtgttatgttgcctctaaatgacgtgaagcgaaaaccctgcatcacgaaaaggaaaacgaaagaggaaaaaaaaactagagtacggttactagagccgagcaaaccaggtgagttgatagaaagaaacccagcaataaaatgattttgttgatttttcttttaaaatgttggctttcccactgaacactggctatgtggtagcgtcaagataagattgccgaagaacgtgtcgcgggaatcgccgaatgaccatgacgattgctccctgtcaacctaacttcctggtgtgcttgtgtataggagtagcatacatggtgatactttcagaaggcagcgaaaatccatgctctagcctttcagttcactaggtaccaccacgagtcccatgcccccggtattgtgcttcatcgaaccgagagaattaggtatggctgaattaagatagggttataggggaacggctgtgagagtggccttttccttttgccgaggatggtgaatggctatcctcctccttctgacagaatgcaatggagatcactaattgtttggatctttttgtttctttttttttttgcttcgcggcttcatgacaccacggcttcattgagattgatattggattgttttcttgagttgagatcatcacgactttgttgagattgatctgagatcttggcatccttaaaacttggaggacaaccattcccctttgtgggctatgtaatcctcgcaggcccatttcttttgtaaagtcccttgttgacatgcctcacagggatggcaagtggctgcacactgaaccacaacttgtgttgaggtaggtagccctttcttactcttctcctatagtcttccctggggcttagtatctccataggtctgaagcacaccgaaggacacgaaggcgtggggaccttgttactaggaagtaacccaatcaagtctttttgctattcctcggaaatatgcacccgtagtacttgtgtgttggtgtgaaggatgtttagttgtaagcacagtctgtcatggtcatccattgaatcctgcagaggtgttctaaggttgccttgtcttcttctaccagctcaatgcaatatggtgaaagccattttgatttttttttgttggacgtggcgtccattttgtaaaacaaaacatggagcaccaaacaatgcaatggtcaatgcacgttggcaagctcacaatgttgttttttttaaagaaaacaagaaaacaagaggcacagggttttatacaaaatatttttttaagaacctcccgttgattggcggcatcggttgtgatccttgatgatcaatcagctggtaagcacctccgtcatatgcttgctcgatgacgtatggcccctcccattttggctcgaactttcccttcatcttgtgtgtaacgacgatgggacgtcgcagaacgagtacgagctcgcccttcctgaagactcgttgcttgacgagcttatcataggctctcaccatgttttggcgatacaactccagattttgaagggcgcctaggcgctcttcctccacggcatcaagctcctgaaatcgaaggcgaatctgttcgtctttagtaagttcatcgtggattgctactcgtagagatggtagctgaatctccaatggcaacacagcttcattcccatagacgagagagtatggggtagcttgtgtcggggtacgaactgtgactcggtacgcccatagtgcttcataaagacgatcatgccaatcccttcgatgcttgtctaccgtcttctttaagatcttgccgagggtcttgttgaaggcttcggccatcccatttgcttgagggtaataaccggtggagtagttccatttgatcttgtatttctccatgaacctatagatcttctgggatttaaaggctttggcgttgtcggaggtaatgcgatgtggtaccccgaagcggtagatgatgtgccgttcgaggaagttgatgacgtcactgctcttcacttcacgcagaggcacagcttccgcccacttggagaagtagtctgttgcagtgaggatgaagcgatgcccccttgaagaaggtggattgatgaggccgatgacgtcgattccccaggcatcgaacggccaagaagggaccgtcgggtgaagcggagccggcggttggtgcttgaaattgtcatggatctggcaaccatgacaggttttagctgtctttaggcaatccgccataatgcctggccaatagtaccctaccagtcggatgctatggtacatttttggtccgctttgatgcccaccgcatactccatggtggacttcttggagaactcgattggcttcactccgatcaacgcatcgaagtaagacctcttgcccgtaagaccgcttgtagaggacaccggccttgtagatgtatgagggaagtcgtcgctgtagttggcgtctctcgacaggatcttcaggtagagagccgtgcttgaagtaatcgaggaagggttgacgccagtcttcctcttcagcagaattagttatgatgatgttgacttcttcggggatgagctctaggacagctggaagaagccacctttcttcaacaacaatttgcgcaggattgtctccttgaaagaccaatgctgcagccagttttgccagggcgtcagcaggcgcatttttgcttcgtggcacatggatgacctcgatgtgttcaaacttgtccataagcctccgggccactgtgtaatatggcaccagttctggtttacgaacctcataaatattgttgatttgtctaataatgagccgagaatccccatgggctcttaaggaacgtacctccatagagagcgccaagagaagaccaaagataagagcctcatattccgcctcattgttagaacactcctccttgagaagagagaacgagtggtagatcacacctccttgtggagttttgaacaccaatcccgccccggctctccgtcgaggggtgccgtcggggttgatgtccttacgtgaggctccgtcgaagtaaagctcccactgttcctgaagctctgcggtgaaaatctcttcatccggtagattggcgatgagtggggagtcatctggcattggatgtgtagcaagaaattctgccaaggcttggcccttaattgctttttgcggtacaaaagtgatatcatattccatcatgagcagggcccatttacctagtcgcccggtgagcacaggctgacttagcacataccttatagggtccgcccttgcaatgagctggatctggtgcgccaacatgtagtgccttagtttcttcaatgcaaatatgagggctaaacataacttctcaattggggagtaattttgttcagcaccaaccatggtgcgacttaaatagtagcaagccacctccttcccttcatcattatgttgagcgaggagagcgcctatcgaggcaggctgcgttgcaatgtagagaataagggggcgccctttaacaggagctgccagtacaggaggattaagcaagtacctcttgatactatcgaagccattttggcattcttcatcccacacaaagggtgtgcccttcttcatgagttttgagaagggttggatccggcccgagaggttggagatgaagcgtcggatgtacgccagcttcccttgtagtttcctcagatccttgagttcttgagggggcggcatattaagtatcgccttgatcttttttggctcgatctcgatccctcgatgacggatgacgaagccgaggaagacaccggattggacgccaaaggcgcacttgagagggttcatcttaagttggtgtcgacgtagtcgctcgaagacaatgcgaaggtcttcttgatgatgttcgtgatctttggtcttgaccaccatgtcatcaacataacattccactgaatgatgaattaaatcgtcgaggacgaactgcatggcacgctggtatgtggcaccggcgttcttcaacccgaacggcatgacagtgtagtagaagttccctttaggggttctaaacgccgtgtcgaaggcatcaaggagatccatcttgatctggttataacctgacagtgcgccataacccgttgttgaatcgaccaccatctccgtgattggtaggggaaagtcgtctttaggacaagcacgattcaagtcgcgaaagtctacgcagactcgaacttgtccattcttcttttccacagggacgatgttggctaaccaccgaggatattgtatctccttgataaaacccacgttgatgagtcgatcgacttcggcgatgacttggtcttggaactctggccttaagcgccttggtggttgcttcactgggcgaaattggggatcaatcgccagcttatgggtggcgacacgagagtcaagtcccggcatctccttgtatgtccaagcgaagcaatctcggaattccatcaagaagcttcgatagtcttctcgctcttcttctgtcagcatgccactaacgaaaatagggcgcggatcatcctcagttcctaaattcatctccaccaactcgtcaatggttggttggccaccgtcgtcaagttgtttaagagcccctgcaacatcgagctcctcttctactccaacagctgcaacctcaaaggggtgttgttggagtaaagcatcacctcttgtagtggtacttatggtgcaacaatgaaatatatcgtcttcaaatacttcatcttcatcatcgggttcatctacgttgatgtagccgagaccgtactttggttgttctttacatctcctcttgataaactcttccgcttgtgcccaccagtcctcgcatactgctggaggtggtggcaacctgttgtttcgctgtagattgatgcccgccttctccaataggcgagccattctaggctcagccttcatggtcgtgcacgcttcttctctagcggggtagaaactgaagtgtagagggctgggggctgcatgcactgagcacccgcttttacctcctctatctctgcaactctcttcttgaccactccctgttgtgcaagcgcggcttccttgcttggactccgtcttgcctgtaaggtgatggtagttggcacatcgccgttgcttttgggcggtttctcgcttcctcgagaagttgcccccaaggtgatcagtgttgaggtagagcgtcttgctttgagcaatattggtgtagtagatggggtagacgtgctggtttcagcgggagatgggagcttggtgctgaggttggttgctgaagaagaatttccccgcctactattcttgtgattccttgacgatgattcgctaatgattggggagcatggcataatgaggcatctcacctcaggggttgtctcggtgccgggttcaacaatgatgtcggctgctggtgttgttcgcccaagttgttgcttgttttcttcaacagggaagtaatacttggcgtcggcatggtatgattcttgaatagtgtatggtgagaaattgctagtgatgcgctgttgcactccattgccgtcaaggaattttaggcattgatggagagtagacggcacgacacggtacttgtgaatccacggtcgtcccaagagagcagagtatgatgtgttggcttcaataacaaagaaccgcaccttgaagctgaatgtagacatttggatcttgatagtaatggcgcctaatgttggcttgccctgattgtcaaagccgcaaatcaccacgtctattggctccaagtcttttgttgtgaaacctgctcgagttagacttcgaacgggtagaatgttcacagcagatcctaggtcaatgagaatccgtcgaagatgagcagaaccaatgtttccttcaatgtagaggggacgattgtgatcgccccctttgatgatgttatcttcatcagcgaaggtaatctcattcacgaacaaggggttgtcgtagagtcgatgcttagccatatcaacttcgtaaacttccggagcctgcaacgcctttataagagcttcgcgcagatcaggcaccatcataagagcatcatagacactcaatagtgctgggatccgtttgagatgcgcaagaactttgtagtcgacagcaggcttctctttgcttccagtttttgtttctggagcttctggagcttctccaggaggagaggccttcttggcaggcttgtctacatttggaactttggacttgtgtggatccggcaaggtcttcccccctcgcaggcttatgttgacctcttctaccttcgtcttctctggatccaactcagcatggaatatttctcgctcccttcccgtaaacgtttcatcggaaccggtactcgtggagtcattataggtgaggatgacattgcatggagcaatgtctggagtcgggatagaattgttcacccccttagcctcccttgtgcttgttgaggactgctcccaacccttgggcagaaattgcgccaaagtaggtagctcacgaccccggcggggaaaagactcgtctccctctgagaaggggacaaatcgaggtggaggacgtcgccgacttggatctagccatcttcttgaagtcgggtgagtatgcggtgacaacttcatttgtgggcgacggggtggaaagctcattggttgaggcttccatcgcacaatactccatgctcggttgttgtcgccatggctagcctccacatgagtggcgggtgctttcgtcagcattatctttgcaatttgatcttcaacttgggccagcggcgcccatgatgttgcacgcctaccttctctttgtttttgagggaaaggctcaacggacaccatattgacggcatggtagtctgggttgatggcgtctgcatcaagattgattcttttctcgttgactgccctttggagccattctttgaaggcgatgcaatcttcaatagcatggccgatatacctatgatacggacaatataatggattgtcagtcatggttacctggtcaggtcttcgtggttcaggcagattcaaggcacggtgttccatcaactggttgaacatatctttcaccaactcccggcggaagatgtattgcttcttgagaagatcttgaagcgtggagcgttgcctgcccccaacttgctcattctttgctccaatcatgggcacctgtccttgaggtgcggtggagaagacttttgtggaattagcttcggttggaactttgggtttgttcccactaccactaggctttgttgcgttaaagcgtttggtagggtcaaaggcgcttgcattcttgtaaagctccattatctggggtgacttctcaaactcgagcttggttgctgccacggcggaactgagtgcgctaaatgtttttggttcacgtcgggacacttcaagagaccaatgctgttgcattccatgaacgcacatctcgattgcgtcttcaagatgcatctcccttgcgagacacacgaagctattccggaagcggatgacatagtcgtcaatggcttcatctctccattgtcgaacttgtgatagttcaacaatagagaaatctttcttcatagcaacaaagtgcttcttgaatacttccttcatggttgcccagtttccaatggatggattctcaccacgtggagcgtgttgtctagcatgttgcctaggatcgccttctgctgtcacatgggcaggtgcactatcaaagttattaggataaccctctccgtctgaaggtagagatgggttgagttcattatagcgagggagattgagattcacttccagcgatgacgatgaggtagactctaactcgtcaagatcttcaacttcaacatgatcctccaggtcttttcttgcttgagaaggagttgcctcaacattcttgatagcgatagccttcatgcgagtgttagcaccaggtcgactcgcaacctatagtagcccgctttggtcatggggtaggcgtgtcgtaatgtcgacgtagcgacgaggggagacatctgaccggagtgctttgcccctatcagataacgatccttctcctgtaccgataggaagacaaggggctgaagctctagttgcttcttgagaggaagatgtgcttcgtcttgaaccctccgagctgaattgtgggtggacttgatccaactgagggaggaacgtcttggaaaaatttgcccttggatttggcacgatctcttcatcagaagggtaggtgaagtcgtgagtaaccggcgggggaacccatgcggcattgggcttggtttcgtaatgcgcggctagtgcgctgcacatgacaatgctttcctttggatcttctatgttcttgcttcccgccacctgttcaactctggctggaggcacagaggatgattcctgctgaggtagaacatcaaccatagggttaatgatagcttcttcttgtcgagacgccttgtcgacttgctctactggtgtctgctcgactccctccattggagtagattggttctccttggactgtcttgctgatgttgatagcgatatgcctaaggtagcttgaactggccccttccctcgctgcaggatggttacggggcaaggttgagttaacgcctgctccctattcttgtcagcaacgtctagtgttctccggggtttcggagttaaacgagctataaggtagttatacctcgcatccctctccaaactgggggagatacggaacacgatcctttcatcttcttgatgcacttctccatctggacgaacacgaacttgagtgtgttttagcaccaggtcttcaagctctctatagagagcgtagcggttgttacgacgtcgctctcgcttgcgttgattctcagtaggtgcatgctgacgtcttggtggaattgacggcgtcgggagaagaggtggtgccacctgccgtgtagctgggttaggtgcgttggtttcacgtcgcctttgtgtatagacctctcgtcttggagaagatggaacatgaggcggcacttgagaagatggagcttctcgaactcgccattcttgagcgagacgtgaagatgtgggataatcttggtgtcttgaccaccggttccagcgtggaggcaacgctgtttgtctctggtgcatcacttgagttgatggaagcgtacgtcgaggagccagcgtgcggcgatcatgttgaggatgataacttggctggtatcgtcttgatctgcccccagcttgtgttgatgatgatcgtggtgcttcatgatcctggagtcgtcttccaagttgggccattcggtcttgcagctcacgaagttcttgtcgcaagtcctcacttcgaggagcgggtgcctcagaccgtaggacggcgaacctgttgttgttgtagtcagacgaccctcctaccgcagacaggtggaggcatgactcccacgtgctctgctggcgaggggtgtacgtattgtagtcgacgaagatagttgagcctggaaggacgaggtgctccctatcacgccgcttccaatactctttcatgatggcgcacctgactttctcctttatcttagttggctcacatgcccattcgtcagggaacaagtcgtaaggtggctctagaatgcttgggaacttgaacaccttcttgatgaggacagatgtgtcaagagaccagtcttcctctaggagggagctctgggcgatgcgcgagctaacgagttggtgtagacgctgcaccttgcgatacttcctcctgtagttgcgcaggggatgaggactgtttgcccgtcgagtatgcgaaatgtgtcgacgaaggttgtcggagacagcttctagagcctcaagcagctccacctctgtgtgttgcacagttggggtaggcagctttggagtagcgactggatcaggggcacgcagggatgcagtaattgaacgcctgttggaagctttgacgcgcagtttctgtgcagcttggatgtctcccttaatctcagctacaacggactccttcaagagggtccgggcttcaagcatgagggttcgccgctccttctttgccttggcagaagcacgcttgcgttgcttcttagactgggcctcctggaattgggtcacatcttgagcttgttgcatgtagaccttggagccatactcgaagaatgtcaccggtggtagtgatccaaactgaatcacaaagggcggcggggtgttcttgatgatggaaggtcctcctgcaagaaggagccttggtcaggtacactccacgttgaagatcatcatgcagcatgctggtgttggttggatgaacggcgaagacgagcttgacgaccacagcatagcgaagatgggaggagaaccaggtcccactgggcgtgccaatttgtttagggtggaaaataacatctgagatctctatatttagagatacatatgtgcgggcgtgccagtgtacctaaatacacaatgtaaacaaaacataaggaacatgctctttattaatcttaaaagatcataaatacaaattcccaatgtaatatatatgtatttgcgctccattgtcattggacagatctgacttgtgcgatgtggtctcctggttactggggccttgagaagctcccagttaattacctccgcaggtctaggcctacaagagaacctccgattaagctgcttgtggtcgtctcgtcgtcttcgtttcgcgttctccatgcatggttgtgatggtgatgtagatgtgtgtgtgtgtgtgtgagcgccggcagcgatccatagcctcgtcagtccgtgcgccggtgttggtagcgtagccttcgcatcggcttcgcctgccctccgtcgtctagcctcggtcttgaacaacgtgtcgatgtagattgttggtgaagacatgcatggagttgcatagcttgaacgacccgacgtcacagcagttgcgtcgagattcgattagagaagaatcaggaagaaattattgaagatggttgacgtagacggcaaccggatttaatcaaagctcggcatctcatttgggacaaataagaaaaaccaacaggacttcttcagcccacgcattggtttgtgcatggcactgtagcagcgatgacatgtcgtcctccaattggttggccatgttgccacaataattaacttaatcaacatgcattagccagcttgttgccatccaacagcactggcttgccgtcctcccgccgtccttcctctgtactgcctccatcgtcatccgctggtttcgacgccatgcgtgatgcttgacctccggcatgggaacggatagaagtcttggcagtcggcgacagctccggcgatcctcggcgctctccggcagagcggcttcccgacgacctcctccatggttagcccttcgagtgcggtgaagcttgcaaatcaaggacgtccggtatctcggcgaggtcgcagcttcgggtagatgcatcaccagcggcttgaattaccagcgtcgagtccagggacaagtagcactgcgtcggcttgaacagacgccggcatcgatgaggcttctgtgaggcgtagatgaatcggccaccgcgacttccccggcgacgacgatacgtgcagatggatccccatgcatggatgtgtgcgtgctgtagatgaaagaaaatgaaacaatcttgctagcttttaccttgactagccatcaagctcctctcctgcgcttgctgatgatcggatcaccgcgcgcgccctctcctgccggacgccgggactccggccgaagtcgctcgccgccgccggtgcgtgtcgtcgatggatggatcgccgatgagagttgatggatggatgtgttgatgctggatgggtagatgtgttgatgatgggtggcttgtggatgctagatgcattggtgaatgaatgtgtggatgagttcgtgaatgcccctggctgccgaggggtcgacgccttatatatgggtctgaggtcggtgctggccgcgtccgcgccgtttcctccgcgtcaagttcgttgcagataaggcttgatcgatcagtttgttatagagataaaatcaattggtttgttggttatctcttaattcatctggttttatctcttccgcacgcgtgagcagaagtcgttcagataaattgaaaccccagcttatctctctaatttgatcgataagtaaactcatctagccgataaatcaaaactgcggatatgtataatacgccgcgattgtgtcattcactgatatgggctaagcccaggggcaggcgcattaaatttcttaattaagcccattaatcacctcacccttaatcaaacaccatatatttgtgtactgccatgcatgcatgcatgcatgtacgtagttgcttcaccggccgactgatatagctagcttgctcttgattcagtatacacacgcatatatatactaattgacaagtatagattgggcacagtgtgtatttcaatatttgcatggcgcatgcacacatgaaatggagagctagctggcctcacatatacctaatgttcatggctatcaggttcatcgttctagccgctgcaaaaatgccatcaaacagttatatactaaaataatgaaggtagtattagattaacttatttgagaatggaggaagaatggagggagtatgtggctcacgtaaacaggcaataagcatatgatgttcataagttcttatactaaagattggacattaattagaacaaaacaaagaaattttccgtaaacgacaatatttgctgttgagtcgttttctgtacagtgcaaataatgactgtactggtgggagcatatgactaactgatgaacaacggtcgtgttacgtatgcccatcgtattcacctccagtcacgcctcatattaaccattttgtccaactccctttcttgccaatatacggagtatctttttttttttttctggatccgaatgagacagagaagcagctagcaacatcagcagcgatcgctcataaacccgggttctccccggatgcaggtcatctacggtacagtaccactcactgacatatgatacccacagtccgtccgggatctcaattatattggttcctccctaagtctcacgcagcaatgcaattatatgacaagaatcaatagcgctacatatacatgtgtcaacttgcccatcgttctggcctgctccgttcattgccatttgccaccagaaaccgcgagactctcttcgccgacacgacatggaaattattacttattaaaccgaagccaacatttgctggtgcctggtgctatattaagtaggacaaattatttacggactcaccaaagataaaagagataaagctgaaaagaaactgaaaaaggagaacaatgagaaaacttgacagcctcgcatgtgttttgttgggatattgtcgcaatatctttggcaccgcacataatccacacattggtctcatctatgattttggtcactggtcgagacaattgagtctcctaactgcagatcactcgtttgtttcgttcgcaccaaatggctcgtcgtcatcgtgtgtgtttagtgtctcgtgtcctagctgttgaaagatgttctcccaaacttgtgtacaaaggtgcagtccttgaaaagtgttgtgttcgttttaaggtttttgtggaaaagctgacagaaatagttgttaggtcatttgacagttttgcaggcttgtagccgatctgccgtgtagattttattttgaagcatgagccatgcgaagttttatatatggcaaacttgtgttgctatagccgacatggaaattaattacaggccgcttcgttcccgggccgaaagcccgtattcacttgcgttgcgcttttcgaccgtggaaggccgcgtggacgcgcaaagcggctcgcggacgtgggagaccgactgagcaaggtggtgtattggaccacatcatttcccacctcaaagttaagggacctcaaataaacttaagatgatgtattgaaccacatcattatgtgcgctgcatcgtgtcaactgacgtggcatggctaccgtacagacgatcatgtggttgggcgttctatccctaccaagcgtagtatgtatgccatgtgggcctagtttgcagtaaaaggggtttcgaaaggagttgcggttttgtggtagtttcactctctacttgttgcatctagctgaaataggttgttaaagttatatctagttggtacttcctccagactaataatatttgttattttggctaaggacacaaaataatttaaaccgctattttctattataatatatatatagaaatatcaacaaatatatgattacattgaaatgcttaaaactaatttgttagcaaacaatttatttttctagtcctgtctctttcaaatggatgctacttttgtcgtggtgcacgcatgcatttttattttctttgttgaggctagcaagtagcaaccctatcaataggctttgtgaatgtgccatgctcataactaatcgtattaagaacattcgatatatattctattgaactgtggttgttcgataggtgttaaatttgtgattttagtaagccgatctatacttttacaattttccattaaaatagattatttctaaaataaaaatcaaagatgtattgactattgcggtgttgcaagatcaactggaagaaatggggagatggattctaataactcgagtggacgtccacccgttcattgcatatcaactagatggttaagaacaattttaaaaaaaaattgacaagatagatcaatatgtaatatatcactccacaaacatgtaagtttaaattcaacttctacaagttgtaacaaaaataacaaatttaattgtaaatatacatatagtaatttaagttaagttttatttgctatttaattgtaaggagatagaatctaataactcgagtggatgtccacccgttcattgcatatcaactggatggtccaccctagttcgatacctcctgacctcctgtgcccatgtactgcaaaagcaagacatgcagtacaacatgtgcatatatcacaagttttcaataaattgttacctcaccaaccttcgtcgaatacctatcgaatagcagttgttcgatatgtaccctgtcgaattttggttgtttgatggagtagtatgctactgtgattttagtcagccgacctacatttttgtatttcccatttaaattgtattatttctaacaaaaaaattaaacatccttttgcttccatagatgctatcttttcctctcttccaatgacacttgatagaagtcgttgctgggtcaactcgagactgattggaattggatgcccagttgcccaaattgatccgtgtcgcgctatcctgccgaattttttgcatctaaacacatgcagcccgaaattttcagatgtgagcacgcaaattcaggatttaaatatgtagacatgatgctcacatgtacactggtgtttccatctaactgctattccaacaaactcatgggcctgtgaattgattcaaactatgatcaaggtaaggatgatagatggatgaaccattacgggaggcaaggaaaatagggcaaatttgccgaccgcttgctgccgttagcctcaatttttcttcgacctccatcgcctctctttactaatccaacaaacaatttttcctgagtttagatattgtttttttatgttggaaattagatctgcataggcagctgtgagcatgtgaccggtgagctccaaatctaatccatctgcttagtgtaatatgttcatagtaagcaaaaaaaatattaaacaacttcgattggctgaaaaaaagagacttactccctgcgtcctataaaaaaccaacctagtaccggatgtgacacgtcctaatactacgaatctagacatacatctgtccagatttacagtactaagatatgtcacgtccgatcttcgattttagatttattttttataggaaagagggagtatgcaactggggctgctagtagtgtacgttacggccagaaacaagacagcagaagggcaaaaggcccattatttacatggacatttagttaaatacatcctatttatttcgttgggcatcagctcaaccggatttgacatggtctaacgaacatgctgtttagaaatagaaattcaaacgttacgtgctcacatctggaattttggagctgcatgtgtttagatgcaaaaaattcgggctatcctgtctttagtcttcactactacccatttccctttttgacccagtgatgctccgagcgtacgtgctgggaaccattcaaacttgaagcagtgcgtagttatggcgactgtcaatctaccatgcatgactgcctgatgctagcaagaaaataaaagaacgcgtttcaaggcccttggtcgatcgatcatcgatatataacgatgaggaaggtctcgtgtcactgaaaccacccaagttgcagccaatctcagccaatatgtcctccattattcttactcagacaccatcagtaccacgacgcctactgctcctcctacagctctcgtttctgctcctcctcagctccgccagcaatgctgtcacgccggctggggtgccatgccggccagaccaggcggccgcgttgctccggctgaaacgctcattcgccgtcaccagcaactccgtcaccgccttccggtcatggcgggccggcaccgactgctgcggctgggagggcgttggctgcgccgccggcgccggcgccaacaatggccgcgccgtgacatcccttcatctgggtgactggggcttggagagtgcaggcatcgaccctgcactcttcgagctaacctctctggagtatctaaacctcgcctataacaacttcggtgggtcaaagattccttctgatggatttgagcgtctcatcaggctcacacatctgaatctttccagctctggattcaccggacaggtgccagccagcatcggcaacctgacgagtttggtatcactcgacctttccacttatttcatgatcgtggagatacccgatgatgcttatgagacgcttatatctcaaactgctaattccatatggctcatagagccaaattttgaaacctttatctcaaaactcacaaacttgagggatctccacctcggctatgtggacatgtccaacagtggagcgcagtggtgtgatgctctagccaattcctctcctaatcttcaggttattagcttaccattctgttcaatctctggccctatctgccgctcactttcccttttgcagtctcttgctgcccttaacttgcaacataacaatctgtctggtccaatcccagacttcttgtcaaacttatccaatttgagtgttctccgacttaaccataatgagcttgaaggatgggtttctccggcaatctttggacaaaagaatcttgtcacaattgatctccaccataatcttgggatctctggtattctcccaaatttctcagctgacagtaggctggaggaattgctcgttggccagactaattgctcgggtttaataccaagttccattggaaatctcaaatttttgaagcagctagacctcggtgcgtctggtttttttggagagctgccctcatcaattggtaagctagaatccttgaatgcattggggatatccggagtgggactagaagggccattaccatcatgggttgcaaacttaacctctttgacggctcttgtgttctctgattgtgggttatccggatcgataccttctttcataggagatttgaaggaattgagaacattagcgttgtgtaactgcaaattttccggtgaaataccaccacacatatttaatctactcaaatggaattactcttgctccattttaacaatttcaccggcacaatagagctgacttcattaagtaatctgccacaactttatgcctttgatctctcctataataatctagctgtggtcgatggagaatataactcatcagtttctcttccccaaattgtgctcctatatttaccgggttgcagcatgtctaagttccctattttcttgaggcaccaatatgaaattaatggcctcgacctttccgacaacgaaattaacggtactataccgcattgggcatgggaaacttggaattatatttcccttttgggcctatccggcaatagatttacgagtgtgggatatgaccctcttcttcccttacaagtagatttgcttgatcttagcaataacatgcttgaagggtccattccgattcctcgaggctcttcaacatctctcaaatattcaaacaatgggttctcatccatgccatctaattttagtgctcatcttagagatgttacctttttcatggccgacggaaatgaaatctctggaaatattcctttggagttttgcagtgctaagagtttacaactccttgatctgtcttacaacaacttcaatggatcaatctcttcttgtttaatggacagtgttagcacgctgcaagtattaaatctgaaaggaaatgaacttcatggggtgttgccagacgatatcaaagaaggctgttcatttcaggcattagatattagcggaaatttgatagaggggaaactaccaagatcattagttgcttgcaaaaacttggaggtatttgatgttgggttcaatcaaattagtgacacctttccatgttggatgagtactcttccgagacttcaagtcattgccctcagatctaacaagttcttcggacaggtcgcacaatctgctgtagagaaaaattcttgtgaatttccagctgcaagaattattgatctagcctcaaacaacttctcgggtccattgccacaagatcaatggtttaagaaattgaagtccatgatgatcggatactcgaatacgtcattagtcatggatcatgaagtaccacgagtaggaaggtacaaattcagtactacgatcacatataaagggagcgccgtcacattgaccaagattttgaggacatttgtattcatcgatgtctcagaaaacaaattccatgggagcattccagggaccattggagaacttattctgttacacgcactcaacatgtcacacaacttcttgacaggaccgattccatctcaactcggccatttgaaccagttggaggctttggacatgtcctcaaatgagctttcaggagtaattcctcaggagctagcatccttggacttccttgcaatattgaacctgtcatacaataagctagagggaagaataccaccacagtcacctcatttctctacattctccagcatctcatttctggggaacaagggtttgtgcggccttcctctgtcgacaggatgcagcaacacgacatctctgaatgtgatcccttctgagaagaatcctgtagacatcgtgctattcctttctgctggactgggattcggccttggatttgccattgcaattgtagtagcatggggaattcccattaggaaacggtccacagtaaggcagagagctctctgaattatctcctgaaataatttttttctgtatcaaggtcacttgcagtatatttgtaatcaaggctatgccattgccgtcgcaagctaataatattcgaatcttgcatcatatgcagagtgacatactaaaaattttactcaaagtcaccgggattgattttctgaaatctgacatctagagcaaattaacaatggacgccgattgttgttaaactaaggaaaaagttcattttacatccctcgactaacgttaagtttcatttgcatccctatatatatataagtggagctaaaataaggacattggggtcactcttttcacgtatcatggtgcaaatgtctaaaataagtgctttataaattagttagaatattttggtagtgtaattagcgaaattcgaggcgcggacacgcggtcgaggacgtgaatgaaactccaatattagttgagggacattaattattattgaattccatatcagccaaaaataattcaatgagagggagagggagagataagtgagaagtagggataggataaagataagagagagaggagataaataatcctaagcagctctctttttttttctcccatgcggctggctcggctcgcagtgatatgtgccggtgctaatgatgtagatactggtttttatttaaaaccggtaactatatgtgtttaaaggcgtcagttttttttttacccaatggagatgggaaatggtcaataaaagcatgttttaaatgaattggcacccatgaaccggcttctattagggattccgtagtaatgctctttcggtttctttcagattaagcatttcttccaattgatcgggcaacaccgcaacaagcaaagcatcctttccagatgctctctttctggcgtggccaattcaagaagctacaccggttgcacacgcgcacatgtgccatctcattctctcacaaagcttcttaaaactcgtgttgtagttagctacaaatctatcacgtacttttcttctttctcttttagttcgacataaatctgaggcgccaactaggtgcgctctcttccaaaacatttgaagttttttttaaggtaaaagagtagccatctttcggcctcattgtttgtttatttgaggaataaggcaaacgacatatttataaacgaaaataatctgtgaataaaatttttatatacgtgtttttagcgatctaagagcaaagactgaaaaataaacttcgattaagaaaaccccaaatcaacttcaactttaaggttgaaattttaaattttagctcataaacataagcataagtgaagatgagactgtttgttttaatagaataaagagtaacagaaaagctatttgcgggacggagaaggacccgcgcctgaacttgtaaattgacaaattgtgtcaccacttttacccaagttatggtctcttctttgatttttcttttacggtggacggggttgcctgcgatgtggcggaagattctcgtgttcctctcgcaacgtagctcccagattttacacggcttgttagggttgtgtggtgtcgagagtgtttgcagtgcaggcttgcagccaccacttcctcaactgaggtagcgttaccccattcctggattcacaggtctacatttgcagctcgacctttgaagtcgttgctacgtggagtactagtattagttgggatcaattcgatcctgactggaattggatgcctagtttgccttgcccaccttgatctgtgtctcagctctcctatcttctttgctcattttcctttttctctgaacggaaactcatttcctttttgacttcttcgtgatgctcatttctggcaacaagccaacaaccaatgcttgttgctctttctaactaaaactgctgtcaccatcttaataaatttcggccgaagtaactttcgtcggcctggcgataaacaaatagtggtggcgactatcagtccagcaatgccttctggccatggctgaccggcaccaactgctgcggctggggatacctgagagggtgttgaggtgaggagtaggcaaaacaaaagtaaaaccatcccttgacttttgatcgatcgattgcgatcgttgtgagcacgtgcttggaatttgtcaccacccttgactacttggccatttcaacttcctaaattcgtatatcgagacgtaattcgtccatatgtagactactcgtcaacaacttcaaacgtccatatgtagactaccgaccatttcaattgcggtagtagactactcgtcagaagttcaaaacctatcggataaagaaattattatttttttttaccggcgtatgcgataagacgagtaacttcttttggatgatgactctgaaaattttgagtgttgtttccttgattttttggctaaataagttgtacacaaagactagtgagtacagtagaatcctccctccatacacctgacccaattctaagctcttacttatagcagataagtagctaacccaatcaaactaagctgctattatgccctccacaatgacccgttacaagctattgttcatgacattgctgctcctcctcttacacacccagctcgttgtcccttcttcatcagcaacatcagctacgtacaccaaccacaccggagtgccgccgtcggcggttccatgcatgccggaccaggcatcggcgttgctccgactgaaacgatccttctccatcaccaacaagtccgtgatcgccctccggtcatggaacgccggcgaggattgctgccggtgggaaggcgtccgctgcggcggcggcggcaccgccgccgccggcggccgcgtgacatggcttgatttgggtgaccgtggcttgaagagtggccacctcgatcaggtgattttcaagctgaattccctggagtatctcaacctggccggaaatgacttcaacctgtccgaaatcccattcactggcttcgagcggttgagtatgctcacccatctgaacctctcctcgtccaacttcgcaggccaagtgcctgtgcatagcattggtcagctcacaaatttgatctcccttgacctctcctttcgtttcaaagttactgaactattcgatatgggttacttatataccggtgcatactctcacgaatggcagctcgtcctgccgaacttgacagccttggttgcaaatcttagcaatttggaggagcttcgtcttggctttcttgacctatcacaccaagaagctgactggtgcaatgctttaggcatgtatactcaaaatcttcgtgttctcagcctgcccttttgctggttatctagccccatttgcgggtcgctctccaacttgcgctcactgtcagttattgacatgcagttcagtggtttgacgggtcggtttccagatttctttgccaacttatcctccttgagtgttctccagcttagctttaatcaccttgaaggatgggtccctcctttaatctttcagaagaagaagctagtggctattgatcttcacagaaatgttggattatctggtactctgcctgattttcccgtggatagtagtttggagattttgcttgttggtcacaccaacttctctggtacgataccaagtttcattagcaacctcaaatctttgaagaagctaggccttgatgcaagtggtttttctggagagttaccctcaataatcggtacgcttagacatttgaattcattgcagatctctgggttagaggtagtagagtcgtttcccaaatggatcacaaacttaacttccttggaggtccttgagttttccaattgtggcttacacggaacgataccttcttctattgcagacctgacaaaattgacaaagttagcactatatgcctgcaatctttttggggaaatacctcgacatatattcaatttaacacaactggataccatctttcttcattcaaatagttttactggcacagtcgaacttgcctcattcttgacactaccaaacctatttgacttaaacctctcacacaacaaattaactgtaataaatggagaaagcaattcttcactcacatccttccccaacatagggtacttgggtttgtcatcttgtaacatgactagatttccgaacattttgaaacatctaaacaagaatgaagtgaatggcattgatctttcacataaccatatccaaggggccataccccattgggcatgggagaactggaaagatgctcaatttttctttttgaacttgtcacacaatgaattcactagggttggccacaccatctttccttttggtgtagaaatgttggatctcagttttaacaagtttgaggggccaataccacttccccaaaactctggaacggtgcttgattactcaaacaaccgtttctcgtccataccaccaaatatttctactcaacttagagatactgcctatttcaaggcatcaagaaacaacatctccggagacattccaacatccttttgtagtaataaactacagtttcttgatctctctttcaatttttttagtggatcaattcctccttgcctgatcgaggttgccggtgcattacaagtactaaatctgaaacaaaatcaacttcatggagaactaccacattatttcaacgaaagttgcacattggaggcactagactttagtgacaataggattgaaggaaatttgcctagatctattgcttcttgccgaaaattggaggtccttgatatccaaaacaatcatatcgctgactattttccttgttggatgagtgcatttcctagactccaagtccttgtcttgaaatctaacaagttctttggacaagtggcaccttctgttggcgaagacagcagttgtgaatttcctagtttatgtatcctggatctagcctccaacaaattttcaggcacattgagtgaagaatggtttacaagattgaagtccatgatgattgactcagttaatggtacatcagtgatggaatataaaggtgataaaaaacgagtctaccaagttaccactgtgctcacatacaaaggatctaccatgaggatagataaaatactaaggacttttgtattcattgatgtctcgaataatgcattccatggaagcgtccctaaagctattggagagttagttctgctaaacacgctcaacatgtcacacaactcattaacagggccggttccaactcaacttagccatctaaaccagatggaggctttggacctgtcctcaaacgagctttcaggagtgattctacaggagctagcatcgttgcatttcctcacaacactgaacctgtcctacaacaggctggtgggaagaataccagagtcaactcaattctcaacattcctgaacaactcgtttctagggaatgatggtttgtgtggccctccattgtcaaaaggatgtgacaacatgacgctgaatgttacactttctgacaggaaatctatagacattgtgttgttcctcttttctggattgggatttggccttggatttgcaattgcaattgtaatagcatggggagttcccattagaaaatggtcgctactagggcagagagtcccctgaattatgtactaaaagaaattttcctgtaccaaggtcatttgcagttcgtttgtaatcaggaccatgtcattgttgtagcaagctaatatatatttgaatcaagctaatatatatttgaatcttctatctcgagataatcgattacgggtgttaaaatgataatggtgttatgcttatttaattactttagagatacacaagtcactaggatacacgcattatatacagatttttctttcgaagtatacgtcatatacaaatttacatactagcaattttactatgattgatttgctgctcaagcaaaatctagcttcagcaacttagctcccacgaaacagctgggtttggaatcggctttacagtggccattgttctggtgagcgaaacgctggaactagaacatttctcgctccaccagtaatactgtactcctaatttagtagtgagcgcgtgcggtgtgtatgagcttgtatgaatctactcttttacgaacaatgcaatataattcgacttcaattgtagtctaaactgtaaattaaggtggcagaatcacctgatgagtgagacgatgctggtcatgtggaaaatcttgattgctttgtccccatctctccagcttcaagaccgatgattaatcgggtgcgggaacacatgctggatatgcaaagctagatgatgtcacctgaaaatgtactgcagaaaaggaaaaactactcacgcaacaaatcgacaggacgatatgtgcaatttgctctcacctgtgctgtgcaactgcacaggcgcattccgtcgaacacgtaccaagcggaaggtagagcgcgacgacgtgcagcgcagcagcaggatgccaggattgattcgctcctgcaacgtctccatgatgacaggaaggtcactgagacttgccctgatcgagctccatgtcgccgccttctagctccgacgggtcacattttctcgccggagagatacacgtagcggcgggattggggaaatccggtgcacggtacagttggtggagtgggtgctggaatttaggtgtggtgggaattggcagagttgtcgaagtgggatgagacgccgacgaggtgagaaaaaaagtggcaggcaaatggggtcggcgaggacggacggcgagcggcgtcggggcgccggacacagggcgtgtgacggcggcgagtaccactttgcccttggcgcgcaggtagatgcgaccgtgaccaccgctcgccacgaggatggccggtttgagacccttcgtccgccggtgcatccaccccgtggatgcattccatggaagcattcctgaacctattggagagctagttatgctaaacacgctcaacatgtcacaaaactgcgaaaggccatgtaaagcctgacttacctcaacataatgttgagttcaaatctttataatagcgaaatttagattgaattatttaaaaggttaacttttcatttttaaaataccgtatataagcagttgctaggtaaaaaaaatatcgttctttaaaaagtaaaaaaaacgtgtcgcacaactcattaacttgtgccgtctaaaccagatggaggctttggacctgtccttaaacgggaagaaaattatataagactgaagtcttaccctcatccgaaggactttgttgctctgcacgacacctgttccgcacgaatcacagcgcatgcttactccctcaatctccctcgtgtctcttcggttactcgttctttcgctcctggcgaggcgtcgagctcgggcccgtccgaccacccacgcggcggcgccccgcagcatcgagctcatgagggcagccaggaattagaatcaaggcatcaagctcgtgcttccggcctgcttgtagaagatatctcaagatttggaagaaggtgtgtcatcgatgatcgattcgactctgctccttgaaactgcaaagagttgccccacgatgaaattattcaacgattagattttgcttgccattgagtttagtctgtatggtgcattgcactgattatctttgctggtgattgaacttgattgagccttcaaagatttctttgtatttgagtctttcaggattataatatgttgatgtcttgacgattcttcccgagcagcgactcatgcgagcatggatgctgctgagtttctctgccacatcgcgaatcccgctcgatgcccgcaacagcgacagccgcgagctcgacgcctcgccgtctcgccgagaagagcatgagaatgaggtggtgtttggatccagtgacttaactttagtctctatatttagacactaatttatagtattaaatatagactacttataaaattaattatataaataaaagctaattcacgagacaatttttttaagcctaattaatctataattagagaatgtttactgtagcatcacataggctaatcattgattaattaggctcaatagatttgtctcgcgaattagtccaagattatggattggttttattaatagtctacgtttaatatttataattaatttttaaacatctgatgtgatagggacttaaaagttttagccccatctatacaggaacagaaggcaaaaggataaggagagtaagcctgtcttgtgattcgtgcggggacaggtgtcgtacagaggaattaaatctttcggatgagggtaggacctccatcctacataattttcttccgcatcgttgcacttcctcacaacactggatctgtcatacaacaagctggtgggaagaataccagaatcaactcaggctcatccaaaaattccgtcacattaaatgtttgacacatgcatgaagcattgaatgtggacaaaaaaaactaattacacagtttacatgtaaattgcgagacgaatcttttgagactatttacgccatgatttgtcaatgtggtgttacagtaaatatttattaatgacgggttaattaggcttaataaatttgtctcgcagtttacatgcgtaatctgtaatttattttgttattagtctacgtttaatacttcaaatgtgtgtttgtatacttcaaacttaggctgtgtttagttcacgctaaaattgaaagtttggttgaaattggaacgatgtgacggaaaagtttaaagtttgtgtgtgtagaaaagttttgatgtgatgaaaaagttgaaagtttgaagaaaaactttggatctaaacacggcctaaggaactaaacacagccattgtgcggttcctcttttctggattggaatttggccttggatttgccattgcaattgcaatagcatgggggaattcccatcagaaaacggtctccagtaggtcggagagctctctgaattctgtattaaaatgaacttttctgtatcaacgtcacttgcagtatatttgtaatcaaggctgtgccatagtgccattgttgtcgcaaactatactcaagtcactaggattgatttgctggaatctggagcaaactgaccattgctgctatctttatttttgagttatagtacaagtcactaggattgatttgctggaatctggagcaaactgaccattgctgctatctttatttttgagttacagtgtactagtctatccaaaaaaacccaaactctggctatgaacctggacacgcgtgtgtctaggttcgtagctaggattggatttttttttgggacggagaggtaggaatctaggatcgatacacacatcatatacatactccctccattaaaaaaaaagacaaaccctgagtttccgtgtcaacgtttgaccgtccgtctatttaaaaaaattatgaaaaaattaaaaagacaagtcacacataaattattaatcatgttttatcatctaacaacaatgaaaatattaattataaaaaaatttcatataagacggacagtcaaacgttggacacggagaccagtgtttgtcttttttgggacgaagggagtatatagtagttacatcacactatagaggctatttaactactgcctccgtcccaaaatataacaaccgtctcaaaatataacaacttttgtctatgtatctggacacgcagttgtccagattaataactgaaaatacttatattttgggttggagggagaatcaattttactcgagtcgctcagattgatttgctgttcgatcaagcaagctgaaatctaccagcagcagcaactttagttcccatgaaacagctgaagcgccgtcgccttcgtcatcccggccggcaccttctcgacgaacagcaggatccccaccgccttggccgcctccacggccaacttctccgccgcctcccacgccttcttctcctgctccatcttctttgtatccaccttgttgtgcttggacgccgagttggagtcctctagctgcagcgcgtccatggtgagcagcgccctggacaagaccttccacccgttcacctgctccttcatgtcggcggtgatcgtcccgctcttcctcaccgccctggggttcatgaagccgcccacaagctccgccacggtcaggaaacgcacggcttcgttcaccatcaggagcagcgtcgccaacgcctcgccggcccgttgccgcgccgcgccgccgccgctggcggcgagaccggcgagcgtgtccacggcctgcgtcatctgctgcgggccgagcgtgacaccgaccatgttgtccgtgtgcccgaggagctcgcggtacgagccgccgaagccgaggtaggtggcgccggcgatgaggccgcgggtgagctcccaccacgcgctggtgccgtcgctgccgcggaagccctccaggtagaggttgtcggcgcgcgtggcgagcgtgagctcgctggtctgcgtccggagcacgacgtggaaccagcggcgcggcgggacgtcgggctccaccggcgggaggacggggcggttgtgggagaagtgcctcgggttggccaccctcttgcggatgccggcgatgaagtcgccgtagttgtcgctgccgctgccgctcacgttgaacgtcacggtgaacagcgggttcaacgccatggccggatgctcgatcgttgtgaactacaactgacaaaagcagaggattgctgaactaccatagacaagatgacacaaccccgccagttagtacgtgtgatttataggcaatggagtatctctgtatctgcttatactagtcaaaaagaaacaatttttgcttacaggtcaaaacaagagcgaattttgcttttgacagagcacacctgagatgttgttccacggacgcctctgttgagaagagaaatatcagcctagagtgagtcaaaagactgcgtcaaatccaagttcaaactggaaacaatgacgtccaggatagcgtgctgccaatccatgacagactagcagcgttggagaggacatgatacagacagaagtcacttgttttccgtgctcatattaacttcgatatggtctttttctaaaaatttcctatatttcttttaaaaaattatattaatctatttttaaatttaaaataattaatacttaattaattatgtgctaatgattcatcttgttttgcgtatcttcttcttcctccttctctcaaagacagcctaataggcgtcacgatcacacaacgctgtagtgctttgtcaactaatagcactggataattggatactatgattgatttgctgcccaagcaagctgaaatctagcttcagcagcttagctcccacgaagcagctgggtttggaatcggttttagagtggccgttgttttggagagcgaaacgctagaactggaacatttctcgttccaccagtaataccgtaacttagtattgcgcacatgcggtgtgtatgagcttgtatgaatctactctttaacgaacaatgcaatgtaattcgactttaattactgtctaaattgtaacttaaggtggcagaatcacctgatgagtaagacgatgctggtcacatggaaaaacttgattgctttgtccccatctctccagcttcaagatcaatgattaaaatcggagccagaacacatgctggatttgcaaagttagatgatgtcacctgaaaatgtactacagagaaggcaaaactagtcacgcaccaaaccgacaggacgatatgtgcaatttgctctcaccaatgccgtgcaaccgcacaggcgcattccgtcgaacacgtaccaggcggaaggtagagagcgacgacgtgcagcggagtagcaggattgattcgctcctgcaacgtctccatgatagacaggatggtcagtgagacttgccctcagctccatgtcgccgccttctagctccgacgggtcacgttttctcgccggcgagctatagggaaatccggtgcacgatgtgggagttcgaagagggatgaggcgtcgacgaggtgaaaaatgaaggcaggcgaatggggtcaagtctaccaactggttgggctgggccgtaacatgatggcccggtagtggcctccagtaattaaagcccattttttcagcaatttcggcccatgaaagtgctctcatgactatcgttggcgccttgccaccgggtgctcccagcgcgcgcgtacgcgccagcgattttgcgcccccttccggcacctttttttttttcctaagctctttttttttcgcttttttttttctgattttggcgttgcgttttttttcaccgtttctttctgtttttttttcaatcttctgtatacctctttacaaatgttagaattgaaagtttttaattttgacttgaaatattttaaatcttgacttaaaagttttcaaaatttaggttgaaagttttcaaatctgggttgaaagtttttaataagtttttaattttaagttgaaagttttcaaatctaggttaaaagattttaaatttgagttgaaagttttcaaatctgggttgaaagttttaaatttgagttgaaagtttttcaaatttgagatgaaaagttgaaagttttcaaaatttgacttaaaaaatcaaatttcgagttgaaagttttcaaatttaagttaaaagttttcagaatttgacttcacgtataaatttcttttcaatctgttacttaaaaaaatctttagaaaaaaaacaaatcttatcttaattatcttaactaatagattttttatacgctaaaaccaacggtattacagctaaatggaaaaaaaagtaaaaaaaaaaaagcgccgacgcgcgcgcctacgcgccaattagctccgccgcttaccacccatcgcttttccgcaaccgccgcctaggatgcgaccagcctcattgtttggcatattttctgaatatgccaaatggcatatttgcaaacgaaaatcaatttgtgaataaaacttttatatatgtgttcttagcgatctaaaagtaaaggctgaaaaataaacttcgatgaaaaaaaccctaaaatcagctttaaatttaacgttgaaaatttaaattttagctgataaacatatgaatataccaaacgatcaggcccgacggatgcgatgaggatgcaacgcaacattgctgagctgacaatgttcatctgctcgggcgtttaatcccagaacttgtggtactacttacgattaggtcatcccgtacacaatgaccatgagatcatcaatgcgtctggatgttgatcatcaattgcagcctgcaggatcaacaacgtaacgtcgaagataattcatatttttcagatagaacaacaccaggaagttcactatactgcagctttgcagctcctcactaagcgctactccctccgtttcataatgtaagtcattttagcatttttcacatcctatctagattcattaacatcaatatgagtgtgaaaaatgctaaaatgacttgtattatgaacggaggaagtacaagttagtgccggtggcatgtttttcaaatgagaaaaatgtgggatactatgcagttgatgtggaatactgatggcgttagcatccgttgttgataaaaaaaataagaagaagaaacccagattagtcgagtaagccagcgcacgcgtgccaagccactaactatcccccctcccaaaaaatgaagatgatgtgttacagttttattttttaaaatattagagaaaaacctaatatcaaataattagaaggggtgagacttcgaaccaggtcgtctagcccattacctcgtggagctagctcaaaaatctccgggcgtttctcaacagttttttttgtcaccggctagctgatcgatgtagttacgttggtggcctttttttcagcaaatagtaatatgatcatgcattattttgtaacggatatttgagattaaggatgggacacatggccgtatgattaggaataggttggactatggattaatcataaaccaccggatccaactgttttttttttcatttcctttggctctcatactacacacatgcggtggacgacggagggatgacttcttttactgtagtagagaaatgcaacccaaacggtgctatatcaattagaaaacagcccagcaatcacttctatgttgcattctttcattttattttatggcagctacttttttgaaggggctttaaaccgacaattgtgtaataattggatgcagtttttattgaagtgaaggccagattttattcattatcttaaaaaaaaaggtagaaacttgcatgtacctttcattctatatactataatcggtttaagaaataattgttataaagcagcatccacgttaagccacgtcatctcagttattggatcaacatgttcctcaaacacttactcatagattaccatacctacagaaaaggactgttgatgctcatggcctatcgtaaattctaagaaagtctaagggcctgttcactttgatgtcattttcaaccttaccaaattttggtaaagttaccaaaaaaagtggctacatttagtttgttgctaaattttagtaactatataagaaatcatgccaaaattttggcaagttaccaaaattttggtaactatgcaaatttgataaggttttttttggcatcaaagtgaacaggccctaaaatggatgttagtgttacggaataatatatgttgggaattttttttttaccaattctaaatcggagtaaagatagaatttatctccttctaagacctctatataaagagggacgggataagacatatatggttaacttgtactcgagaccagaactataatgaagaaagagcttcaccatatatttatggtaattgtttatttctgcaatgttcttgaaagcaaccagaagggtgtgggtattctatatctttactactgtgggagggacaaggaatggatgttaggactagacatactcccatcttgttttttcctcgcttatctttcaatatcttctagtatatattttcattttaacatagttagtttggtagcaactatttttaactacatattctatagtaacgccgggggttgcatctagttatgcaagggcactcgttgaatcaatgattgatgattacttgttgttcatgaagatctcttatgcttcttgaaaaaaatctcaaagaaaaagggagcataatgttgccttctcaaaccgggaaaagaagaggcaatttccatacgtaaaacgtacgtgacacgaccgtcattagtcgttggggtcgtgctctcaaaccagcgacgtctgcagatgtaagtatattttgctacttgtggcgctcaaaatttgtgtaatttactaggaaacatcgtaaaaaccttaaaaaaactaataatttgcaaaagaactcaattggagagatatattcttaagaaagacaagaataccctcagaaccacatgctttaaacatgacgttagagtaaaattttagaaattatgcaactccaaattaatttgccaccaccccaaatacatcatattacatctccactctagtctcaacttaaaagcttttgactctagtggcattctcgtcttttttgaagaattttgctcttcaatttgagtcgaaagtgtcctctaacaaattactatttttatggtgttttcaaacatgatacgtttttatgatatctatcataaatgtaactaaacggagttgatcaacgctcacgaccacgctgatgttggaacagccgaacaggtaaataaaactagcctagtagtatagccttggaattgatcggtcgattgagatcgttgtgagaatgtagggagctttgctcccggccgttgattattcggccctttcaacttggtacattaattttctccggcccacaagttgttctcgctgtaaacttccatcatgcggcccatggctgcaggaaggccgtgcgtagaacgttgcgtatgaatgttacccctgcatgctgattgggataattaccgtttaccgtttaccaagttgctaaacttcaggaaattaatcaggatgacgaccctttgaaaaatttgatccattacctcgtgttgattagttgatatttcctgtaaatcattctcactagatgtcctcgacccgtgactggccggttgatcctctttcttctctcttttttaccaaggcaaaggtatctaattcgtgtataaaaatgagggagcaaggtagaagtagagctacactcaactgtatctctacagttagcgcaatcaaactaagctgctattatggtggcctccccagtaaaaacgttgttcttgccgtcgctgctgctcctacacatccacctcctccacctcttcattccttcatcagcagctacgtacaccaatcacaccggagccctctcaccaatggttctatgcttacctgaccaggcagcggctctgctccaactgaaaaggtccttctctgtcacaaacaactccactgccgccttccgatcatggaaggccggcgaggactgctgcctgtgggaaggcgtccgctgtggtgacgctgacggccgcgtgacatggctttgatttgggggactgtggcttggagagcagccgtctcgacccggcgcttttcgagctgatttctctagaatatcttaacctgggcggaaatgacttcaatgtgtctgaaattccatccaccgggttcgagcggctaaataatctcacccatcttaacctctccacctgcaacttcgctggtcaggtgcctgcacaaagtatcggtcaactcacaaatttggtctctcttgacatttcctttcactccgaaataattgagatatgggaagtgcttctatgcttctttaaaaaaaacctgcacgaaaattaaagcacatcaacagtgaggattaaaagttgattaacagagtaatcccctttaacgaggggtaattttgtcctaagaaaaagctgaccatatctagcccaccctgtccgcatatcagaatcgactggttcctccttgacttgcacctttgacggaggcgccatcttcgccgccgccgccggcaccgccatcccaccgggtcgaacgaacccatcttgcccgacgccggcacgcttgccggcggcattcgacgacagccttgtggcgtccatgctcgcgcatgccggcgcctccgcgggctcctctccttgacctgcagcaccgtaaacggagggaccatctccgccgccgccgctgccatcacttcgtcctctccctgttcctggacgtcctcgccatggctcccggcggcggcgggggccgcggggcgggaagcctggagggcctgcagctagctgaagcgggcgtggatggaggactggagggaggagaggtgggagtcgaggtcggaccagcggaaggggaggaggatgggcgagtggaggacgaggctgtcgcaggcctcgcggaggcgttgcttcttgccatgcagcgtcgcgatggcggcctccatctgcgccggccgtcgtcatcgccatcagagatggttcagggcacagggccgttccgtgcgccggcggcgagctgttgcataatctccatcgccatcgattcttcgtgcggccggtaagaagccgacgcagtttatatataggcacgcggccgcgaacagtccgagacggataggatcagcgcatacaaccaattctatgtaaattcaaaagattgtgatcagccttgtgttaagttcagttcaattctgaatgcatatcaggtatcaccatatactgaggaataaaatggacatggaagctttggcaatctctgccgagaatcatgaagaagcagaataaggtgttgataatggtgagtgagggtgttgtgctcaatgaatcagccaaccagccatgtttcctgaaccacgagactattgacgaacctgaaagcacgacgacgagcaccacctacacaacacgtcaacacgcagctccccgaaggagagagctcgccggtgaaggaagcagcgacggcgtggttagtagcggaaggggaaaacactcttacagttacagggggtagaggacgcttctcggcgaaggaaagggtgcgggcgtgcggcgctgttcaccggaatgcgtcgtgagaactgccgcgcgctggccgcgaatcaatccatgagaagggatgtggatacggatatgggcttttacttctggacgaaattgccccttgctaatggtgattactcggttaatcaacttttaatcctcaccattgacgtgctttaactttcgtgcagttttttttttaagaagcatagaagcacttcccttgaggtatttgacgggagttatttgtttggaggtgatttcactcacccatggcagctcaatctacaaaattttacaaccttagttgcaaaccttagcggtttgaaggagctgcatcttggcttcctggacatatccgagcagcaaaccgagtagtgcaatgctctagccaattatactccaaatctccatgttcttagcttgccgttttgccagctctctagccccatttgtgaatcgctctctcgcttgcgctcactatcagtgattgacctacaatacaactttttgactggtccagttccagagtcctttaacaacttctcctctttgactgttctccagctcaggtataataacctagaaggatgggtatctcctttaatctttcagaacaagaaactggtggttattgatcttcacagaaatcccgtcttatctggtactttgcctaatttccttgtcggcagtagcttggagagtttgcttgttggtcacaccaacttctctggtacaataccaagttccattagcaacctcaaatcttttaaagagctgggccttgatgcaagtgggttttttggagacctgccatcatcaataggtaagcttacatccttgaactcattgaaggtatccggtctagagatagtaggattgtttccccaatgggtcacaaacttaacttccttggtggtccttgagttttcccattgtggcttatatggaactctaccatcttctattggagatttaaaaaagttgacaaaattagcactctatgactgcaacttttggggggaaatacctcgacatatcttcaatttaacacaattggataccatccatctttgctcgaataattttgttggcaccgtcgaacttgcctcattccagatactaagaaacctatctgacttaaacctctcatacaacaaattaagtgtaatagacggtgaaaataattcttctcaggtatcctacccagatattgattacttgagcttggcgtcctgtaacataactagatttccgaacattttgaggcatatagattatgagattaatggcattgatctttcacataaccaaatccaaggggccatacccctttgggcatgggagaaatggactttgggtttttctttttgaacttttcacacaacaaatttactagtgttggatatgatgtctccctacccttttatattgaactgttagatcttagttttaacatgtttgaggggccaatacctctacccagagattctgggaccgttcttgattactcaaacaatcatttctcgtccatactaccaaatatttctactcaactcagaggtactacctatttcaaggcatcaagaaacaacctctcaggcacactgaaagaagaatggtttacaagactaaagtctatgataactgattntggtaatgaaacatcagtgatggaatatgaaggtgatcaaaagcaaatctaccaagtgaccactgtgctcacaaacaaagggtctaccatcatgatggagaaaatactaagaacctttgtattccttgatgtctcggataacgcattccacggaagcatccctaaatctatgggagagctagttctgctacatacgctcaacatgtcacacaactcactgacaggaccaattccatctcaactcggccgtctaaagcagatggaggctttggacctatcttcaaatgagctttaggtgtcattccacaggaattaccatccttggacttcctcggaatgctaaatctatcctacaacaggctggaggggaaaataccagaatcgcttcatttttcgttattcgccaatagttcatttcttgggaatgatgctttatgtggccctcctctatctaaaggctgcagcaacatgacattgccgaatgtgataccttccgagaagaaatctgtagatgttatgctgttcctcttttctggaataggatttggccttggatttgccattgcaattgtaggagcatggggaattcccattagaagacggtctccggcgaggcagagagccctctggatcatgtattgaactgaacctttttctgtatcaaaggttgtaaacttgtaccagggccatgtcattggtgccacaatctactacgtatttgaattcttccatctggatcaaatcaactatatcgtatacagaggtacattacatactactagtagcagttttgctgaagtcgctcggattgattttgctggtcaagcaagctgacatctagctgctgcagagttacattacattttcggtttcgggttgtttatttggatatccgagtttattccatgattatggcttctagatggatactatacgtatgtaatactattgtttgctgctaatgagtcaagttggagatagcttggtctcggaatatgatttctttgtttgttccatgtataggtgactcgatgtctcggaagagtatttgcggtgatggaccgggagtcggcttgaggataagacgacgtccgtggtggtcagagatcatgcgggatacttaggcaagagttgatgcacgtggttaatggagattccatatggcatacgatggaggaattgtgtgcgtatgggatgcggagtcgaatttggaaggagtccaaatttggtacgtttggttatgtaaagtttctttcttgtattagtgggtttcctaaggtgtttaggactcctagtatgagtttggttcgtggctttaggctgcctaccttatgtataaatagagggggagcgtgaggcttcccggtatcgctttagagagcaattgagttgagttttgagttagggtttcgagtttagtcgaaatttttgtaaggagtgctgttggtgcactttgtaaacacagagagaagtaataaagtcgtcatccactttaagagttcttcgatttgtgtttcaccgggtttcggcggtctaaccggcggcgcaccggcggtcagaccggcggcatctcggtggtccgaccggcgggcacacggcggtcagaccgacggctacaggagtcggcgacaggcattttcggcggttcgaccgatcgatctacatcggtcagaccgacgttcatcaggcggtcagaccggcgcaactacttcggttagaccgcgatccatcgatttcgagggtaacttttatttccgctaaaagttatcggtttttgggtataccaaccattcatcccccctctg

SEQ ID NO: 62022 - DNA, 9625 bp, Oryza sativa
gaaaagctgctataagagaaattgaggtggatcatatttgtgagttgcgcaaacccagatgctgggagagcggttcccaaaaaatcattgtaagcaaggttaaggtttctaagagaggtgaggttaaagagtgcaggatcgagacgatggcttatcaagttcaactcactgaggtcaagggaaatgaccctgccggaggccatgtcacaggtgacaccctcccagtggcagcagtccgatccagctcgccatgatggcagcaggtttgtaccgatgaaggaagctttaagccgtagtagggaagaagcttgatctgggcggcaatggacggctgtgtcatgctgggctgcagtatcactatgaatggcgtaagagcacaagaggagtatgaggatgttgatctgttgcttgggtgaaatcatttttgacactggcttgcgtcctccaatggcgtccagtgaccctctatatattgggaaaaagaagaacatccggtgacctagacagttcagactttggactcgtaattagctcttgtttagttccaaactttttcttcgaacttttaacttttttatcacatcaaaattttcttacacacacaaacttatcaaaatttgattccataaaaatcaaggccgtatttagttccaaaggttttctttaaactttcaaatttttcatcacatcaaaactttcctacacacaaacttctaacttttccgttacatcgttctaatttcaatcaaacttttaattttaacgtgaactaaatacagcccaaagcaactcctaatacgaaaccaaggagatgatcgatttgcaagccgccgctaacagtaccgatgagtgagcgtgtggaccgcgagtagggaacacaagggtacaagcgtgtgggccgaacccgcactccactccacttcgcgctgtcaattgagacgtggtggtcccgttccggtgagaacacgatggacgaccgaccagcggatccgtcaacgacgtggtctcctgccggccgggccctgctatttccatcccatccatctgcctgcagatgggctgtggtttgcccattgatgaacgcctcatgctggccgcgattttgtgccccgaatttagttcctaaatttttttagttccttgcgctgtgtttagttccaaaataattcttcaaacttctaactttttcatcacatcaaaactttcctacacacataaacttttaactttttcgtcacatcatttcaatttcaaccaaacttccaattttggtgtgaactaaacacagcttgtttagttccaaaattttgtgccccaaatttagttcctaaattttgtgccttaagggttaaggccttgtttagtttctaattcttttataactttcaactttttcatctcattaaaactttcctacatacataaacttccattttttttcttcaaactttcaattttagtcaaactctcaattttggcatggaactaaatataacctaacttgcgagtgatctggctgcctcctggccggcgatacctaccgaaaatgatagagctcagtgattgattctcaggctgctaaacacgcgggtggtgatgcgcgcggcagctttgttctctgacgagggggctataacaccaccggcttccggaggcagtggcgtagctagaatttagattaaaggtggtccatctattagtggcggacacaactttaaaatatagatggggcggagaaaagagatattcactcgataagagcaatcgaacacaacacatatcgtattaatagttcgttcatataattgtctcaatctgtcaagtgtttatatcttgttatacctaattttgatggcctatgactactataagcggataaggggggatgatactccctctgttccataaaaaaaattaaatactaaggatagatatggacatagtgtatgggacaagtttgtcttttgtaacctttctctacagttttattttttaatttgcaattataggatagtaagaaagcaggagctgaaaatattcgcctcaagatacagttggataactgcagtgtagtgaactccctggtgttttttcttaattatctgaaaatatgaattttcttcaacgttgttcatgattatcgttctacaagcattcatggtctcatggtcattgtgtacgggatgatctaatcgtagtagctagtagtaaccaactaccaagttatatgattttagacgttcgagtttcaaaagggtagcttttagtaggaaagagtcttgtacttaggtcgatgaacctcttggttatattctaagcactttaacaaacgatgtaacaatgtttaatgatcaataaagctagccgaatggtattccctcgaaaaaaaagttatatgattttagacgttcgagtttcaaaagggccaggcctttcggattcaggggatgagcataattgcacaacgtgcatcttgtacagaaggattatccaagggcagaagccaagaaagtgttcgagcagatgaacattgtcagctcagcattgctgcgttgcatcctcatcacatatcggttgagatccggcggttgcggaaggcaaagggaaggtaatgcgcgggaacgccatgcaggggagaacgtggcgggagcggcaacgccgccaacgcgagtcgcgagagcgcttcgatgggccgagattgccacacaaatgggctttaattactggaggccaccaccaccaggcccgtcatgtgtgtacggccccatacgatgcgaggcctgccactagatctgcgacggttgcgaaatggcggcgcggccatggtgccatggccggcgacgaggtggatgcgccgaaggctctcctcccacccagaccggccatcctcgtggcgagcgccggtcagcatctaccaaggtccaagggcaagtggtacgcgccgccatcgtacggtcgatctcgtcgtgcgcgtcctgttcgatgccccgacgccgctcgccgcccgtcctcgcggacgccgccggagccggagccaccggttggtttggtagacttgtcccccttcgcctgcctccgcttcacctcgtcgacgcctcaccccacttcgattcccaccaccactccaccagccgtccatacaccccgatccccaatccccagttccagtgaggtccactgccacttgcaactcgccggagagaaaacgcgacaggttggaactgcaaggtgcgacctggaggtcagggcaagtctcagtgatcatccggtcatcgtggatgcgttgcaggagcgagttaatcctgctgctccgctgctcgccagtgcggcgctgcttctgcctggtacgtgttcgagggaatgcgcctgtgcagttgcacagtacatgttacagcaaattacacaatctcattgtgccaacttggtacgtgatgaactgatgactagtgttgccttttcttcattacattttcaggtgatctcatctagctttgcaaatcaagcatgtgttcctgcaccgataaatcattggtcttgaagctggagcgatggggatggaaccatcaaggttttccttccacgtgaccagcatcgtcttggtagactcatcaggtgattctgccacctcagtttacagtctagaactagtagataaatccaaattgcattattcgtaaaagagtagatttatacaagctcataccacacgcatgcatgcgtacactacttaactactacagtgttactggtgaaacgaaaaatgttccagttccagcgtttcgctcgggaaaccactgacaaaacaacggccactgtaaagccgattccaaacccggatcccacaaacacaaacaatattattatccccacactatctcgagaggatgatggtgatcttgcagcttctatgcctgaatagttgcactgtttggacagcggccttccacagagtcctgcattgccttcgaatgatctgttgccgaatgacaagaactgtggcccttgtggtatctgtccagtcaaattgttgtatgagagattcaatattgcgagagatgttagggatgccaactcctgtgggattgcttctgagagctgattcaaagagaggtccaaggactcgagctgaaccaatttaccaatcttagatggaattcttccagtgaaggagttgcgtgacatgttcaaaccatgtagagcaattagcttcccaattgattctgggatagcaccattgaaatcattgtttgataagtctatcatcttgaaagtagtcaggattttggtaaacatgagatcaaaccctttaaatgtaacaatcatattgttttggtataagcccttatatatcccctgaatgcccaaaacatcaccctgatcactatttatcatcattgtttcaaggttctcaaaccattttgattgcaaactccctgataagttatttgaggctaaatcaataatttgcaaacctgagaaatacttactggttgcatcactttctgtaggtagtcctactgaaccatagaattgattggatctcaagatgagaacccgaagattggacatgttccctaaccaagatgggaaagaatcaagaatctggttgttacccatgtcaagaacctctaagctcttgcatttagacaatgatctaggcagtttccctataattcggttgctgttcagatcgattgtctgaaacatacatccttctctaatattcttaggcagcacgccatggaagttgttctcccttaacttcaatatggtgacatcaccattttgtattaaacaggatggcaccataccactgaagttgttgtgtgataagtcaaggacctcaagataacattgggtacatatagaacttggtatatgaccacttattttattcctggaaaagctaagatagtagacgtttcgaagatacctgccgaagtcacgagtaattgaagagaagctgttgctagagtaatccaagagaacaccaccatctctagtagttgtcagtggtataggtacgttaccatgcagtctgttggaactaagattgagtctatctaaagtgtgcaagggaagaacagatggattattttccaagctagtgaacatgttgttagagagtactaacacggacaagctattcttccagttatcccatatccagcttggtattactccatttattctgttgtttgaaaggtccaagtaagacataccttttatatctctcaatgcgcctggaatttttgtaaggttgcaagatgctagtcccaggtatttgattgtagggaagtaatgaaatggatagccatcttctcgatctatcaccgacaacatattgttagagataattaatgattctagtttctccatcttccaaagaaggttaatttccagtgtaccattcaattgatttgattgaagcacgagatttgttagtcttctaagatcaaagaacgatttgggtatgtagcctgtaaggtggttatagcttaagtcgatgaattctaacaacgaggaaaacgggtctgaaatgtcttctagatgtccagaaagttggtttgatcgcagatctagcatttccaacgattgatgagcgaaaagaagcttcgggattctacctgtgtggatgagggacagagagagaacaacagtcaaagtttgttcaaaaaagaaaagcacagaatgtcagaagtcctgatatatgtactcaaatgtgtgttcttaccgctgaggctgttaagtgaaagttccaaatagataagcttagtcaagttcccaatccatgatggtattggcccatagaagctgcaattaaagagcactaaagattccaaacttgtacagtttctgatccaagggggtattggactggagaaattatagccttcgagcatcaagtctctcagtttaattgttccaatccaagataacagtggcttctctatgcctgatccagagagccataatgtatctagagatggaaggctaggtatgaaagtagcaacctgcttgggagatcctacgttgctaaggcccaaaaatttcaatgatttgaggtggataaacgaggctggcatgttaccagaaaagtttgtcctctgaagatttagtgattccaaatattttccaggtgggaaatccggaagttggacaaaaagagtaggattgaaagatacatcaagagacctcaaattttctacctggaatatctttgtgggaaattgcccttcaaaattattgttcgagagagcaaggtcactcaagaaaaagaagtctgcaaagaactcaggaacccttccagaaattccattgtagttgaggttgatcaccactagagagcggagttgggaaaatgaacgatgaatagttccacctaggtcacattgggacaaactaagattctgcagcagagggagagagtgtgctaaagcaacggaccaggttggttcactagtaatgcgcacttgatcaagatagagctctctcaaattgctcaggtttgctacaatggtttgaaaactccggtcttgaaaaaacagatatttgaaggaaagatcaagagcacgcaaattcttgagatgtgcaattccaatgggtatctgaccaaagaagcctgcttctgacaaatcgagcctgaggagtttggtgagccgctgaaacccgaaactaggaagaacggtccggttgaaatcgttaccagcaaggctgaggtttctcagagtggtgaggttgaagaccgctgggtctaggccaccggggctctggagattatagtaactgaggtccaacgctgttacctgcccagaggatgtgtcgcaggtgacaccctcccagtggcaacagtcggtgttcagtttccatgacgagaggtttggattaatgaaggagctcttcagctggagaagcgcttcagcttggtgaggatggcaatgaactgggatggtggtgttggcaacagtttggatggagcagtacaatgtgagtagcagcagtatgaggagaagctgtggtagtgtggatgccatctctgtattggtttgccactacacataaccacttgggtgggtggttctcaaggtaatatatgtaggttaattacataggaaaaacagtaggttttaattaaaaagaaaagggaaaaggctggcctgtacatcattaaatttttatatttgttagtatttcctcaatatgttgcgttcaatcatcaatataacctttacctgttagtccaggtctccaagatgacagttagtgtgcgaccgtcatgtggctaacgttgtttccatgtccaggccggcatgttttgctgtcttttctaaggctaactgagagtgagagaagcacttgccttagggcaagtacaataacgtgaaattaccggctaatttggattttatatctatgtggcggagagagagtaccatgaatgagaaacgtcgtcgattaatctgtcgaaggtcatgcacaggcaccaatgctcctatcgccgacttgcaggggcggatccagcgtggttgctggggggactcgagtccccctaccccactggatcaccattgatagaaggggagatgaaagggaaaaaatagggagaaaatgaagagtagggggactgaacaaagaagcccccccccccccccaaaaaaaatcttattctgaatccgccccggctggcttagcgccttcctatcgacaacaccatggacggaacaagaaattagcatgaatgatctttccttgatcggcttggaggaaagagaaaagctgggaagaagtgagggagaaataattaaaccatgattaatatgagtgttgcagtaaatatgaagagacaactattatatttattatctattaagttgcctctaaatggcgtgtataaagattaagagtaagcagtcgtcttttctattgcccttgcccttaggcatgtccagttgccacaccttggccgtgtaagaacagtctcgagtcttttgataggtgcccagtttttctcactttttccaacttcacctccctttttgtatgcacatgtttcccaaattgctaaatggtactccctccattccaaatttatctacatatagttttttttaggttattcctaaatgatctacatattagtgttcattcattaagtctattcgttatttgtgtattggagtaaatggatattgatgcatgcatccatgcacacaagtatttataacccacatgcaatatcttgatttgctattggctaggaaatagtagggatggggcatgcatcgagtttgttgctagagtaaatatagtatgagagagttattagcttttcttggtcttggtgtacatatgaaatatatagatcaatttagaatggagggagtacattttttacaaaaaaaatttataggaaaattgtcttaaaaaatcatattaatccattttaaagctttttagctaatatttactccctctgtcccaaaatataagcatttttagcatagcgacaagtcaaacatttttaactttgactatcaatagcaaaataataataataataataataataataataataataataataataataataataataataataataataataataataataataataataataataataataataataagatcaataatgtaaaattgatgttactagatttactattaaacaaactatcataatatccaactctttttatttaaaacttttttacttttacagatattattggtcaaagtagcatatcagagaccgtgtcagagtccaaaaattcttatattttgggacggaggggtaattaataatactctaatctgtcacttcgtttttcgtgcatggaagattagttcccaaacccatttgccgaacatcttgatgtctcaattctcagaaactttgatgagaatgctacaaaccaaattgcatggcaaatgtctctgcactttgcagtaggttgtcacttgtcgggaaaatatcgacagttcaatggggtttacactgaacagaactattgagagggcatgcactctctctttttttttgaatggaactagcacgagagtgtgcttttttattaaatatagaaggagaaaaatacagcccctagagacaaagaaaaggcgaaagccaaactctgcacactatacaaggtgcgggataagatcgcgcaatcgcttagcgcctgccaacgcccacgtgctagcttcttcttttatttttgcggtgagatataatgttgtggcctccttgtgctcgaagattcgctggttacgctccttccatatttcctaaacaacgatgaggatcagggtgcgcaatcccttcttgaggatgccagccgaagtggctaacaattcccaccaatctttgaccgtctgagtcgtctcccaatgccgaggatggagctgatgatatcccgagagggcatgcactctcaatctcattgtgtgctacgatatgattgtgatcaggtctatttgttgctcagtttgagaaaaaaatgttatacatactcggcagagtgcacggtctctgatttgctcatttgaccaataatattcataagagtaaaatgtacgggcggtccttaaacttgta

SEQ ID NO: 62023 - DNA, 620 bp, Oryza sativa
tctctatttcatgttctgtttacaatgagtaaacaatatacatatttaggaatgtgctagcaaatcatgcattaggatatatttcctcaatatgcatcaatacaatatcctgctaagttatatacaaatctcctttggatacttaagcacatacaggagcacactataaagtgctccatccaaggtaaaatattagaatttgatcgaacttcggaaatagttacataatatattattttattatgtttatagtactatagtatgttaaaaggaagtgtcaaaattcttgcactggggaccagaaaaatcaaagctaacttcagaaaaatcaaagttaagaaagtgtttcgttataggatgaataaataagaaatttttggggaaaaagacgtgctcagatgcttgtttttctgatatactgcatttttatttaaggtatctatcacaagggaatcttagggatgcaaatttgctcatggacgagctgaaggatcaactaaaatctgctgacttggaaatccccaaaacagatttaattcagttcatcaagtatctcttaccgacgtaagtctttcctgtctttcagtttgcattatttttatgtttcttttccacatttt

SEQ ID NO: 62024 - DNA, 14430 bp, Oryza sativa
cgcgcgcctcgtgacgaggccggcggcggcgaccagcgggagcggcaggtggaggtcggtgttcggggcggtgtgggagcaccagaaccattaccagcagcgacggcagaagcagaagcagaagcaggagcgggagcaggcgacggcgaggcaccggagcagcagcggcgcggcgcggcggcggagcgtggcggaggcgctgcgggaggcgggcgcggacatggtggcgctgcagaacgtgcgcgcggaggaagggcgcgggatgcggccgctgtcggagctcgccgaggggctcgggatgcggtacgtgttcgccgagagctgggcgccggagtacggcaacgccgtgctctcccgctggcccatcaagcgctggaacgcgcgccgcctcgccgaccacttcgacttccggtacgtacgtcacacccgcgacacacgtcagatcgtcatcaccacgcacgccatggccgccaccatgcgtgcctacatttgctgccttactagcttcgaatcacgcatatctttttcacgaacacgtaaaaggattgcacggcggtatattagaagaaagcaataccgaatcatgcatatcatttgcattgcagtaattacatcgtctcatatcttaattacattacattacacgtgcgcacttacatacatgccatccaaagttccaaacaattatgaaattttgacatttgggaaaaaaattaatgactatagattatgctgttattaaggctagtaaaatcaaatcaaatccagctgagcatagttttacactatttacgaccaaattagcgtttctccctcctccatatgtggttcaagtttagttttgcatctgtgttagatgacaaattgccccttgactatcaataacgaagctttatactatttgatgatatgcacgaaacgaggacacgttgctatcaaagtctatcccttcagtaagtagaaaaccaccaatataatactatttgtatttctgcatacataggagagcaagtcaaaacttttgacagaaacaacaaaaagtagctgatttttcttactttctccatattcttaagttaagtggcaattatcatatacgacaatgggacgatgacaatttagatgagaagggcatacgtatgtatgcactttggcaagtacaatcacaaaagattagtcatggagtaagtgtagctgaaatgttgccttttttcccccacttaatataacagtagttgatgaaatgcttagcagttcagctgctgagatgcttacccaatggactcagcctgatctaagctagtaactgagctaaaaggagaattaggttagctgcttcataagcatcgagaggccaacatctagcaatcagcaaaggttgctgcagtgtcgatcgatgggtcacaattattatccgcgacaggattagtagcgtgacattatcaaattattaatgctttggttcttcattaaactagctgccacagtaggccacacgggcacctcgatcgcacttaataggtcccgccggtgtacccaacgtgagtatacatacgcacattctagctcggagacaacaaacaacaaaaaatgcgttcatttgaatcaaacatgcattataggggctcatttaagactctaatcgaattaataatggttattttattcagcaggtgagaagcgtgactcatccatccactgcacaaattaagacaaaatgtccccaaaatcctaaattaattccaagctagtagcattcagaacataaatagttggagagagtagcagcgtatgtgtatgattaggcctgaatttggtatggttaaaatcctagataagttaatgatcaagaacaaggaacacagtaagtaagagagtaacaaacatattaataaggcattaatggtgcaggaacgtgatgagagccaccattgaggtgccgggagccggggaggtgaacctgtactgcacccatctggaccacctcgacgagggcctcaggatgaagcaggtcgactccatcctccgcttcgccgacggccaccaccacatcctcgccggcggcctcaacgccctcgacgcctccgactactccgccgaccgctgggccgccatcgccaaggtacataccacacaccaatcaatctattaagttgcatgcaccagccagttgcaactaaaagcctaagctgatagggaaagatggacaattcactttatacattccaacacaatcaatcaatcgattttgtccaagaaaccatcctgatccatcctgatcatgggcaatttccggccggcggcggcgtgcgtgcagtaccacgaggagatcggcaagccgccgccgaagtcggaggtgatgaggcacctcaaggcgaagcgctacgtcgacgccaaggacttcgccggagggcgtgacgccggcctggtggtggttcccaatggccaaggttagattactgacaaatcttatcgcttgcagaattattccggcgatctgaagctgctgctaattaacatcgctgagatcttcttcttcttcttcttccatggtggtacggtgcagatgtgcaggggacgtgcaagtacggcacgagggtggactacatcctggcgtcgcccaactcgccgtacaacttcgtgccggggtcgtacgccgtcgtcccgtccatgggcacctcggatcaccacatcgtcatggtggacgtcgccgtcgccgcccacgatggcggcggcggcggcggcgcggcgaggcggcggcggaggcggagggtggtgaaggtgacgaacaagagttcggcgagagggatattcgccgattagactagatggattattattgggcttctggtttcttcttccttttgagtgaactgtatatgtgtctcagtttacggcccaaacacttttttttggtggggatacggcccaaataattatctggccgaataagcccattagtaatatgaaccgaatggtagcgagcgatccaatcttggggtttgggttccaggaaggcccgtcaacattttcgtacgcacacagaacattgtcgtatggaattattcatccgatgccccttaacttgtcaacgaatctgattttcgtccttcaaccagaaaaccagatacaacgggtccctcaagtgttaaaaccggtgtaatatataggtcccatggcggttttagtagacgtggcgctgatgtggctaatttcactcggtcttcatctgacgtggcattgacgtggtatatatgaaataaaatttaaaaataaaacaaaatatatggtcccacacgtcagtcaaaataataaaattaaaaatagtgagacccacatatcagtgtccccattcatccacctcatcctttttctctgtctgctctcctcctcctccctctcttctctatcacctcatcatcttcttgttagatatcatgtgtatatctggatgtgtccggctggttgatcctatcctttagctgttgagatagcgttgtaatccaggttagttggagatatatcagccggactattctcgtcttgtaaaccacgatgcaggttgtttgcatcatatattaatacatgcgacgcacccaagaggaggtgacgatcgcttcctgtcctctgactttcttcttggtatcagagccttctcctctttcaatccaatctactcatggcgagctcgtcccaatctccggccgttggctctcttggagggatcacggtcacggagaaactaggcaaggggaactacctgatctggaaggttcaggtccttgcggtgattcgaggagcacggcttgacggctacctcaccggcgccataagagcgccatcgccgaccaccatcatcaagaagagtgacaaagatgttgaggtccccaatccagcgttcgacgaatggatcgcgaacgaccagcaggtactaggatatctgctaaccactatgagtagagatgttctctccaaggtggcgacgtgcggatctgctgccgcgctttggagcgtggtcgaagggatgttctcctcagcgacaagggcacgctccatcaacaccaagattacactgacgaacacaaagaagggcgacctcagcgttgccgaatacgtcggcaagatacgggcgctagctgatgagctagcgacctccgacaagctcgtcgacgaagaagacctaatctcgtttatcattgtgggattggatgaagattttgaacccatcatttcctctttggtgtcaaaatctgaacatgtgagcctaggggaggcttactcccagttgctcagctttgagcagcgcatgaaactccgtcaggagcactcggcgaaccttgctcacagagggcggggtcgtggacaacaacaacaaggcagaggttgcggcaatcaaggtaatcagcagcagcaacaatgcggtcgcggcggaaaaaattgcgggagagggcgcggcaacacctcctaccagcgacaaggtggaaacaacaccgacaaccgtcccaagtgccaactgtgctacaaaagggggcacactgtgattgattgctggtacaggtatgatgaagactttgtacctgacgaaaaatatgcaggaacagctgcgtcctatggtgtggactccaattggtatgtggacacgggtgctacagaccatattactggagaacttgagaagctaaccattcgggacaagtacaagggccaagatcaggtgcaagctgcgaatggtgcaggtatggtaatcactcacataggtcgttcaattgttaacaccccatctcggcctctgtacttgaataacatcttatatgttccaaatgccaacaaaaatttgatttcagcatatcggcttatggttgataactcagcttttcttgaattgtatcctaaacatttttctctcaaagatcaggccatgaaggagatacttcttagaggacgctgtcgtggccggctgttcccgcttccatcttcatccccttcagctcatcaagacaaggaagccctagctgccactacaccgtccctcgagcggtggcattgccgccttggtcatccttcctatgctatcgcagaaaaagtagttcgtaatcatgatctaccagtgtcagctgagtccaataaaatgttggtgtgtgatgcttgtcaaaaagggaaaagtcatcagttgccatttcccaagtcttctagtgtctttagttttcccttagaattgatttattcagatgtttggggtcccgctcctgttgccgggggtggaaagaaatattatgtcagttttattgatgctttcagtcgctttacatggatttattttcttaagcacaagtctgaagtttttcaaaagttttatgagttctaaagtcttgttgaacgtatgttcgataggaaaattatagctatgcaaaccgactggagaggcgagtatcaaaagttgaatacttttttcagcaaaataggcattacacatcatgtgtcctgtccacacacacatcaacagaatggctcagctgaatgaaaacatcgacacattgttgaagttggtctctctcttttagcacatgcttccttgcctttaaaattttgggatgaggcatatcaatctgctgtatatttaattaatcacacacccactaaagttcttggtttttcctctccacttgaatatctgtttaaacaaacccctgactatcaagcccttagaaccttcgggtgtgcgtgttggcctaatcttaggccttacaacaatcacaaaatgcattttcgctctaagcgctgcaccttccttggatacatccccattcacaaaggctttaggtgtttggattcatctactggccgcatttacatttcccgtgatgttgtatttgatgagtccgtttttcccttaaccgaactaaatcctaatgctggaaccaatctccgtaaggagatcaaccttttgccgactgacatgattagttttggggttgttcagttggatgatcatgtgagttattatcctgcaattcctgctaatctgtctcctgcagaaaatttggagcaaaacgcaacagcaaatacagaaaatgatgcagcagaagatgcagccgattctggtgcagccgaacaccaagcagctgacaatatctctgatgctgcacaagaggacagtagtcctctgtccgccgcgcatcattctgcacacgaggatgctgccgatgaatcatctgcagctccgtcgccggctgaccagtcttgtcaaccacaggcgcaaggttcctctgcgccagggggagagccacagcgtccagctactcgaccagtcacccggcttcaaaaaggtatcagaaaagaaaaaatatataccgatgatactgttaagtatggttttctcaccactaccggagaacctagagatttagctgaggctttacatgatacaaactggaagcatgctatggatgcggaatttacagctttattacacaataaaacttggcacttagttcctccacaaaaaggaaaaaatgtcatggattgtaaatgggtttataagattaaaagaaaacaagacggcagtctagacaggtacaaagttagactagttgctaaaggtattaaacagagatatggtatagattatgaggacacctttagccctgttgttaaagctgctactatcagacttgttctgtctattgctgtgtctagaggctggactctaaggcaattagatgtacataatgcttttcttcatggaatacttgaagaagaagtctacatgaaacaacctcctgggtatgaagacaaagcaaatccaggttgtatttgcaaacttgataaggctttgtatggtttgaaacaggcgcctagagcatggtatgctaggttgagtcagaaattgcagcaacttggatttcagggatccaaggcagatacctcattattcttttacaacaaacaaggtcttacaatctttgtacttatttatgttgatgatataattgttgctagttcgaggcaggatgcagttctaactctgttgcaagatcttcagaaagaatttgccttaaaggatctgggagacttgcattacttcctgggtatagaggtaaataagataagtaatggcattattcttactcaagaaaaatatgctaatgacttactgaagcgagttggcatgattgattgtaaacctgtaagtgcatcgttatcgactagtgagaagctcactttgcatgaaggagatttgttgggtctcaatgatgcctctaattatagaagtgtagttggagcacttcagtatttaactctgactaggccagatattgcttttccagtgaacaaggtatgtcagtttttgcatgctcctactacgattcattgggctactgtgaaaaggatactaagatatttaaaacagtgtactaaacttggtttaaagattagtaagtcaaagtctatgcttgtaagtggatattcagatacagattgggcaggaaatgtagatgatagaagatctacaagaggttttgcagtgtttctaggagataatttggtttcttggaacgcaagaaaacaggccacagtttctaggtctagcactgaatcagaatacaaggtattggccaacgctacagcagaaatcatgtggatacagaccttattggcagaactgggtgtttctagtcctctaatggccaggttatggtgtgataatcttggtgctaaatatttgtcatctaatcctgtttttcatgctaggactaaacatattgaggttgattatcattttgtacgagaaagagtacaacgcaggttgcttgaagtggattttgttcctacaggagatcaagtagctgatggattcacaaaggctttatcggtaaggcaattagagaattttaagtacaatctcaatctaggtagattgtgattgagggggagtgttagatatcatgtgtatatctgaatatgttcagctggttgatcctatcctttagctgttgagatagcgttgtaatccaggttagttggagatatatcagccggactattctcgtcttgtaaaccacgatgcaggttgtttgcatcatatattaatacatgcgacgcacccaagaggaggtgacgatcgcttcctgtcctctgactttcttcttctcccttctcctcgccaacgcctgcacgccgcccacgctgccagagaccgggagggtggtggaggttgagggccagatcaccaggtttcatgcgccttcttttccatcttgccgcgcacaggccacgacgctgtcctgctcggccgctggccacgctaccatcctccgctgccgtgggccacgccggctcctctcccccgcggcgccacctagagttgctgcggttgtcgcaaccgttgcaagaagctgcagccgccaccaccaccgaaagctcctgcaggcgttgtcatcaggcgttgtcatcgccgtcgccatggtagggcgtggttgatgtaaaagtttactataggctacgcctattgattatactaaattatactacaggcttggctgatgtaaaagttttctatataaattaaagttattttaaaaatcaaacaaatcaatcttttaagtttataaaaaattatactcgattaattatatactgataacttgtatcattctatgtgctatcagaatctccctgtactcactactcacacagtatgaaaatggaactgaaaattcccacgcgcgtggaggattcatagtttcatatataccacacgtaccgacgtacgacggttgaaggcatcacatccccaggagaagtcgcgatgaacttcaatttttcagacccaaattttccaattcactagtgaaaaatctaaacattacaccagagttctgaaaatgtgaagcatgagccgggctggttccaatgtattcagctgacttaccaattaattggagaccggtgatcatgtgcatacaggcatatcatgtcttgtcaggtcaaacaatatgtttctggccggtccactaatagctactcccttcaccccactttaagcgcagccaggatttcgtgtccaactttaatggttcgttttatttattcttttttaaaaaataaaaaacataaaccacacataaagtaccgttcatgttttatcatctaataacaataaaaatactaatcataaaaaaattaaaataagatggacgatcaaagttagacacagaaactcatggctgcatttaaaataggatagatggagtagtataggtaacacagtagattgatcacatgagcgagatcattttttctaggcaaaatttgctacggaacacttacaaaatatgtatttagctgtgaaacaccacaaagacgtgaatttgtccgagaacacttcaaaaatgtaatatcctcctagttgatgagagagaaccatataaaataacattttttcccttgttcttcctccaagtcttcttctggctcacttggagcgagctccaccgacttacccatggcggacagccactcgtctcaacatcacaactcaacaccctaaataaaaaaaaagggcatcggcataataaacaagaaggcgacaaaaaaagaaagatttttttaacactgactatgagctagtgatgaatgagtgtgagcgataatgactacacgcactgattaattgcttccatccatggcgatggcgcctgccggcacacgccacatgatgttgcacccagtgttggggtcctcgtagcattgctgctgttggtagtacggctgccggttgccgtagtaccatccctggtggtcgtacgacgccgtcactgaggccactccgtagtacccactggtcaccggcttgttgccgccagcgcacgagccgcagcggcacgcgccgccgcagccgtagccttagccgtcgccgtaatatgaggactagttgtacaccgggttgtcgggttatagttgtagcatgacaggaagccagtgggcaccggctagatggacggcacggcgacgccttgcgcagtcggctcgggcggcaccatcatcatcggcggcgcgatcggctagccgtgtggcggctcgaggctggcgtgctgtctgccatgggcaaaccaatggaacttgctaggagtgagcatcggaagaagacagagagaagggagaaggagataataagggtaaaattatcattttgtgtggtttctttttcatcaataggatagatattatattttaatgcgtccagtatcctacggtaaattattgcacttttagagtgtctaaattcacgtctttacggtgtcctacaactaattacacattttttgagggtcctatagcaaattttgccttttttatatctatcgatctgagtgacgcttgttctggttataacacatattctaaattaaaagtaatgtgtgaataatttttagcgacttaaaaaccaatggcgaaaaataaaaataaaaatcaactgaaaaattaaattttaaattttaaaagtcagttatacgttagagagtaaacgaggatctgacatatttcaatatttgacctctgtggtagcatgaggaatgcatgcatgcctgaaatttttacattttggtcctttttaaaatttattttataaatagacccttgaaaaaacttaaaccggaaatgatcctttttgggacgccagagtggctggcgccgtaccccaacatggcggcgccatccacactggcgccgtgcccgtgccaccgtggcactagggctgtcgtggaggtgctgactaggccgaagggggcgccagccaaagtggcgccgcccctcataccatgtgcccctcctctacgggccccaccaactttctcccccccccaaaaattttcgccctgttctgcctccgggcaacagctggcgcctccccccgaccgcggcaccagggtggctggcgctcccctcctccccccatcgaagcccttccgcctccgggcctcggctggcgccgccctcatggatcacggcgccagggtagctggcgccgccctcccccagcccaaaacccttctgcctcgcggcactggctggcgccgccctccccaaccgcggcaccagggtggttggcgccgccctctgcctccctgcaaattgaagatccatattgcacaaatgtaccaattcacagttcgcaattcaaatcacaattcacagattcgtacagactaaaacaggttctaattgcacaaatcacaatgccaaaagtccatcacatagtcctcacatagtccatcacatattccacacatcaaacaatgcaaaaaatccatcacatatcccacacatcaaacaatgccaaaagtccatcctatattccacacatgaaacaatgtcaaaagtccatcacatagtcctcacatagtccatcacattttatatcacatagtgcaccacatatgtcatactaccaaccaatagattaacttcatacaaattacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcctgagtggatcgcaagttgtattgcgtgggttacgtcccctgaggcgcgtcgggaagctgtgacatgtctatctcctcggcatctggtgcgacgtagtcctcatcctcctcgtcctcgtcgtcatcgtcgtcgctaggtggagccggcgccttcccctttcccctcccttgcttaatgcgtgacgacgacgagccaccaactccttcacgctcttctatcctgatggagtgtcgagcgatacttggacgcgcggattgaggtagtggtggtggtagtctccccggttggtacacgtcgtccaatccaaccgacctgcaacctaatcttgctgcaagtttccggcacctttgacgaactttctgcatttaaaaaaaaaagaagtttgttaggcataactcaagtaatgcaaagtgctaaataaattttacctctaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgactctgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaagtactctgagaaaagatgattttggtgtatagtctcgatgtacctgtcgttccttccggctgtcctccattcatcaatgtatctattatgctctagcccccagtctttcaccttctttgttctcaccctgtcatacctagacaagtagaaggtgatgaaacaatagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttgtatgccacatcccggtgagcatgtgcagtggcagtactctcaaaaaggtagaccactgtcttctccatgtctggctcattgtagggccaaggagtgaagctttgcctccacttaggccttccaaccggtagtcttaaccacatccacatctgaatcaatagcacacaaccactcatgttggatgatggtgcctaacgacaacaggcctcacagagctgtctatatgtccacgtcaacactgctgagccgcaactgaaacggcccagatcaccaaggtcggcccacagaggaggggcgcgccagccatgctggcgccgtggtatgaggggcggcgccagtgtggctggcgcccccattctgcccagtcagcacctccacgacagccctagtgccacggtgggcacgggcacggcgccagtatggctggcgccgccatgttggggtacggcgccagccactctggcgccccaaaaaggaccatttccggtttaagttttcccaggagtctatttgtaaaataagttttcaaaaaggaccaaattgtaaaaatttcaggcatgcatgctatacaacagaggaacccgttcctattttgcatgctaatttcataaagtagaatattgatatatgcagttcttaaattcttaattttaaatttactcatgcacgccatgtactaggtagctaggtacagtttttaaatttattcattatttttttaggaataattaactactatttgccactcttacgtgtggttctaaagaatttatgtcatagacagcgagtggcaaatccttaattgccacatcttaaaagtgacaaataattaaatgcccttttttttacctgtagcgaccaatctaaactgtcttaaaaaatgttatctaaaagagtttcaaggtttttaccatcttcgttctaaaatattgctatctaggtcccatcttaccatatctaactgtacacaatgcactagtgtcctagtcgctagtgccatgcactatttgacatttgcggagccatcgtttcaccttattcgtggaaacttatatatatatatatatatatatatatatatatatatatatatatatatatatatatatattcttagcgaactaaaagcaaaggctaaaaaataaactttaatgaaaaacctcaaaatcaattctaaatttacggttaaaaattcaaatattggctgataagtataagtataagcgaaaagataaggcccttgatgtagcatattgttgcgctagaggaaccatcgttcatattttaccatcgacaggtatatatatatatatatatatatatatatatatatatatatatatatatatatatatatatatatatatatatatatatatatatatatatatatatatatatatatatatatatatatatatatatatatgtatatatacatatatatgtatatatacatatac

SEQ ID NO: 62025 - DNA, 1351 bp, Oryza sativa
aatctttggtggtgtggaataggcaaaatacgttgggtggcataatgttagatgaagtgattgatacacaggtggttgtagaggtaacgttgagtgatcaagtgcaggcttgctggagcaaaaagaagatgatgcctcactcagtcgttgacggcacaatctagctaacctgctgccattgtggtgattcatgcctcctctccgaagactctttgacttgtactaatggagtggactgctaccaaacacgcatgaatagacgaccagatcatcatacaattcatcaaaattagcactcctagtttcaaactacttaacaaaggaaattcaacaaacttcattaaaatagtgtagtgtatttttttctttaaaaaaaaattgccaacgccaatcgcggagtttcacatggaggagggaagaatggaatgagcgccaggcgtcgcgtcggcgcgcgcgtgagtgcgtgatttgtgttggttgtcttcctcttggcttcgcttcgctgctttgccgcgccttcgccgagggaggccgaccaacgcatcaatcaaacacacaagcacaccacgcggacgcagcagcaggggaggagacaatttcctattcttcctcgccccgcgtcgcctcgcctgagtctgactctccaaacgccgaccagtgacgccgcgagccttgccccttgcccgcgcagatctcaccaaaccctaccagatctgcgccccgccatggactccgccgccggcggtggcggcctcacggccatccgcctgccctaccgccacctccgcgacgccgagatggagctcgtcagcctcaacggcggcaccccccgcggaggctcccccaaggaccccgacgccacgcaccagcaggggccccccgccgcccgtaccaccaccaccaggaagctcgtcctcgcctgcatggtcgccgccggcgtgcagttcggctgggcgcttcagctctcgctcctcacgccctacatccaggtatacccactaccctttgctctcccttctgcttcagaatggagagtatccgcatttgggaacgggaacggatcgcccatatatgcgtggcttgatgctcccttttctgtttctgctgacgcaaccgtattagagcaccaaaattcgcgccctacatattttgtgctttgaatgcaactgcttactgaaatcaaggttgctgccaaatggcaataagtgaaaaatcagccaggggaagacttgcctgcttaggaatttcgataccgtaaatttcgatacacaggagaggtttaactagatgaaaaattcacactcttcacatgtacatgttaaagcatggtttcttaacaccgaataacttg

SEQ ID NO: 62026 - DNA, 55604 bp, Oryza sativa
  unsure (1)..(55604): unsure at all n locations
tatatatatatatatatatatatatatatatatatatatatatatatatatatatatatatatatatatatatatatatatatatatatatatatatatatatatatatatatatatatatatatgtatatactccctccgtatttaaatgtatgacaccattgactttttaactaacgtttaaccattcgttctattcaaaatttttgtgcaaatatgaaaatatttatgtcatgcttaaagaacatttgatgatgaatcaaggtacagtaaaataatgataattacataaattttttgaataaatttgatgatgaatcaaggtacagtaaaataaatgataattacataatttttttgaataagacgaatggtcaaacgttggataaaaattcaacggctatggaggtagtagtatttctttttgcaagttgccaagttggtaagccggtcgatgtcaccatgccataaccgtggagcgtgtccatgtcaccgcatgctataagggcacccgcaatggttacctataggctatctacaagagattcatgtcagcatatattttcctacttggaagaaattaaatgaaaagagagagagcaaagctatctactaaactggagatagtctatagagaaaagcgagacaatggatttagagagttatagatacccatgtagatgtactattaaggtggtttactattaatctagtctattactgatatgtacattgtcggtgatatgggaccgggggtatcgtgaccagaggcttgaggcagacacaatcgcccatgcggcctggcaccttcggggacgtcgggcccgagggtgaggtgtccgccctcctcctgatttcccccgagggggggtcgggttactccggtcccggccccgagggccgaggcaccccgaccccttgaggaagtttgcgccacatatatgggataggtgaacacggcagtgctcacctaaccgcatttattgtaagactggtcaagcgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccagtctgacactggtcatgtcgtcggcagacagccacgttcccacgacgcgcctgccttcggcagaagtggaggtaggtgtgtgccgtcccgtcagaaggatgatcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagatttggaacttagaacaagtaagaggttggctcacattttgtagctccctcatacacagatccaccaaaacacaggagtagggtattacgcttctcagcggcccgaacctgtatacatcgcccgtgtctcgcgtttcttcctagctggcgatctttccacataccgagagagcttgagatttcaccctaagcccccggccgaaccggcaaaggggggcctgcgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcgctcgatgcgtacgtgcggaaccaatggccgagaacgggtacgtgtgtttcgatctgtaattttctttccccaactcgcggcatgtcggcatgtagtgtaattctcctgcactgacagaatcatgggcaaattaaacatatcaaaatcacaacatctgggaacagccgcacacgcttcacactcgcacgagaatattaaaatcacaacaatagctatatatataggcctctacagctaagctacctcgtcaattaattaattgttttatcgtggaagatgggctcacgtttcagctctataaatacaactcttcagatcagagctaggcacaccacttcacttgtgtagctgtgttctctctccataacttcacttcacgtacttcaactcaaacacagtagagttcgtcgcctccttgtcatcactgaacacacacacgctgctgacatggccgcgagcaaggctgcagcagcgaaccagccgctggagatggacgctgtcgtcaatggcggcgccggctttgaccttagtagcgattcatacaagttaaatcttctaatcaatggtgggccaataatgaattttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccatttcgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatataaagatcatgagctgccccataatgaaaccaccaggagtcgcgaatatctccttcttccctaatccaagattggagaaagaagatccaagagggacccatggagaatgtggtcagaaacctataatagagtccgaccgcaacgacctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctagaaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagnnnnnnnnnnnnnnnnnnnnnnnnnnnnnnnnnnnnnnnnnnnnnnnnnnnnnnnacttggggagatttgattcattctttaatgtaagaataaagaattgaattaaagggctttctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccggggtaccctcaaaaggaacctccctctcctcagccatttcatttcgggttaagaagatgggaaaacccctttctctctataagaatagtgcgttccgaggtgtgaagtgggagagaggggatgtgatgattgaggttttgaataagaagacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagataaatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcacctacgcccctcccctctcgcaggcacgggcgtgatatcgatccagtggctcacatgatttctgtcaaatttcagacaaaatttgatcaattttcgcctgttttaaacgatcatatatatattaattgatgcaggttgtgaggagcggatgagggcgcgggcggagcggctcgccggggaggtgcgccgcaggatgttcgccgccggcggcggcaacggcgacggcgagggcggagttacgatgagcgtggccgaagcggcgacgctggtggacacgctcgaacgcctcggactagatgggcacttccggcacgagattggtgtgctgctggggcgtctccgccgcgaggaggcggattttgcaggcagcgacgacgacctgtatactgttgcccttcggtttcgtctgcttaggcagcatggggtctgggtatctgcaggtacgtaactgttagtcttggattaattaatactatgatgattcatagaggaaaatacaagaaaattggttttgcataaacgatttaagaacgaatggcaatacatatagttaacggatttgctagaaaacttctataagttttttgttcccaaaacttttaggattgtaaccatcggatcgccttgagatttgtgcatgaagaaaaaaattgctaaaagaatgtttcacacgtgtcacgcgtaagatttcagtactaactaaccaaaccatagttgaatgcaagttttatataagttatatcgtagttacaatatagtacaatataattacacttcaattatattatagttacatctgaaagttttatactcaaaaaacttgtgacaatttttagatatagatactacctatagttaattaattaatttggcattatgttgtgtttgcgtacgtatgcagatgtgttcgcgacaagttcagagatggtacatgtagtttcagctcaagcctacgtgatgacccgaggggcttgctgagcctgtacaacgcagctcacatggcagcacctgtagagatcgccctagacgacatcatcgccttcgcgaggtgccacctcgaggccctgtccatggaaggcgagctcaaatcgccattggctgagcaggtctcccgcgccccggacatcccactcccacggttcccaaggcggctcgagaccatgagctacctcgtcgagtatgagcaagaggacgaacacgacgacatgctgctggagctcgcgaggctagaattcgagctcacgaggtgtcttcaccttgaggagctcaaggctctctccttgtgagtgatcgtttcttatcgtctcattgctgctgccactgtcttcttcgtcttcgctataagtgtaagaggttgatgatcttgcaggtggtggagagagctttacgagagcgtgaagctgagctatgctcgagatcgcctagtggagtcctacttctggacatgcggcgtgttccatgaggaggaatactctcgtgcccggatcatgtttgccaaggtatttggattgctgtccctgatggatgatacctatgacgtccatgctaccttggaggagtgctataagctcaatgaagctatacagaggtctgaattaattaatctctcatgatgttgcattgttgattgatccttatgctggtgattcagctcacatgtatacatgtcgatgtgcagatgggacgagggcgcgatttctattctgccagaatatttgcgcatgttttacatcaagctgctgagcaactttgacgagttggaggctagcttagaaccacacgagaagttccgcgtgtcctacgccaaaaatgcggtaaatattcatagtaaaaatcacatttcagtctatgaaacatgctaatatgtagagtaaaatcagtagaatctcacgtgaaattctccctttcctgtccatgtacagtttaagctgtcgtctgaatactacctccgtgaggccaaatggtcgaacaccaagtacacgccgagcttcgccgagcacctggaggtgtccgtcatgtcgtcgggcttcccgatgctggcgccggtggtgctgatgggcgtgcacgacgacgccgccgtggcgaccgcggcggcgttcgagtgggccaccgccgccggcgtccccgacgtggtcatcgccgccagcggcgaggtggcgcgcttcctcaacgacatcgcgtcccaccgcgtggggaagaacgagaaggacgtgccgagctcggtggagagctacatggcggagcacggcgtcggcgaggaggccgccctcgcggcggtggcggcgatggcggagcacgggtggaggacgatcaaccgggcgttgatggagatggaccccgggctgctgccggcggcgcggctcatcgtgaacctgacgaggacgctggaggtgatctaccttggtggcagggacggttacaccttcggcggcgacatcaagggcctcgtcgtcagcctcttccttgatccggtcgccgttatacgtatttgagctgaatttgaatgttctcgatcgatcctgtataagttgtgtacccgtgtattccaggcttctagctaggtgtgtgaaagctaggccagtaaggtatagtaccgttggaaaaatatgggtgatttatagtagtagttgtttctaagagataaattacacaaactattgatgcaaaataaattttgagacagaactcgaaaatatatccaaaattttgaagaataaaaagttctattaaaattggttctaatgctgttgaaaagaaggtgtcacatttaggggtgaaaacgaatcaaatatggtcggaaactagctctaccatatccgttttcatatttcttttcacggaattggaatcagaaacccggatacgaaaacagaatcgaatattatcgaatatagatacggagtgaatacgaatcgaaacgaataaggtaacgaataattatcgaaatatcaagacccctcaaagtaagcttcttaaatcgaggaagaggtgtagccattagttttcaaaaacaaaacatcaacatgttcaaattttatctctatttgtaagtgcaagggggagatagaaaatgttgtgtttactttcatacaaatttatgttatcatgaaacaaataaattaatgtgtatcacttaaattttcacaggcacattaaaagttttgaaaattggttgagtattttaaattttgggttgaacatttcaattggagttgagagtttcgaaattgaattaaacgttctagaatttaagttgaattttttaaatctgagttgagagttttgaattcgaactgaatatgtggagaaaggaggaggaagaataagatggctgagaatgacatgtggggcccacgtggaccccaccatttttaattaattcttttagtgtaactgacaatggggtcattgtttttattaattctcacatcaaattgctacgtcaatgccacgtcagaagaagaacgggtcaatttagctatgtaggcgccacgtaagctaaaaccaccatctaaatcaccatgggatctatattgcaccggttgtaatagttaagagacccgttatatctggttttctagttgaaggatgaaaatcggattcgttgacaaataagggaccgcatatgaacttattcctttactatttgacaattttcatattgcatgggctacacacatgaaattttatggatttggcccgttattgaatttgatatgttttcatgtgtttgtagcactgggcacatgggcccaatatatagcccacatgtaggctaattattattttttaatttgtttcaaatttatatgtacgaaagttatacgtacaatgtttatatgcatatgcggagaaagtagggccagggcttcctaatgcacgcgctgctctgtgggggcaagtcgtgcacccccaacaagcgacccctatattacttagcgcacccccgacccgcttagtgttaatctggttcaataacattttgtaatataaattaacgaaaaagtgttaagttgaaagtttctatcagtgttatggataatgcatactcaatagttttgagttaaactcggtggggcccaccatatattaagtcctacacagaatcttgcctcgtatgcggaaggtggttcaagttgaagtttaaaattcgagctgaaagtatcgaattccaagtcaaaagtaaatttgatatgaaagttttgaaacttgagttgaaagttccaaaagttgaattgaaagttttagaatttaagttgattgcttcaatttgagttaaagttttaaatttcagttggaagtttttgaaatttgagatgaatggtttgaaaattgagttgaaagtttcggaatttaagtagagtttcaaatttgattcaaaagtttcaaattttaaatatagttttcagattttagaaaaagaacaataaacactagtttgaggaaaaaaaaccgcatagagggttaccaaatttacgtttaatcagattgtacaaaatgactaattagcgcatgtgaagaacccttgcgccgcgagcctcatgagttaaacaagttgtgcatatgcacggaatagatttttcacacaaagtatcaatgtatttggtttttatgcttatttattttgaaaaaaaaatctgaattaccccttgaactattgaggtagtacaatttacctctaaactagttgttttgcaccccttactctttaagcgccgccgctcaccgaccttgggttcttggccttttcccgagagagggagaggggtgagagatgtcatgtgagcccacttggatatttattttgacgttttgttgctgattggagtgtcaggttcgtgccacgtgtgcaatcctatgccaaaaccacttcaaaccatgctcacgggtaatccatcaggtttaaagagttagggggtgctaaatgtctggctttgtgatttaagagattaaatcatattacctcaatagttcaggggttaattttgacttttttcttttctttttctatgagtaaactttctttctgggctagggttaacacgaagaattcatttccaaattcatacgcatgaattttatatatacaaaatttctacgcaaagtatctatgtataaagttttacgtataattttttaatttatgaagtgtatgtgtataactttttttactggacagcatactgtttgttggctcaaagtccaaccagaataaaaaacaagcatgcgctgtggcgggttgaatgcccagggaagagaggaaacttgtggtcgtatgcacactgttttgtcattttttgccgcgcactcgtgatgtgcgcgattgcttgctcatcagactgatctctatttatgttcttgaggtgataccatataactgaagagaggtgcgagggtaagtttatattttcacgttagatggatggatatgctgtacggatgaaagaggccggtgttctcagtttcttacgcaagcgcgctcacgtaataactcatgcaaacataccaagggtttgacggctcgtgcaaagtcaccttccaaatgaataggtatagtatgcagacgacgagttgtgctgaggctgtgtttagttcagcgtaaaatttagattttggttgaaattggagatgatgtgactgaaaagtcgtgtgtgtatggtaagttgatgtgatagaaaaggactgaagtttggatccaaattttagatctaaacacagcctgagtactccagtagttaggccggccgttatatgtgccaatcagtactggaagtctgaaaatatcggtcgatcagcagtacacgtattcacgatgggagtgtatgtatgtgaggcatgtgccagtcagtgcttgctgcatgcatcatgcatgctgggccacagcctacagccctacagggagaacagtacagggtgcacatgcaaaatgaggccctcgtacgacaattcgatcgtctattcttctttttgctgaaatcgtcgtccctgtgcggcaagcggtccatgatggaccattcatgcattgtcttcgttggtcaatctcgtcactacgcgcaagcggtgacactacttgtactgtggtgtctaataaatgtacaggttctttgaaaacaaaggaaaaaaacaattgttgcactagtcgcgcataaatcatcctacgtataaacctggaccttacttttcatgtatgatatatctccattataccaacctgtagatcgtgatatatcctgcgtagacgaacgacgctgttgatcctgttaatgatattttatcagctattacactggttgaaagatctttctcaaacaacccacacccacgcgacttcacggtccaccgagagataaggcactcatgtgtcccacgcccgcacgtacggtgacagctcctcgtgcttccgctgcttaatttccctataccgcgctccgtctcctcttcttcacggaccacggccacacaaaacctatgtttaaatgtgccactttcactgagaaaactgctgcgccctgctagaaaacttgcaacctcctctgccttggagctccgtcgctgcctttcccaaagcgcccgatgccgcagctctctgcggaagtcatcgcctccactcacctgagccgacccgtcgagctttttccctgtaccgtagtctactacactaaaaagctcgcgtgccccgtagcttgctcgacaccaccaatctgctccgatttccgatcaactaccacaaccaaagccgatgaatcaccatactatatatatttctagccactaaacaacctgagtgtcaaatcttattatcatctctctatggtatgcatcttactgaagacccgtgcctcactgaaattctatggatagcttaaacacatgtgcttagtatttgtaggcatcacgatttaagttctctactgggtagaatgatggcttaaacacatgtgcttagtatttgtagacatcacgatgtgagttctttactgggtagaatgatgtacccgtgaggccgtgactccgcttaaaagcacctagttattgaggcagacgagaagaactgaacaagcaagaaccatcatatgctaggaaaaggacgatttttgtttttgtttttgtttttgtttttggagtcgtgacaaaatgccctgggtcgttttctctttatttttttttatcacaaccgactcaatccatcggcaaatacaaagacaaagcactacacacaagaggtatagagctcctggtggattaatcttatttgtaaccagggcaagtgtgtgagatgtacaactgtattggccccttaaaattatatattttgatataccaatgtgttctaatatatttagaatctttttacttcttttttaaaattttctttgtgcttcaattgaattttcctagaacgagattttttttctctgacaattgtttgataatcatagataccttgtagaactatattcatgacggtagtgaacgtgtgttctaaataataacaatatcatttgtccacttaattaataaaaaaatgaacttggtgcagcgattcttcttctgcctagctaggtcgtcatagacggcagggacagatctacagtagaagggccggtgttaggcgacaccgacgattttcagcaaaaactatagcgaaactgcttatccatatgttatgacacaatgatgtaagtataattagcacacgatgacaccgatagacacgttctgacactaacgaatcgattttctagatccgccactgatagacaggtgagtttctttagcatacattggctatcgccaatacgtataagaccttattttatattttgaatagggccacaataatttaggatggccctgtttgtaacatacgcatgcataccctagtatttattatgtgggcgtatagtgtatatgtttttagataatggataaaatctaacatttacttcaacagaagctatagccacttattacatagttattggctgaaaaacaagtataacaatttgtaacaaagaataaagagacgacacaataataaatgtcaccatcataggaaagagaaacaatttactcaaagaataatcttattattaaaattccatccaaatttagcgaaaatttaaacggcggttgcttataaattccaacatgtagcatgaatagtcaccatgtcctcttcacacatttgtagttggacatagaaccgaagccagtatgctctgaagaaaaccggcatatatgatttagttggtgttttataaaaaaccatgttaattctattcaactatagagtctaacatagaacagacaccctaactaaaataaaatatatatgtaggatcgaagttacgcacacgatttggacgaacacgtcggcacgttgctgtgtgcatgcctaatacacgggaaggggatcaagaaagaggttggagacgagacccttgaggtcgccaccgacggtgtacccgtccctgccgccgaggtagatcacctccaccgtcctcgccaggttcaccatcagccgcgccgccggcagcagggcggcatccatcgtcccgacggcggcgcactccccgttgatcgtcctccacgcgcgctccgccagcgcggccaccgccgccacggcctcccccccgcccacgccgcgctccgccatgtagcactccaccgtgctcgccatgtccccgccgctcttcccgatcctgtaggaggcggtgtcgttgaggaagcgggcgagctccccgccggcgcggaccagggcggggacggggacgctggtcgcccactcgaacgcctccttggttgtcgccgccgcaccgccgctgtcgcgcacgccgagcagcagcaccggtgccatcgccgggaagccggacgacatgagagagatatccaggtgctcgacgaagctgggcatgtacttgtcgcttgaccattgggcctcacggaggtagtattccgacatctgcttgaactgtgtacatgtgtgcatgtgcaggaaaattaatcaaaatgtgtggacgagggcacgaatatcactttagtatgcctttttttttttttttggagaacaagattttaccgtagttttcgcgtaagacatgctgtacttctcatccggctccaagctgtcctccatctcatcaaagtcattgagcaactttatgtaaaagatacgcaaatattctggtagaatagaaaccgcacttttgtcccatctgtatagatatatatatatatatcgaggatatatttatattagctagatcattgattagtaatgctcgttggcaaattgacaacctactaggccatcattaactagcaaatttctacctctgcatagcttcgttaagcttgtaacactcctccagggtggcgtggatgtcgtaagtgtcatccatcagagtcatcagttaaaacaccttggtgaatatgatccgcgagcgagagtacttctccccgtggaatatggcacaggaccagaagtaagactctactagacgatctcgagcgtagctcagctttacgctgtcataaagttgtctccaccacctgtcaatcatattcacgcacgcacatatttactagaccacgtaattgtatttatgctaactgtgcagtgaagtgaagtagagtaattttatgatagtttttactgacagtaatatatattccactatcataatctgctgatgagtaaaagcagggctattgcttataacacagttgcgtgaagcagagaacgacaaggacagtgaagcaagaaatgattgtggaagaaaaaaataatatgcataagagaaacttaaatgattacaaggagagggtcttgagctccttgaggtaaagaggtctgataagctcgaagtccagcctcgcgagctccagcaccacgccgtcgtgcgcctcctcccgctcgtactcggtgatgtagcgcatcgtctccagcagcttgggcgcccgtgcgagagggatgtcgagggcgcgggagacctgctcggccatcggcgatcccagcttaccttgcaaggacttgacgctccgtctcgagaacgcgatggcgtcgtcgagcgccgcttcttcgccggggcatggcgaggtgcgctgcgttgtagaggcttagcaggccccttgcgtccgtgctcaggttttctctgaaacaacccgtgctatctttgaacttgtcgaatacatctgcatgaacaaatttctagctgtaagggtgtacacactagtactatatatgctccagggattatatttatccaaatgaatcagagatgggagagatgtgtgttcaaataacaagctttagatcgaaccttgtttgatctttgtcgtattttagaattcatttagtgtttttttcaccgtattttttttcaacctcagtttttggactgttatatactgaatttatttccattcttttgattttgtgtcccaatttatacgctcctagctatcaatgaaaatgtcttctaactgattcggcaattatattcattctatatcaatatgtacatatatataacaaaatattctcctacaaaactgcagagagattgaattatactccgagttacctgcagataccaagaaaccatgctggcgaagtagacgaaacctaagggattcaaggtggagcaagtcagcagcagcaacgctgtcggcgtgctccttatggtgcaataataatacatgctgtaacgctacggtgatctcgtcgcggaagtggtcgtctatgtggaggcgttcgagcacgtccactagcatcaccgtgtaggccatactcgtggccttcgacagcttgcagcgcacctgcctctttagctgatccacatgttccctcatccacttctctgacatctgaaaacatatgcacgagcaattaaatccaagagagccatagttaaaggggaattacatccatgcgtaaagtctcatattcaaattcatattatacagagacaaaaaaacaaaattatatactctcaaaactatcataatttttatcatgtttgttatggctaaaatataatgaatttgaggttaagactttacacatatgtgccatattattggaagtacttgtataattttattttagattttttcgggtgaaatttgttaattagagtatacggtgtgtatacgagaagagacttgtgtgtacatgatatgttccctagttaaagtatccatgtattgtcaaactactaattaagctatctagaatattgtatatgatcaattaacaacatgccattgaaatttcacgcaatctcttgctcctgaacttttataagatctctcacacatccatttcattagttgatcattagttaattgttagttttatattttttaaagaaatggccatatttcccttggcatattattactaaaagtttgacaatttaccgaatatgtagttttgggtttaaaaaagttagggcaaaattacataatatggaagtaatttcattgaaatttcaaaaacttgtgaaactctgcatcaaatcaaatttgaaatgtattttttaatgaacaatattcagtttgaaaattgtcaattttgtcatagccatgtactctctctgttttaattaattgacatgtcgttctaaaaaaatctaacaataaattagtagttggcaaattacattgctaccctcgttaattatttcctaatcatctttctatatatatatatatatacatatatatatatatatatatatatatatatatatatatatatatatatatatatatatatatatattgatgaaggatagtagggaatatagatctctagaaatgttttcaagtgtgatcagaacgacaaaaacgttttgacacgaattagaacgaagagagtattcgtcactgtcatttcatgcaatttttttcaaaaattatttaatatttgaaattttgtttttcttatcaagtgaaaaattttgaaattttcaaatgtattttaggcactatataaaaaaaatgaaaattgttcttttaattagaacactcaacattatgtaatacataaattagggtaatatggtcattttaggaaaaaaatgatcaactaaaggaaaggaggtgtagaaatcaacatagaagctctgcatataaaagggattcgacaaaactcaaacatataaacgaattagctaaatatttagatacaaaatgataattttctctataatgtactccctccgtcttatataagtcgttttgaatttagtcaaagtcaaactactttaaatttgactatgtttatagaaaaatatagtacaatatcaaattagtttcatcaaatcaatgatcgaatatattttcataataaatttgccttgggttaaaaatgttactttttttttacaaatttggtcaaacttgaagcagtttaactttaaccaaaattaaaacggcttataacctgaaatagagggagtatatttcttgtgtgtgcacatatatattatgttcagtaatactagtattaatttgcatgcctgtggggctgggaggggtgtaggtgacgaagaagtcgccccacacggagggagcacaagttcggccggtggcagctgcggcatcagctagctgcgtggtgccacctttaactgcaagcacctccgtatcgagaacactaatcaccttactcccagacatgagattagctacttttggtcggtgtgctctagtcagttacagaggtcgtgaaactcttgctgcttttggatggtttgaatcgattggtcctactatctctcctctcatctcatggtctctatttatagacaaatatccttcccggtgatgattattaatggaccatctaacctaatttttctgttacaacaaggtgaccttttttaagattttataacattcccttctttctcacatacttatctcattgtttccatgtactattctaactttgatctctaataaccttcaataacaaatgaaacttttttaaggatacaatatactttaatgttacaaaaactttctaaagtatttataaacgcttttgaatagtaaaaagacgagtgatcaatctgagaaccatgcaattaatggagtatccgagggtggtccggtggtcctcggaccagaaaaaaaatcgccaagccaaagcccatttatggtttaaaaaaagagataaaaacaactcctatgtgtgaataaaagtgttggtcaatcggttcagctccagatatatagtagtccctcactcgtctgtgttgtttcctctcccacacgtgtgcgccgtgcggctgctggctaaagatcctagtgagtggcaacggtggagttgcggacagcaagggtgttagggctcccgagtctgcacccgacaggtcaggtccgtcaggagattaactggttgtttaggaatctttttcacccttctcacctcaccatgaatgtaatgtgtattagagattaagtatgaaaaaagatggaaataatatcgcatctctttttccgaaacatgaagcaaataagatgaagattgcttctcaatcacctccttcctaggttgtggcagaagagcacactaaaatcaatcttcttcaaacatctgtagccgagtaagcttctttaagtcaaattttatgaatcatgatgaactttcaataattatatgggtaaattctagatgtaccgtatttaataattttatataagttggactacccatgcctaaaattctagatacgtcactagaaccatataagtattttataccaaccttttttaagaacagctcgtttagagttctttaaattcaaccttactgtagttgccggaaaaaaaggaatcgacctagcaaaggtcggtcaacggtggaaaaaaaggaattaatgtagttgccggaagaagctcgccaaagagaggtctttgttgtcatcatcgctgaagggagtctacttgtctacacatttccttttctccatcggaggaaactcgctggagggaggtgaagcaagcttgccacccgctatcatcatcgcccattgggagagaaaggtggataaactgtgtgtgtgtgagagagagagagagaggtggagagagataaagaaatgggttgggctgctgggctgtcgagagtattcgcaaggcactaacgctcacccaacatacccacccgtgggccattagttcctgttaacaaatggaaaaaaaatatccacttttgttcatagccgggtttagaggctcttgtaactattaaaacggtaataccaggtcaattctcacctcactagaagaaaactgtaaaactgggtcaattcacctcacttggtagcctacacgaaggtttcatcatcctagcacctacatggcacgttgacctagtcttcatccaatgtgaagcctacgtgatgcaaacattgcattaaaaatgtaaataaaaaataaaaaaataattaaaaactagtgaacccatagctctcataaaaaaacagtgggaccccataagacccgtacgtactacctctaacacatccattagtcacgatgatggctttcttaaaattaagggaggatgttgagcccatggcttatcaagttatttcttttaagtatgttgaaaattgttacaaggtaacaaataaagatgatggctttcttaaaataaggggaggatgatgagcccatggcttatcaagttatttcttttaagcttgtaacaattaactattctatgcagtttggttcattttttttgatttaaaggaaaacaagatgaaggtaggaggagccttggctacttctgctactatgccatgcatgttttttttttagaattacacagtacaacgcaaacactcacaacgcacgcacactcacccctataaactcatgcacgtaaaccctacccttatgagcatcttccaagactgggccggcaaatcttgtagattgacgaagtcaccacagacgcctcactgtcgacgggtacgtcgcctaccagtgaaagcataatgccgttaaatcccggaaaattcgtttcccatggggagtcgaacttaggatctaaggtgctactaaggctcttataaccactggctacatgctcttttgctatgccatgcatgttgataattcatggctctaatttatataagaataaagaagaggagaccaagacaaagaagaaaatagtagatcgaggatgtgttttgtatttaagttggttccaatcacataccaacgaatcagctatggtcctagagttattgagtacaaataatgtgattagctatgctgtcgcaattttttattggtaatcattgttcaagtcattaggcaattaaccaatcattgtttggtccaattatattttcgttcatcgttgtcatcatccgctatatttcagagttctaatctatacctaatttaaaaatgcgtaaaacttttgagatgatttttcgtccatcattgtcatcatctgctacacgattttttttttcaagtgaaacagactgaactctagtgttcgctagttttcgagttcgatacgaagcggatttgctcagatttttgggaaaatggaaggagaaggagatgaggatagaaacccctcaattaattttagatttatgtccaaggatgctgttggattttacaaaggaggcggcttcaagcggcatcgggcagctgagggagtttgaacggagacaggggataacactgtagcgatgggcccacgtgagatgagaggaggagcaggaggacgcctattagactttcggttgcttgttgggccggacgtatgcttgtgggctgaggtaggggggggggaagggaggaaaacaggccagctaggctgcgggctgagaaaggaaatgggctgaaaatagcccagagagaaaggaaggttttatttagatatttatttaaataaatactgaaatgatgtttgtactactaaaattagcaactaacctttgaaaattccaagaaaatttcagatagtgtaattaatcatggataatttaagaaaaaataaatccagccatgtaattttatgtatcacacttactttactttacttgtaaattaatttaattctacacctacctacttagaaatacctaagtattccgaaaattttgtttttaattaattacataatgtaaatatttctcatatttctcgtcttttcttcccgttgcaatacacatgtaatttttcttgtttgtgtaagaataaagaagagaaggagaccaagacagaagcaaagtgtacaggatgtgttttctattttagttggtcccatccatataccgacgaatcggccaggtccatttttattggtaatcatcgttgaagtgtatctctctctcttcctctcctccaagcgggagcgggagctggtgccgccgccgccgccgctaatgacgatgaggaggtggccgggagcggctccatcgatccccatcaccgcccggcgctgcaacacttttgcgctcagccccctccacttcacagcacatctcatatacctccttcttgctatagtgacactcgaataaaaaaaatccctaaatccttcttccctctcaatttttctccttacaggtatagaaaatagagctccaattagcaattgccattggtctgcgctccacgatgaccttatccttgcaccacatgcacttgatcattggtaccttgttccggcgactgcaagatgagaacgagcatggagaatccatggggatgccgagcatgcaagccacactacgccgcctcccgccgctacttgggccgcaccgtgccacggctatcctcgtcgcactgcgacaccttctgctataatctcgctgcctaggcgaccatagctgctacctcgcaactcccgtcactaaacttgcaatcgaaaccttagccgatttgaggatatttggggggattcgggtcggaatgcactggtcaggacaagttatgtaagaaggtatatgcagagggggcggagcgtaaaagggttgcctatgtggcgcgccatgttagcggttaaacgcagtcaaaggatgattggactataaggatggtacattaaaccaagttcatggatctaaacgtgtaattttcaagtttactgatctaagtaacatcaccacataagtttaggaatttaccatatatttcacttaataccaaatattggtgtctctatgaaacatgtccatcttttcacttatacatatgcttaccaagcaaattctactacaccgttttaaattagtagtcgctttgactttttttttcttgtaacgtttgaccattcgtcttatttgaaaaattagtgcaaatataaaaacggagaagtcatacttaaaatacttttgataataaagcaaatcacaaaaaaataagtaataattctatattttttgaataagacgaaagatcaaaattacaaacaacaactcaaagcgttctgggacggaggtaatataaaataaatcacgataaaaaaaaacaaaatcaatttaaaaataaataatgataaaaacccataaaattaacttcaaatttaaatttaaacctacaaagataaatataagacaaactgtatgataaggttaaaatgtctcaacgtcgtgcgattaatttcgcagctgtcgtgctaggcgtacgtgtgcaactccgtatgattaatactccctctgtttttaatatcttttaagatatgtttgaatatttatcttatttagaaaatttatataattataattaattttatggcctttctttattgtcaaatgttctttaagcatgtcttaaaagtttttatatttacacgaaaattttaaataacatgaatggttaaaacgtttatcaaaaaattaaatcaacagcgacgtgtattgaaaacggaggtaatagtacgtaagaagaaataagtataaccatatatagtactccctccgtcctaaaatatttgacgccgttgactttttaaaaaatatttgactgtacgtcttatttaaaaaatttaagtaattattaattcttttcctatcatttgatttattgttaaatatatttttatgtatacatatagttttacatattttataaaagtttttgaataagatgagcggttaaacatgtttaaaaaagtcaacggcgtcaaatatttacggaaggagggagtacttgctaatataaatgattagacaagaacttcagtactgaggttagctttagatattttctttacgaacaagaaaacgaatgaagtgactagtaataagtacttgtgtgggccttgcggctgcttagcgagcccggtcatagttcaagcatgcatgacattaacatagacgcatactccctccgtccaaagcaaacctgggttttcgtgtttaattttgactgtccattttatataaattttttttataattcgtatttttattgttgttggatgataaaatatgattaatattttatgcgcgacttatctttttaattttttttaatttttttaaataagacagatggtcaaatattgggcacggaaaccagggtttgtcttttttttttggactgagggagtatataggacgtgattactgctgtacgtgcttgttcagttcacgtctaagtcaaaatttgtacatacagctttcttcttttcatttcgcttttaacttcagactatgcttgcacggctgcttgtttttgttcttcctgctattaaatacttcatccgtcccaaaataattttatttttcatcaacttacttgtctcaaaataaaatcaatcctaaaacaaccattgtattaaagtttatagaagtgaaggacaaatacattatgatgtgttaattaaagtgaagaaaaagtacatcaggatttgtagttaaagtggatgacattttaatccttttgcttttgtgttgtattggtattgtttgtgatgagtgaaaatgaaattattttgagctaaaaagtagtactactatcagccaactttgactggcctttcgggtaaaagataaaaaaaaaagacaaatacggacaaaggtccatcagagtgagtcttggcgcaacatcctggtagcacaacacatgcatgcatcatttcattttcatggctgcgatgatacccaattgcagttaccgtacgacataacggaagaaaagatcgagaaaaactaaagaaccatcaatgtcgggagtacacgatagctatagctagcaaggccaacctgcaactttagcgtgctaactactccttaaagaggtacgtgccttctaatattcaaaacaaattaactttaaaactgtaaactgcatgattatataaactaggaaggttctacgcggctactttatttatttaatgttggttgaatttttattacaaatatttatgtggttgatttttcctcttgaaatattaattcattaactctattctaaacatgttttcacccataatttgtttggggctaatttgtatgttggttatttcatcaataatttgtttggggttaatttgtatgttggttatgaatttcctgtagttacttttgcaaaaaaaaatttctaaattaaattattgtgtcacaacaattgagttggttactacttcctccgtcccagaatataagcatttttagcatagtaacaagttaaacattttttactttggccattaataacaaaaaaaatcaatcatgtaaaatcgatgttattagatttatcattacaaactattataatatgcaactctttttatttaaaacatcttatttttatagatattgttggttaaagtagcatctcggatactatgtaaggaactaaaaaatacttatattttgagacggagggagtataaaactatcatttgtgcttatgtgtatatctttttttgaatatttagcatatcttaattctagagtttctgacttagtaacatttttttttgtctttatggactttaggagatattaattgaagataatttctgttgaaaaattttataaataggaaaatttcatctaattaaaaacaaacttctatttacttatattctctcctttttatatgctttcttattttctttgaaaaaaatgaatttaaacagaaataagaccaaagtttaagtgtagatatatcacttcaaaatgtttcatcttcatagactacagtacacgtttgttagggatcgattattattatagtattattttattgcatgaattctcatatataaatacaatatgatttgtgttccctaattaagcaaacttagtgtggaatactacatatcttgcctatttaatagaaatcatggaggaacaaacatgacgtgtactccctatgttcttttacttattatttagtacattaatatcagtttggtatgctttgtgttccctaattaaccaagcttagtatgaaatactcacgtaccatgcatatttaatagaaaccaaagagggaaaaacatgatgtgtacttgccctttgttcttttatttattatttaacacattaatatagcctccaaaatatagaacttatacatggtgttaaatagtaatggtactttaggttaaccccgtatgggccgagtagactggaccctactgttgatgtgaaaacacgtggcctgagagatctgcttaactccagtataggtccaaaacttgtctttgggtatgctagcgtgccagttgatttgattctacaatcaacaagaaacaaagacaaagaaaccgcggttaaatccataaacgatagccaatcggctagatgccgatgacatatcatttatctttgagccgatatcatatatgcatcgatcgacaatcgttgataagtaagaaagaactaaatctactcgatcggctgtagatattaacgatatatagtccgtatatcgatatatacttaaatcaagtgattgggatagatcggtcgccatgccgagacaatataaatcatttagatcgaaatatatattaataatgagactatatatatttatagcatagccgatcagatagatctagcatgtatcggctaatacttcgataccactctatattgagatattgaaacaagtagaatatatcaaacaagggcctaatatacttaagtgcaacaagatcttaacataaagggcagatttaacatgtcaatcgagcatataagataaatgtagttaaattagataagatcggctgaaaccccgatactaccctaatcagcaaccaagaagcaggctagagattgagattctaatcaggactcataagatcaaactcaactgatgcagctataagtatgaaaagaaaaacaatatctagacaatcaagtcgttgtaagtatcatagagtggtggatatcctatataatctaggtcaacatcgatgtttaacctaatcggttgccctctactggcagatgttagccgattgtgggttagacaacgatattgccggagattatataagatatatgataactcaacgaattacataaacaagattagagtatcataaagatggaagcactaatcccgagaacgcaagccaccgtaacaagttttacctcttgttgaagatcgaaaccgatgcagttcaacccaaaagcaagaactcgtcgaaacaaaacgaaagtaaaagggtggcgatgcgccgagattgtattgaacgtgtgttagtttgactacatggggctcggggtctatttatacccgacaattacagaatatgtccatatcggacacgattcttatctctaacaaactctaagataccataagtctttgaggcagacttttgcctaaacatttttctaagaaaattacataaaatatcctaattaatagatacaattgccttctcaggattctatccatgcgtggcaatcatcatgaaacacatcaaactaaaccgacaacatatgccgcttcatattgtcggattcggctcaatcggctaacctcgtccaactcgaactctgccgatcttagtcgtagccgattcggacttcagccgatccttactctgtttctgggacgattccatctcgaattccatctcggtttcttcttcaccttcgatacttagattaccaaatttggttgttaacacctacatggtaagcatacttatatgatgatataatccatattcctagttttttcatgatttttcataattctcgtataccatgcaaagtgtcaagctaagataggacatgttacttgttcacattataaatctaatttggttttctttaaaaaaaattctaatttagtcgtgcatatttgtgaatttataatgtgtatatagcgatatactatatattatcatctttttcataattttgacgtctgtttggattgcatgaaaaaaaataggacctaaaatagtaatatagtcgtgaatatttgtgagctaataaaaaacttttgaaaaaaaatgtactacttgtatagttttggaacccattaatttagtatagctatgattaagaagtcgtcactagattgaacccacatcatctctcttttctttgacatcgatgatgcttttgctatttagattatcacgtgatctttctagcctacgtgagtcttctaattaaggttcaactaaaataactccaaacaagttgtactaataaaacttatactcatatccctatataagtgatacgctatggccgggcctcctttgtttgagattatgatagcttataaaaaaaggggcgaggtcaaaacaaatagatttgtttttttatgaaaatcgatgcacaatggcgacacgaatttaacgtgaaaaacccttgcgataaaaaagccacgggcaccgatcgggaaattatcaatataggggagttggatacaaacgcatggaatatattgggctatcacaccctccctgtacggcttacaagggatatatataggagaaagtaggagtcccaatagagtaataggaaactaatcctataataaaaagttctattagaaaactaatccgaatatattgtgggcccaaaattcggataacatatttaacaatctccaccttgatacgaatttcccttatatcataaaaatcttcaatctccaaacaacctcgtgatgataaaatcaatgtgcgccaaatagtcacttggactataattcataacacccttgatccagatgaggtagaccatgcttcaaactcgccattggaaatatataactcctgaatctgttggtataagcctgtgtgcaccaaacatatacgcgaaaactgatgcacaaccaaactcgtcatgggcataaaatcctgaatctgctgcatgaatttatgtaatcctagcagaaatgcgaaactcttgcgctcaaaatgaaatacttagatctccttattaaccttctggtacactgggcaaacggaagtagcaattccgccggaaattttaccacacacacgtgatctggacatgaaccttctggttccctctcgacgacttcgcttgtatgtcctgaaactgatagactggtgtacgatggtattagtttctcctcctcgcggtaaataccccactttaaaacatcacttgccataattagaatattgcatctcaattcacgagcgatagatcaaacctcaaactcgccttgggaataaaatcctgaatccgttggtataatttgtggaaccttagcagaaacgcgaaacactctgggtgtataaaacgaattatttaatctccatagaaaacctcctggtaaactggcgtgtgagcgtagcaaaaactgaacttgaatttattcccctgaacagaaccgaagtaatgcagatgaattgatccctgtatgaaggacgtatgcacgcagcgaaaaaccaacgtgaattttaattcacgtgaacagggagtcaggtccctcacttgccccctactttttctcgatatgcgtgcactaagatgatcatcgatggcttcaaccctgatgatgccctgcttttttttcacatcgagacccgtgtgcagcttttcctctccctgacgcatgcgctagctgctgcagagatgagaacgacgtgatgcaacttcgcgcgacgaacgcgatggcagccggacagcaaatgatctcaccgaacaggtcgaaattgaattgtcgaggacgatgaacagatcggccgacggctgcgtgaacagatcgcatctccaatgtttttgatatgacttgttatatagtaaaattgatgtacaatatagacacgtatttaacatgaaaaatccttacggaaaaaaattacggacgctgaccggcaatgatcaatataaagaagttggatagaaatgcaggagacactttgggttgtcgcaccctcctgtatgcggtgtacagggatatatataggagaaaactacagtagaagtcctgatagaaaaaactcgaagtcctaataagaaactaatcctataatacaaagtcgtattagaaaactaatctgaatcaattttgctatatatttatcaacaaattttctcccaaaaatttgacagatgtaattacagtacaatagtagtgtaattacactgtaacttatatataaatttcaaaaatctacctgtaacatgttatttcggtaaaatgaaggtcatgggaacaaatcctctcacatatatatgtgtgtgctgtgattttttatcttcctcaccagaacaaatcttgtaatagatctaacgattcaaaattatgtgaaacttacatacaagttacacagtatttacatgtaggttacaatgtaattaaactacgattgtactataattacatctgtcaaatttttagaagaaaatttgttgacaaatgtataggtgatctcaatccgaatatatcgtgggcctaaaattcggatcacatatttaacaattttttatttgccttttattttttaaatcataaactactcttgtgctatcaagttaaagactaggtttaagtaattttttaaagcttttgtggattagagttgagactttatgtttaaacttgaggacacccgcttatctctactattataaaaataaaatatgtttttactagtattttagtacgtcattcttgtttgcggttttaagtttgttcgcttttggaaatacatatccgtgtttgaatcagattttaaattcatttgcttttggaaatacgaaaggagttgtataagaaatcttttttaaaaaaacttgcataactaatttgagttgaaaatcggactcataattgcagctcatgattattaaaaaaaatatccaagcgaattcccataatgaatttcacaatagctaaaccgtatagcaataataagattgaaatagcattaattcacccgttgcaatgcacgggtatcttttctattaaaccataaaaatcaaaaaatcaacttaaaactctatgccaatataatgatctaaacccaaacaaaaatagccaactaattaatttttttaatgaaaagaaaaggagcgtctttatagtccagcacatagtaccgctcggtaccggtacgcatcgagccgttcattccggcatgggtaggatcgggagagaaaaatgtgctcggtatcgttccacagccgcgcgtgcgtggtgcgcccccaatccttcatcccccgacgcgtgcgccctgtccggcatggactccgcctccgccgtttagatcgaagtctcggcgctagaggaagaacatggcaacggcggcagaggaaaacggtagcggcgtaagtgggacatggcggcggtggcagaggaaaacggcgacggcggcagcagcggaagaggaacacgacggcagcggcagaggaagaggaacacggcagcggcggcggcggcggtagaggaaaacgaacacagcggcggcgaaaagcaaccagcgctggtgcaaccaaaattctagggttcgagctagctaaccatcaactcttcccgatccatccctccagaaccatccatcgcacgcaaagttactcttttacccttctaactctcttctctctgcggtgctgtctcagggacaattttgatacctcgtggtaccacgcaataccagctgttggatctgaccagatccaacggctagcatttggtaccgcacggtacagctggaccgtaaaaaaactcaaagaaaaattaaatccgccacatgcatgcatgtatgaggttcgatcgtatgctaggtgacccgtaggccatagctacacgggtcctagaggggtgctcgtctataaatagagaagatgggagaggtactgaccatatccaattagtagcaagctactctaattgacaacttctgtaaactagcggtcgcgaacgagctcgatcaaccaacgataacatgtctgggagcagtgttctcgcgacggaggtgcttgctgttaatggaggctcctcgccgttggctgccgctgccgtcgtcaccacaggcccattgttgcaaggttttgcgccgtccgtgtggggcgacttcttcatcacctacgccccttccaactcacaggcatgcagattaaacagtactgtgcatatatatatatacttaggtcttatttaaggagcttctagcatctgcagtttgtatcataatcttcaactctcttaaatattctcgtcctactttatagaatccagaaaataaggtacaaaccaaaaccagggtttacctggaaaaccatttttacggttcctcgtaagctaactattacacagatcgaccagctgcttatcagaaatgggcagccttagacacaaatagtgaaatagaaccatacacacacatgcataccgtatttatttacgtgtgtgtgctttgcttaattgtacagggcaggggcttaaattaattatctgtgtactctcgatcatgtgcgtgtggtgcagaggtcagaggagtgcaggagagaacgagcggaagctctaaaggggcaagtgcgccgcaagctgttgaaggccacgagccgcatcagcagcgtggccgagacggtggtgctagtcgacacgctggaacgcctcggcatagacaaccacttccgccacgagatcgcggcgatgctacaccgtgtgcacagcgaggagcacggcggcggcggcggtgctgccggctccgatgtcgccgacgacgaccttcacgttacttccctccgattccggctgcttcgccagcacggcttggggatatctgcaggtacagttaggctgtgttctttcccctgttttcccaacccatcactcccgttttacgcgtgcacgttttttaaactgctaaacggcgtgatttatgcaaaaactttctatatgaaagttgcttaaaaaattatattaatccatttttttaaaaaaataattaatacttaattaatcatgcaataaaataaactttgttttgcgtgtcagggacaacccctcctccgaacacagccttagggtggtaatggacccaacattttgacctacaaaatgtgaggtcaaaatgagtctaaaatgagttgggctaaaatttagtagttttttatgctaaaaatatttaagagttgagatgggttgtgaaaaaacccacgagtcttgaccccacccctaggtaatcatatctgcgtatcttcataattgaaaactgattaattaaacatttcaaggcaactcccacgtaaaaacattgattaggtggataatgtaggtgggaatttaaatttagtttttttcccaaaattgattggtagtttttgttaatatatttcgaaaaaattgaaatacatttttttaaatacgtttactaattatattttggaaaactaaagctggctcttagtttttatatatttgtaaatatataaaaaaataacatgatccccaccaaaatactttgaataataacatgatccccaccaaaatactttgaataacatgatccccacttcaaaatttatttaacactctattaatatttaatgctaaaatttaaaatttagtaattagctagttatgagactaaattttgtaagagttggaattttattaatttaattctaaattttaagattaatactagtagttagacagagagttactttttttttgcaattcaaaaaactacccgtgtattcaacatattattgaacttatactacctaaaattatatcgataataatacagctaccgcaaagcacaggttaacgactagctggtatatatctaatttgaactctgaatatataaatatacacacacatacattttactggtctgctcacaacaaaatatgtacattttactgatagaaaatattaattcatgcattgcaaaagatgtgttcgacaagttcagagacaacgggggcagtttcagagcaagcctaagcagtgacacgaggggtcttctaagtctgtacaacgcggctcacctggccatgcccggcgaggaggtgctcgacgacgccatcgcgttctcgaggcgccacctacggtccatgaaaaccgcaggcaagctgaggtcgccgatggccgagcaggtctcccgcgccctcgacatccctctcccgcggacgcccaggcggctggaggcgatgcgctacatccacgagtacggcgatgagccgggttttgacggcgtggtgctggagctcgcgaggctggactttgagctcgtgaagtctcttcacctaagggagctcaaggccctcaccctgtaagttttcacgttttcgcttcctgtgatctcagctgcttacttaaatatccctgctaaagaagtacaactatttttttcttcatatagctagcaagctgttgtttgtgttttccgttaattgactgacagcctactctcaaatatatatgtacccctctctgttgtgaactccattttgtctaaattaatatttgactgcacctttgccccgtctagctagctaaaaacaattaaattttcagcttttctgtttatcagccatggttttcttttcttatttatctgtcacctggagtagcttgcaaattgcttatcctaaacttgcagaattcacaagttacaacttgaagtatgtcgcattagaccaacttaagctagtttcgtttcgttcgtatatttttttttggattactctagatatgtttttatgctttattttgccttctcttgtattggcatgtgtcaacatcaatgtataacttccaattccatgatagagcatagcttgctttgccactattgaaaaaatagctagcgatactgttgttagatgttgttctaatgaatgagaaaaaaaatcaaccattttggcaaataagtgtcccaaacttttccagtataaacaaatggattcaagcatggtcaattgattggtacatacaggtggtggaaagacttttacgacaatgtaaagctgagctacacccgagaccgtatagcagaggtcttcttctgggttagcggagtgtactacgaggagaaatactctcgcgcacgtattatgcttgctaaggttttcggattgataaccctaatggatgacacttatgatgtccaagacaccttggacgagtgttgtaggttcaatgaaacaatacagaggtagaaattagtaatgacctatttgtttattttgtcaaaatgaactatctgagctgagctaactactcaatccttataaatatgcagatgggacaacggagcagtttctattctaccagaatatatgcatgcatattacataaagttgctaagcaactttgacgagatggagaatagcttagaaccaaatgagaaacaccgtgtgtcttacgccataactatggtaaaatctttttacatatactgacgtatttttagcttgcctgtaaaaggaaaggggtgtccatgaaaatattttttatagtgatccagagtcaagatacttaaatatagaactagtcaattattaagagaagaagatacaccctagataatatagagagtatcgatcgatctattatgagaggagcaccgaatcatatataacttctaattataaatttagaatgaaactggttagatacttaaatagagagtcaagatatatagatataccttagtgtatactgactttataaatttattatttgtcaagaaaagtaaaaataacactgctaattatgttgacaaaatttctgaattttaacattttttggctgtcaagcaataatcacaataatcaacaaaactattagggccagagtggtattcaatcggttggagaaaatatttttaggccatgaatatgacttgataattattaatttcatttcaaaaatttaaaattattagactataaaagcctatagttgcgactccatattcattctaactttgtatttgacaattccgaattttagaattaacttgtcaataacaaggaaaaattatgtacgtctccatgataagtagagctttgtgttcgttgttgtaaacctcaaaagtatcgaaaaatatactcccttgttgtttgttagtttagttaatgttttggatattaatgttggcgtagtcacacatgtttcatcacaatttttatccaactacggagtatatattataaaattaataaaactatagctgcatgaaagaaattttcaaataattttgacatattaatgtcattttatatatgttaagttgtaatgttttgtatgtactaaggatttaacatattgacatttgaatgcatcgtgttatatacagaacgttatattatgagacatgagccaaaaatagttgtcttatatttagaaatagagagagagtatctatttgacgaaaacatatatagttcgtagtctaaaatttgaaatataaaagtatatatacactttaccctgacgtacgttcacgtcaggtgtaattttccccaaggacacacgatcagtcaattttatttttcctcaacaagctagttactatgacgcgacattattttccttgataaataaaatatactgcagtaaaaaaaatattctattcacaataaacagagttcaaataacttatattatcttcatatgcctgcatacatgtacagtacaagcagttgtctgaatactacctccaggaggcccgatggtcgagccacaggtacctgccgagcttcgcggagcacctgtacgtgtccagcatctcgtcgggcatcccggcgctggcaccggcggtgctgatgggcgtgcacgacggtgacggcgtggcgaccaaggaggcgttggagtgggcgtgcgccatcccggacctgctcctcgccagcggcgaggtgggccgcctcctcaacgacatcgccgcctggaaggtggggaagaacaggaaggacgtgcgagcctcgtggagacctacatgacggagcacggcgcgggcggggacgcggccgtggcggcggtggcggctgcgtcggagcgcgcgtggaggcggatcaaccgcgcgtgcgtggaggcggtagaacccgcgctgctgccggccgcgcagctgctggtgaacctgacgagcaccatggaggtggtgtacctcggcggcaaggacggctacacctccggctccgggctcaagggggtcatcaccgatctcttactcggcccagtccatgacgattaggcacaacgtaatatataccctctccatttaaaaaaaaaccaatatagtacactaaaggtgataattcataataaaacaaatctaaacagaaggttatttagatttgttgtgttagaaaatatcacatctaataaattttttttttgggatagagggagtagttatttacgtgatcgacaacttgctacacgtatgtactacctagctacttcttgtgtctttaaaaaatatccaattctctttgagagagagagagagactagctcttacatagtacaaatggatgtgtacttacatactatgcgataaaacctagttaaatcgctagcatatgcttatgatagggatagtatacttgtcttccataagaaattgtcatacatggttgtgcattatgcatgccgtatatgtgtgttggcagaatccagcaagttagctctcagtctacctgtgtgtgtagtatgtgcgtgttttttttttcaaaactcggtgaactttatttgataggaaggttattacatgagtgatggaaacatctcccaaggggagattagacaggtagcctaacgtgggacaactgctagctagtatgccactatatatgaagatggattctaatctctcaggtggacgtccacccgtttcttacatgtcaactaaatgattaagaaaaaattacaagatagattaatatataatatatcacttcataaacatgtaagtttaaattcgacttctacaagttgtaataaaaatatcaaattaaactctaactagtatacgtatatgaagatggattttaatctatcgggacacaaattttggtatatctagataatagtattttgagatacctcaacagaaaacctagacaacagtatctcattggaacgggataccttttatgagatagtacctgatacctgttgtggtaccagctgtatggtacccgatacctgtgatacctgttactcggtacctgtgatacttaggacctgatacatgtcatactcatgcaagagaatagttaatatgccttatcccgttgcaacgggatcccgttctgtagcatccctcatacctcaaatactttctcaaagtacggtaaatttctcgtttctaacataagcatacataaaacaactgattacatgtacgtacatatatagtatataacatatatatgctggacaggaacgcgtacgtctatgattgctgtgcctgattaaacgcgaagggggtcgaggaagagggcggtgacgagacccttgaggtcggcgccgacggtgtagccgtccctgccgccgaagtagatgacctccggtgtcgtcgcaaggttcaccaacagccgcgccgccggcagcaggttgggatccatctcgacgcacgccctgttgatcgtcctccacgcgctctccaccagcgcggccaccgccgccacggcctcctccccgcccacgccgcgctccgccatgtagcactcgatcgtgctcgccgcgtccttgccgctcttcccggtcttgtaggaggcgatgtcgttgaggaagcgggtgacctcgccgccggcgcggaccaagctgggcgcccactcggatgcctccatggacgccgccgcaccgtcgccgtcgcgtgcgcacaatagcaccaccacagccattgttgggtagccaattgacatgaaagacacgtccagatgctcggcgaagctgggcatgtgcttgtcgctcgaccattgggcctcacggaggtagtattctgactgctgcttgaactgtacatacatatattcgtgtgtaggaaaatcaatcaaaatgtgtgggtgaacgcatgaatatatcacttttactcttttagtatgtctatgttttttgccgagaaagattttaccgaagatttcacgtaagacatgcggtgcttctcatctggctccaagctgtcctccatctcatcaaagtcattgagaatccttatgtaaaagttgcgcaggtattctggtagaatagaaaccgcactcttgtcccatctacatgtgtagaaggatatattaattagactaatcagacgaggtagctacgctcgttggcaaattgataacttattactacttcagtttgacgttttaagatgttttggattttaaatatatttatacatagatctatgtacgtgcttaatatatgtgtttaaatttatatagatattaataaacctacataagagatgaatagaacaaaacgtcttataatataaagagatggaatagttaatttctacctctgtacagcttcgttaaacttataacactcctccaaggtggcgtggatatcatagatgtcatccgtcatggtcataagttgaaacaccttagcaaatatgattcgcgcacgagagtagtcctccccgtggaacatggcacaggtccaaaagtaagactctactaggcaatctcgagcgtagcttagctgcacgctgtcataaagttgtctccaccacctgccaatcatattcgcatgcatatgtagattagaaatagatcactcatgtagctagttatattaaccgtgaagttgagttgagtaattttacgatgtcctttttttaaaaatcactagcagtaatatttctactatatatcataatcttaactgtaggtgaagcagagagagcagtaaagggcagtgaggcaagaaataattttaggttctggggaataaaaagtaataggataacttaattgattacaaggagagggccttgagctccttgaggtaaagagatctgacgagctcgaagtccagcctcgcgagctctagcaccatgccgtcgtgcgccgcctcctgctcatactcggtgatgtagtgcatcgtctccagcagcttgggcgcccgcgggagagggatgtcgagggcgcgggagacctgcttggccatgggtgacctcagtgcaccttgcagggactggaggctccgtctcgagaacgcgatggcgtcatcgagtgccgcttcaccgggcatggcgaggtgcgctgcattgtataggcttagcaggccccttgcatccgtgcttaggctctctctaaaacaacccgtgctatctttgaacttgtcgaatacatctgcatgcacaaatttctagctgtaagggtgtacatactactatatatgctccagggatttatccaattaaatgaaaggtaatgttatcaccattgaaaatgtattgggaccttcaagtagtaagtataccacaaattttaatgtgtaatttaattacctcaaggtattttttcaaaaaccataaaatttctctcaaatgaatcagagaggtggagagatgtatgtgctcaaataacatttattggttttttttcagcgtattctatttttcaacagctttttgggctgctagcaacccgactaccatgaaaatgccttctaactaattcggcaattatattcattttagatcaacatctacataacaaaatatccttctagaaaacaaagatcagaatataatttaggctacctgcagatacccagaaaccgtgctggcgaagtagacgaaatctaagggattcgaggtagagctggtcaccatcgtcaaagccagcggcagctttctgctgttcatcgtggtgaaatacatgctgtaacgctgtggcaatctcgtcacggaagtggttgtctatatggaggcgttcgagcacgtccactagcatcaccgtgtagggcacatttatggtcttcaaaattttgcagcccacctgcatctttagccgatccacccgttctctcatccactcctccgacctctaaattaaacccatgagagctatagttaaagtatcaatgtattgtcaaactactaattaagctagcaagtactatgttatatatagtcaattggttacatgtctgtgagatttcacgcatccctcctacatctctaagatttgtttgatcccttatgtgccgttgagttattctaatcccttactcgtccactccattagttacatgttagtgtgtgttttttacgaaacgaccttatttccattggcatattactaaaaaatcagtaatgttctatgtaggaattatttgcattgtgaaaaaaagtaagggataaattaccgaatatgtagtttccaaattcaaaaatttgtaaagtaatttcattcagatttcaaaaaaaaatgagtaaaatacacggccggtccttaaagttgagcgcgggtgtcacttaggtccataatcttgtaaattgcacatttaggtccaccatcttgtttaagtgactcattcaggtccaaaggacctctgaccggattgactgacttacgtggcggtccagcgtggcaacatatttacattttgtcccccatttttcttcctgtcttcctaaatctctctctctctctctctgatgcaggttggcaagtgcgcacggcgaggcgtcggtggcgaccggcgaattgctacgcggaggggcgggcggcgcatggggacggccccgctgccctcccacgcggcgtcgccgactctgcccttccgctccgagcctccgagactccatcgctgccatcgcgcccgagctcgtcattgtcgtcttcaacctgggtgtgcagaggatggcgttggcagcacgagagaggaggcgtcggtgggggacgggagaggaggcatcgttggcgagcggcgagagaggaggcgtcggtggcaggcggcgagagaggaggcgtcggtggcagggagatccggtggccgccgtcggcgccggcgacgtgcgccgggtgctgcgcctctccgccatgcctgcctcgccgacgcttccgcctctccgccatggccaccgccgtgcgcgccgactgccggcccgcccccgcacttgcccaccgccgcccgcggccgtggtgcacgaagaggaagggggtggccggtggtgagcgtgtgtggagaaggagggggtggccagtggcgaacgcgtgcggagagggaggaggcggagaggcgttttgctcggcctagtcgtttcccgtgcaccaccgctgctgccactcgcacgtgtgtcatgctagtatgccgcttgctactggcgctcgcgacgccgtcggtagcggcggcggcgcggcatgactatggcgaaggatttggggatatttgtgctgtccatggcgctactgttgcggaggggtttgtttgcaaaattgatgcttgcgtggcgtgccacgtcgacggtcagagttggtcaagtggggtttggacctcaacgagtcacttaaacaagatggtggatctagatttgcaatttacaagattattgacctaagtgacacccgcgctcaactttaaggaccggccatgtattttactcaaaatgagtttatgaaactttgcatcgaatttgaaatgtaattttgtgaatgaatatgcagtttgaaaattgtcgattttctcataaccatgtactgtctcggtttcaatttacctatcattccagcaaatctcatactaaactaggaggtgtgctaaattacattgctatccattaattagtacatcttgatcatcttttccaaagcaaggagaaaatatttttatggacagtcccagctccaccttccatctcagcaagtttctatggaattaaaaatgctatcatgtaagaaaaaaataacttgacaagagagttaatgaagataaaaaaaaaatgaaaaacacgttgctcaaggaagaaaccagctctacgtagaaattaagaacgaagacaagaggatatggagatgatcgaaaggagatagaaaagacgtgactggatgagaatttattttccacccactcggtatatagtttttatatttagtgtctatatattatgattatgattatgattatgattatgattatagtgtggatgggaactatctaatagttttgattaggatttccggcaatgagaagtactagtattagtacgaacgtattgatgaagggtaagaaggatacgcatctctaagaatgctttggaatatgagaacaagaagtatatattttgacgtaaatttaagctggtattcacctaattctgtcattattatcacttcatgattttttttaaaacttgtttaatatttaatttcttgtttttcttataaagtgcacaatttgaaaatttttaattgtattttagccattcatatcttttttcaaaaactgaaaattgttttttacttagagcggttttcgtcctgtaatacataaattagggcaatatgattattttaggaaaaaaataatgatcaactgaaaaaatgaacgtgtagggattgatatatagaaactctatggtatcttatatgtctataaaattcatttctactaagtgtagtataagtgtatagtataagtgtagtgtatgttatttttataagcaattttacagtcattgaggaggtactatgagataccaaattttatactaattttttgtacctcatagtaactaagtaccgatcaactgaaaaaatgaacgtgtagggattgatatatagaaactctatggtatcttatatgtctataaaattcatttctactaagtgtagtataagtgtagtgtatgttatttttatgaacaattttacggtcattgagtaagtaacaagagttaccaaatttataatagaaaaagtggtacctcatggtaccttctcaaggactataaaatttttatcctctcattaagtcacattatctcaattatttctagcccttggataattgatcaatggtctaaacctccttttcttttcttataaagtcatatcactttagttttgtctttggataattaatccatattatctctcttctttttcttctcttactgagccgcatcacatttgttttgcgtttaaatgatcaatctatatatgatttaaattagtacaaatcacatcatcttaattgtttatatatagcttcgataaaagatgaaaattatataaagtatataaagttatgttatctagctatatatcttcatctcaactgtttatagtctttcattcaaatagtcgatcaaagatgaaaattatataaagttatatcattaaaatatcttgcatgttattatacaaaacttccgtatcaaccgcgcggggtttcatctagtatattataaaagggatgagccaaaactcaaaagacatcgaaggggtaactaaatatttttttggtgcattcagagaatatctgatctctatatcatatacatatatgtgtgtaacaatatactagtatattgtttaataataataattaattaatttgcatgcctgtggtttgggaggaatgtaagtgacgaagaagtcgccccacacggacggcgaacaagctcggccggtggtggcagcggcagccggctgcgtcatggtgccacctttaacagcgagcaccttcgtatcgagaacactaatcaccttgctcccagacatgtcccggtctaagctacctagtaattaagttacagaggaggctgtgaccttgctacttgggtagtggatggtctatctctcatggtctctatttataaacaaccaccctccccggatgacgattattgggtcacctcacctaacctaatttttctattaaaagaaggtgacctttctgtttgattaattttgtagtactatctccccatttaatacttacctcattgttttgatgcgctattctagcttatctttgacccctaataactttaaaatgcaatggctagactataacgaacggaaccttgtttaggatgcaatattctttaatattattataacatctttttaaagcatttatatagcgtttttgaaaagaaaaaaaaagagacgagtggtcaatttgagaaccaagggagttttacagaaactttaattttttgttgtagtggtcgtacaggaagcaactgacaaagtatcgtaaatacacatattataaccattgcaaatttaaacttatcacatatttatatatacacatttatttatttaattttcttataactatttaattaggtgacatgaaatgaaaggacatttcattggagaagaaaaattaaggagccatcttcaaacactacgtctgtatcgatcgggccacgcggcacacacccatgacccatcagaaccgtcagggatgtatgtgtcactctgtccatgctaaaattagatgtttggttgaaattagaacgatgtgatggaaaaattaaaagtttatgtgagtagaaaattttgatataatgaaaaaagttaaaagttttaaaaaaaatttaggatctaaacacaaacacggtgtcacttgatttctcgtaatatctcctcactcagcgctagcgtcgaggcctatgtatcatacatcagcctatttacgagccttcgttattacatgcatccgccgttccaccgtcagctactgactacccggcggcggcggccgccggcggctagtgaaaaatatttttgattgttttttttttgctactgtagcgtttaatcacgtgcattcaaaacttagatccaacggatataaaatgcccaacggcatggtactgtagctcaactggaacggcggaggatgcgaagcccagaagatcttccaaatatgtcttaagactgtccgagagggaaggaaaagagaagattgaaagtaaggtaagctattaatacgtgattaattaagtattaattattttaaacttaaaaataaattaatatgattttttaaaacaactttctaatatattgtttttttagattgtttttttcaaaaaaaaacataccgtttaatgatttgagaagcttgcacatgaaaaaggaaatattttctcactatccgttccttccttagaatgcagcctaagttaggaattattaaataccctgagttttgaattaatgggtttaagtaaatattagaacaaacacgtaaaagtttaatttttaaaccgttgtttgaatatgcgatcaataactgtggatacgtagagctcgccgagtagtgcaaaatagactataatttataatttatagtaattgtagtccgaatgaattcctgcggattgaatcgacgtggactgattgatctcctttctaatctcttatatatacctacagacaaaaaaaaatggaaaaaaaaaagaaagatcgagagcctctcaagccctagccgccatcaccccaatcgttgctgcgccaccatcacgctgctgccctcgttgctgcctctgttgccggtcgccatcgctggtactccttcctgtcagcctgctcctacgtaccctggtggtggctgattggagcagcaggtttgattttgttttctcgattggacttttgctgttgtgtgttggactccaattcctgctgctgctaaggctgctgttgcccctgtgctggtgttccttgctgctgctggtctgccgaacatagaggagggttagaaggcagagaagaaggaagcagggagagaaggagaaattagatagaagaagggaaatttggggaatttggttgatattttcaaattcattgttttttttacaaattagtactgctaggtacttcgttttagcccctagttgtttctaatttatatataagaggatctgttttcggtagctcgaatttaatttatcggccgctaggctgaaaccatattttcaaatatggtattaaaccatcgggattcagattgattgtcctaaataaagtttgtattcatcgtcgatatctttccaacggcgctggtttcactcaattccgataaacggtttgggagaaacagcaaaaacaatactgctgaccaggtctagaaatcaagacagcaattcgttttacttaagctaggatttacagaggcataatctgatttttggcccaacatgaaagttgtagattattttctgtaaatgcttgaagtgctattatttactagattccgttagatggtttgcgagttacgtataaaacagtaatggaactgctataggttatttaatacaaatcggtaaaagtttatatgttattggtttcgattttagtaaatatcctttgtaactattattagttgaatatagtggtttatttatagttttgctccatgggtgtggagagatctggtgtggagggtggttcatcgcattaccgtcaaggttaaaggcaagtgcatgacgaactaagtgtataattcatggattgtttgttctatctatttatttccgatatatttctatgtgataagtgactgtttatgttcagattgttgttcacactatttagatttcgagttcatcttatatttacgatgttattcttgtttcaatatttcggattctggttctggttaaataattcaagttccatgcttgatatggatgtgcaatatgtttttaatttggttctttgttttcgacttcaattattcatgttccatgcgagcatggatgtgctatctggttttctattcatgttcctgtggataagcgttgatcacgcttactcggctttgccgacaaatgctagaatatgttcactattgtctgggatgaaaactattatttcaattcatacctgcccgagatgggaactactatcttttttgacttggtgtttgaaaatgtctttcttatcaaaaaaaaagaaagctttctgtttatgctttattatcaatgatgtgtatatgtgttttctagttccatattatacttgctgaatattttcgtactcactcttgtatttattcggttttaggtacacattaaggtcgggtatgcatgagcgggaagtagcacccttgtatacatacctatgtgcacactatcaaactataatgtttaggtccataataatacttagaccatatcttggtttggttttctaataatccagatacctattagtttctttccatgggttatatggatgaatcacattgtggaaatgatattattattagttcaatttataattgtttgtcgtggatatctatatttataaaggagaatctgccgaaatttctaataattttgggagttagtgattttaagtgtattttggtgtgacactctatgtacttgattttaagtgtattttgatgtgacactctaggtacgtggttatttggggtgttacaaattaagaaggatttaaaagtaagcagtatcgtctaacactgcaggagataattggatcggagggctgaacaatttcgtcttgtataagcagagttcagcatcatggaatgccaaaataattcgtgggagatagaaaaaagacaaaatttactacatgaaacccaaagtttacgttttttttttcggagaacacaagaacgcatttctgctagttgaatcagaaaacaataataattagttggtggacacctattgtattattttattatatctgaaaaaaaaacagataaacattagttaaataaaaatttacccataggctcgagctcacttgcgaatcccacatgtcctccctatctctcttcgtcttcttcctcatggtgctgcctttctcgtgcgtgctagacccgttaaacgatcgtcttcgtcctagcttgtcctccgctggcgtacgtgtgcaactctgtatgattaatactatcttcgttataaaatataataggagtaacttttagctataaatctgaatagacagttgttcagatttataaccaaaaatgcttatattttggaattgagggagtagtatgtaataagaaattattagataagaacttcagtactgaggttagctttagatatatattttttacgaacaagaaaacgacttcagtgactaataagtagaattaggtaagcctaattgttccagcggacgtgacgtccaggcgaaaaaaggacgacctactttgtgtgggccttgtggccttgtctactttccttcaaattttcaatttttccatcacatcacatgtttagacatatgcatggagtattaaatgtgaacgaaaaaaaccaattgcacagtttgcatgtaaattgcgagacgaatcttttaagcctaattacaccatgatttgacaatgtggtgctacagtaaatatttgctaatgacggattaattaggcttaatagatttgtctcgcactttacaggcagaatctgtaatttgttttattattagtctacatttaatacttgaaatgtgtgtatatatacgttaaaatgtttttatcaaaacaactaaacatggccataatccaaacatgcatgacattaacatagacaccggtcctaggacgagattgctgctgtacgtagtcgatcaggtgacgtgcaagtcaaaatttgtattgtactcagtataagaagtttccagagttgaacataatttatctatctatctattatatactaaaagtctattaaactcttttaaaatactcttaaaccgccatgtgacatctcaaaacgttctcaagctaccacatatcattttaataaaataaaaaaaatcctaaaaaatttgattaaaaagaaaaatatctagccctctgttttcatttaaattgttggtccattatctcagaccattagattagatatactgatctctttgtgaaaaaaaaatctggattggaaggggtaatagatgaagttctagctttgtgggcaagactgtcagcatgcttatttgcttgtgttggtaatcatctgatggtgggccgcttcgttgtgccggccggcgtctgtccccttgcgccgtcgagtaggccgaatttcttctctcggcctatgaaccaaagaccatcttccctcctcccattctagccggccgtggaataagtccacgtgtgcccttggccccacttgtcagtgacacgcaaagaatatacttttcaagaaaatcaataaatcatttctcattgtttcaaaaaaaatcaattaatcttagaaaatccatctcttgttttgtagcttcaattgactttgttccacttccagtagttagtctaaatatgatcattttcatgcgttggtttttgtttgtttgtcatgctttgtcgaaaattagttaagctcaagatcccgaggaacgcaagtcgcctttgaaatctattgggggtcgtttggcaaacgtggacacttacgggccgtttggaatctattaggggatctcgagtagcggcgggagaggaggccggcggacaaggggtatctttggggaggtttctaggggctcagggagggtgggggcgagagagatcgacgggagaacggccgatggcggcaccgtgaggcgcgcaatggcggcggaagggagtacgtggaacggagagaggacggcatccttggcactgctttggggagggaaggggaggtctcgagggaggcggtggtgaggggattcgccgagaacgaggccaacggtcacgcacgaccgggcgcggcgttcggcgaaaaccggagcagcggcgagggaacgtgctcaggagctatccttgagcctccagagggcatagacctagggatatgggaatggggtgctcactggcgacaaggagcggcttcggagcgggtggcccggtggaagaaggncggccaggtttcagggatgaagattccgggtccggcatcgcgtcaaaaagcgcggcgcgcgcgatgcgtggacagcagagcccggtggcatctacgcgaatcagcggctatagagcagtcgctacggcagggcaggctggcgcggtgacgccgggctcccttccgatcagccatgacgggagcgcgcccgggaacggcaagcggcacggccaaaatagaatggcgatgacggcgcggccaaaatcgaatgacgacgaaggcgccttcctccccgtacatgcgtggcgcgtgggaggcggggttggacaggatcgagggagtggaggcggcccaggcggtagggggttgggttgggttcagagaaaaggaagggaggtgatgtaaaatgattttaatctttttttaggaattcttttaggaattttgaggagcatttgatgtgggatttgaattaaaattttatatttgaactcagagaattagagaggagtcaaggaaaataaatatggtgtgagtttgatattttcgggataagtttgtatttgaaccttcggaaagtttgagggggatttaaggggacaagaatttggatttgaaactagtttcgaatcaaaggaattactgccgggggaggatagagataaatatggtttgagttgggatcgggattcgagttttacattttaacttagtgaaatacaaggggtcaaggagagggcatcgactcgagaacgtgatattttgggatggatgtatatttggggacttgttggattattcgaaaggaattcaaaagagagaggggaaaagaggaaacttggtagcatgggttcaaggatggagtttaattggactttgcatcttggagttgaaagggatacttggagaaagggttcaaaggatagatagattggtagatagagagcgagagggggagagaggagggagggatgaaacttgagagtttgagttcgaatttgaggaatggtttgaaggaaacaaaaggcggagtttaggatttggcggtgaatcgctggatcgaattttgaagtcagatatttgacggagtttgtggatagggttttaggagagaaatccgaatatgaaaaattcgaacttccgatattatctggaacgagaattttgtggagttggttgttggcatcgatgaaggaatcaaccgatggattgaaattgagatttatggcacaacttagactctacaatcaaagaatgaaattttcgcaattagggttttcattaaattagctttttaatgccacgcgaaaaacagggtggtacacaccgccacatatgaggttcaagatagtattgttgcagtccacattgcagccttgagtattgcgatgcctagtactagacctttccactttatgtctacttaatgtagttttgttcaactttacattttgaaaggaaaaactttttgaaaggaaaaaagtgggatgctaggaaggaacttagtagtggcgtagctaggattcagagtaaaagtgatccatctatatatagtaggtcaattaaaagggtggtccactatataatttttattatattaactagtatatattgtcacctagctagctaggcctctgcattgaggggactcagtgggatgtgtaacgctctgcttctcgtgagacattaaaaactaattcggcaaaatcctaattgcgaaaatttttgttctttgtgtgagagtctaagtcgtgccatggatctcaattcaatcccgttgttccctctcatcgaaatcaaaaatcctccacctcaagatttcctatccaaaattcaagtctccgaaatcaaattccgaaagtcaatcccttcctttgaatccttgccgaatattcgctccgactaaaaaaaatatccaagtttccgttttgaatctcttccttgacttctcctcgagtctcccttgattcctccctaaaccatcgagttcgaatgtcaaatttgaattcgaatccaaaaccccaattcgaatccactccaaatcagtcttctctgcaaaagtctattttacctccctcgggtgttgtgggccgttttcccccttagcccacctccctccctcagcctcgcacgtgcgttgcacgtgccgagccgagccaagagagagctctctcgctctctctgtttctccctctatctctcgttttctctctcgcgcgccgacgccgcttcccgccgtcgccgcccaaaacccaccaccgccttcgctctttcccgcgctcgcgcgtggccgaccggccggtcgttgccgccgtcagccctgtcgcgcctgcgccacgcagccgcccggttgccgccgcgtcaagccctggcgtcgcctgcgtcgtgcactgccgctctgccgctccacgccgctagcttccaaagctaagagaggcagcccctctctcactccctctccctccttcaacttttccccgaaacagcaaggagcagagctccctttctccccctcctttttccttttgcccgaccaccatcggcgtcaccgcctgccaccgcctggactaatggcgcgaccgccggctcctccccttgaccgccctaagtcggtttcctcccccaaaaccgacttcccgcacccataaaacccaacccgagcccctccctttcctcttcgtttccttgcccaacctccaccgcaccattgttgccaccccgccctgcagtcgccctcgctgtccgtcaccgaagcaccagggagaccggtgcgtgcgtggacgcgtgacgcgggactccaggcaccctctccttccccttccccggcccgaggccggagagctcgccccgcaccgccgccgcccatcactgcgcccggctcggtagtgcctccctccgttctccttcctcgttctccctcgccctctctagcttgcatgatagctcggttagcccctcgaacgcgcgtacacgccgccccgacctccgccgctgctcggcatggccttgccgccgtcggcgcccgctcccggaggccgcctctcgtcgccggacctccacagcgcctccccaccccatccaatcccacaaacgaaacccttgagccccggagatgctcccgccgcctttaattgagtcctcgtcgcccctcggtgatttcccctttctctcgccgccggccgccgctgtcgaattccaccgccgtcgaactccctccggtgaatccgagccgttggctcgctccttctcgacgccctcgtcactccggtgtgctccccgaagaccaaatccgtcgtgcttgctccggtgaacaaggccgccgtccgcagtccatctcggcctccccttcttcctcctcctgccggcctgcgtggctgccacgtaggcgccacgtcggcgccacctcggctttgaccaagccgagccggtcagccacctcctccctccccccctccgcgcgcggtccacggtgcgccaaccggccgcgcgtgggcccgccgcatccctagtccatccggtgcacgcgcgtgaaccgcgctcacccgaaaccctagcgccgccctcatgcgccgctcccacggtgagccgcgccaccgacaagcaggccccactcgggacaccgcaaggtggactcggcccaccggccctctctctccctcactctccccgcgccccattgggacgcctctccgggccagccggcccattagttcggccgagccgtgcctctcctcttgggccgcacccaagccgcccgaggaagtctaaatcatatccctccttcaatttctttccaaaaaggttttaataaattattaaatcctttttcctttagatagaaattccttaatccttagaaatccatatcttctcaaccgctcatccgattgactccgttcaactttcaataattccgtaaaattgagatctatctaatggtactattatctagtctaaataggatctttattttgggtcttgtgtaggtttttaattgtttgcgtatagttgcggttaccggattttcgtcgatcgcgggttttcttgaagattcgtgaagcttcgtgaagacctcgagcaaggcaagtcaccctttgaccaattgctcctataattgaaaaatcattattattttgtttgcaacttgcattattagaatcacacactcaacttgcttggcctcggtttgcgtgccaaaccgacggacctacccagtagtcgcactaattcctgtaggtcgtactaccctgattccttgtcgctccgcccttgtggtacctcggtattcgtgctctctgagcgcgtataccaaatatcccacatacaccgttgtttgtcgaaaacttgggaaatgggtttgtgaagccttgaaaacccgacatatggtgtcggtgtgtttgaaaataaaatgaattgtgaaaactcgcgatgcgggggttgtacctatgtggcactgtcccgtattcacatataaggaccgattcctatgggaaactcatcgaacataatcaaagtgtaaccacaaggtggaatgggacaccctggctaagtaactagtcggttcagggaaacgtcgcatgccaatagttgggaatgccggggcggggtcaggacaaaccgggttcctggtaaggcaaggacgagaagcttgctctcttaccgatcaaggtggttggagttgatttgtgaatgcctaaaatggcctatttttatgtgaggatttgatccttctatgtggtatgaggtaaccctgggtcggcttgggaaaggctttgtcgcaaacctctgacaccggccagtgtttggagtaagtctatgtcttgagggtaaagtgtacccctctgcagaggttaactaactgttcgaacagccgtgcccacggtcatgggcggatgtgaggtggttccctttgcgtagatttgattgcctgtgctttgcgaaaagttgttgtggtttggaaatcgtaactagaatcagcctatgtggcagatggatgacctgagtggtcagaaacggatctgtgtgattcaggatgtctgcgggcatcatagactaggcttcccgagtggaagcggattgctttgctgctaggcagctggactctaggagtccgagaaaatgaaaaaggctctgggagccgcttaatcaagtgaaatggctctgggagccgagaagcaatgatctgacccgggaggtcggtacattaccaattgagttgttgaaaagcatctcttaagtcgaatcgagacgcaagtctcttttcgacccaaacctaaaaagaaataaatcacttagtggtttcaaaatggatttcaacaaaagatttacaaaacaacctcgcctctcttccaagcttgcattaaacacctaagttcccgtgacttgccgagtacgaaagtactcacccttgctctatataaataaataaataaataaataaataaatatatatatatatatatatatatatatatatatatatatatatatatatatatatatatatatatatatatatat

SEQ ID NO: 62027 - DNA, 3992 bp, Oryza sativa
  unsure (1)..(3992): unsure at all n locations
tcctgcagcccttcaaaaaaaaaatttctttgatatgaagtttgttttgtattgcaaaatgtggcttgactatccaggctaagtgtataactattctgttcacgtatgctgataaaacaccaggtagactgttcaactgattggtctcacaccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtgaggggatggtggacggcaggatggccggcacggcggcggcgctgggcctgtcggtggtgtcgtcggtgtcgatcgtcgtctgcaacaaggcgctcatgagcacactcggcttcgtgttcggtgagccctgaacttatccgagttatctcgcgtacagtctgtttctgttggacgccattgttcgagatgccaggaacatttagcggtttatactgcctttaatcgatgcgtagcagagtccccgttgttcccgtcttgtgcatcgcctgcgataatgatttctgattaagctcagtgacggagaatgctttggcctgcgtagaagacaggaggcggcggtgtacggcttgcaaacgaggagtaatttgtgaaaaaaaaacttttatatacatgttcttagcgaactaaaagcaaatgctgaaaaataaagttcgataaaaatacaccaaaatcagcttcaaatttaaagttgaaaatttaaattttggctgataaatataagcataagcgaaaagatgaaacaaatagtttacgcaagtacctcctacaagtacactgcagtttatgtgtcactcgaatggttataaaaaaataaaaaaatattaagaatatataaataatatgtgatatattatttcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtcctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaanaatcctttanattcctccattccaaggaaggcctaatactattgttctatttaatgctagcatctagcactctgtccgcatacattggactgcggcaatacgagcttagagcaacgcaaatgactagataagtatgcactctaggtgttctttgaattgcctcagtgcagacttgatgaccattttctgaacatctctgctctgctgcatatgtgagtcaaattcatggctccatgggacaattggaaattgcacaacgttactgctatcctattcatgtatttgttgaacaaaaatgacatccttcgaaaattcaggaaacacaagttgcctgatggacacggttcattaataaggcacacaaattctatactactttatgagtacaatatgacgaacaataccacctgagaaaactaactgtttcctaagctatataaccatgcaaaaatcacagcactctcctaatttctttcagctactacgctgacaagctggcatctcctggtgacattttgttcccttcatgtggctcttcagatgaagcttttcgagaacaaagatttagaccccaagacaatcattggatttggaatactaaatggcatatctattgggttgcttaatctgagccttggattcaactctattggcttttatcaggttggtttactcttcagaaatcaggccaatcttgcatttgtttatttttcctattttgagatgaacatattcatcttcagcaaacgacacctgttggaaactttaaaacttaaattcttgctggaaatttagtagttgaccttgattcatgcccaatctgaaaatcaacatgcacacaatatgttgccctgattttattggggatggaatgacacaattcaacagtctctagtttcagccaattcatgttctttgtctacagacctaactgtgcttgtgtaattagtctactgctttgtctaagctatctcactctatcaaatgcatcaggtaaccaagctggcaataattccatgcactgtatctttggagactatattgttcaggaaaacattcaggtctgtccaaattttgccttgtcttatgtaaaaaaaaaaaatttgccttgtcaattcacgctgaaaaaaaccattaactactaaatatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgctt

SEQ ID NO: 62028 - DNA, 1121 bp, Oryza sativa
agcgtgtagggtgttgcaaagcggaaagtggcaaatacgctttcgcttatgaaccccgtgggccatggcccttatatattcctacctgacaacttagaccgtcgatccaacacacgaacggccaggatgctttgccgcttctcccggttctagtataaaaggccactcgtggcgcaaaccctagtagaggagagattaccttggaggcttctgagctcgaaccccccgccgccgccgccgtcgcctcctccatccgccgccatggtaaggccttgcttccctatgcttaacgcctagattgctttgcgggattcagcgctgaactgacctctcttcttgctgcatcggcgcagaccttcaagcgccgcaatggcggccgcaacaagcacggtcgcggccacgtcaagtacatccgctgctccaactgcgccaagtgctgccccaaggtaaggcgaagcgaatccccttttgccctctctcgttgcgcgcgaggcacccactggatctctgtgttgattgggaatctttgctttgggtgcgggacaggacaaggcgatcaagaggtttcaggtgaggaacatcgtggagcaggccgccatcagggacgtccaggaggcgtgcgtgcacgatggtgcgtttcctctcccccgcttttggtttcttttgctgaatttgtatgtgatgcgaaatcgtagtagaggttggatttgtgatcgccgataacacactggcgatttgcatactgctggaaatttttattctatcttgatattgttgaattgatggcatacaatacaactatctcgttgcaggatacgttctccccaagctttacgccaaggtgcatcactgtgtgtcctgtgcaatccatgctcacatcgtccgtgtccgctcccgtgagaaccggagggaccgcaggcctccggaacgcttccgccgcagggtacctgatccccgcctcttaactattatatctagtgcttaattgatagtgtaattagtatatcatgatcggaacgatttcctttatctgttactgcagatttaagaaacaaagtctgatatactaatagacgtaatgattttgcacagtatttgagatatctcttatctgcacatat

SEQ ID NO: 62029 - DNA, 668 bp, Oryza sativa
gatattatttagtaccactataaatctggatatgacatattcgtattactagatatatcatggatcctgtttagatttgtagtatcacatcttgtcttaggtgactgtaatttgggacggaggaagtatcacaattttcgaatgactattattggccgtacactcgtacttatttatcacctgaaatgatcgttctacgtcctatgctcaactcggttgcttttctctacacagtttcttcgttgtgtcggtccagcatgtggtgaccacccctcccccccaccccaccccaacccacatactcgacctgtggagtttcatggtgatagatctccaaaagtacgtacctgccctgtcatgtcccgcgctattacagtgtactagtgtactactgctctgctcctacttgaccatgctcaatcgatcaaaacctgagctttctttcagtaaaaaaacgaaaacggcgttgcagactcggactagtccgcagcagtaaaacgcggcaccgaaaaaaaggatcacgaagagatccacgagaggggagtaggaacggaacggggcctcgtgacaagaaaacgggggtccaactcgaattgaacggccacccgcagcgcgacgcaactgcaggcacacagtcgtcgccagtcgccgctcgtactctctccgcg

SEQ ID NO: 62030 - DNA, 1004 bp, Oryza sativa
ggagctggcgattgatctcggcggttcgaccggtgttacaacctcggtcagaccgacgatatccaggcggtcagaccggcgctactacttcggtcagaccgcgatccatcgatttcgaggataacttttattttcgctaaattttttttgtttttgggtataccaaccattcactcctctctggttggtttagttcttgtgatttaatcttacatatagtgagttctcgcttgctgtttttgcttctcttccttttgctggagcttattggtttcttagccagcgtttctagtttctctttcttttcctgttcccgaatcccgggcgatggttgtccggctgccgtgtcgtgtaaaaacttgcttttgcttattctaatagaatgacgtgtaattccttgtcacattcataaaaaaaatgaattaatcatcgcttcaccgtcaaaagttgtatggttaatcctaccgaattgtcaaatcgagcatggcatacgttaaaaagctcaaacagcaagtgcatcttgcagactacaccatcacagagtccagaattatcagaacgatcaaacgtctggtaaaaatgcatcccccaaaaaaccctcctcctatttcagtcaaattctgaccacacacacggccatctgctaccagctcgcgttcttaactcctcccctaaatgcactcaacaaccttagtaaatccaagctaagcttcctccgctatataaacacccccaggaagccccattccatccacacgtttcagctgtctttcagtgttcacgtaggttgtagagagcacaacaacgtacgtacacagcagcaaagactgagactagctagcttagctgacatggctccaaggtgcgcgacgctggcggtggtggtggtgctggtggcggccgtggtggcgccgccgacggcggtgcgcgcggctatctcgtgctcggcggtgtacaacacgctgatgccgtgcctgccgtacgtgcaggcggggggcacggtg

SEQ ID NO: 62031 - DNA, 27008 bp, Oryza sativa
tcggaatgtttgctgcttcactatagagttttaaggaaccaatgtccagagctcacgtgttataggtgcagtaaagtcggatgaaatcatgaatatctgtttcggtctagacacttttcttttaagaatggtcaccgggggcgaaatgcccacctgaatatgttacttcaaacaatcttacacagggcaggcttagcttatgcaagcgtaggtggccctggaggataatatggaagaatacacgggatatacaaagaagagaatacaaacgtatcacaacctcccccacctaacacaaagaggcacaatagatagaagacagaagctttgacgtttgccacctgcaaaatcacccaacaaaattccaaatcaagcaaatgctagaacccttgttcgacatcatccacttcacatgcagtctggaaacaccaggaatcgaaagtgtcggagggcctctccgccatacgcatgcggctcggtaccctggcagtgtgaaaggctgtggttgtcgaagaccacccgcatcatgcaatcagaataatgacttagtcatgttgctgctgggatcaatgcctgtcggcgtcctttgggggaaggaagccccaaaggagggagggccactgaaagattgaggccataggccatccgcatcaagtcatcttcaatcagtctttaacaaattgctactccctctgtcctaatatattgcaacctaggatgggataaatttatcccattctaggacaatgaatctggacataccatatatccagattcatagtcctaggatgggttgcaatatattgggacggagggagtagctagtttaacgccctccaacatccttcgggggaaggaagcgccaaagtaggaaaggccgctaaactttgcggacacattgatacactgttagtcttgatctcgtctaaaaatttaccatggtaacagatcaaacttgtactacctccgtcccaaaataagtgcagccataagtttccgcgctcaactttaatcgtccgtcttatttgaaatttttttataattagcatttttgttgttatgagatgataaaatatggatagtactttactcgtgacttatgtttttaatttttttcaaaaaaatttcaaataagacgaatgatcaaagttggacgcagaaaaccatggctacacttattttgggacggagggagtatttttcctttagaaagaagtacagtatataccttcatcttggaaatgacaaagttctcagtagtgtgtgtgtgtgtatactaatattttttcgaaacgttcgtcatgatatgattatctatgaaaatgtttctactgcattatcatatattcatatttttcctcgacatattgtactatgaggacaaacttatcagttaattgacaggctgtaaagttgtaatgcgcttcttacatttttgacagaagaagaagtgctgtcaactttgagataaaggcaaaattacgagaaaaaagactttcaagttcttttgaggatgagtgaccctggagagccttctaagcattcccaatggatgtcacactggaccaaaggaagcagcagtgcagagccccaagttggcagaagtaatgattctccggaggatgcgaaatatgacatttgcgaggacaattctgggccttcaaactttgagatcatgaaatctagattgtttgaaaggctaatggtaggaatcagccaagaaagagcttcgttggagcatggacagaagttaaattctaacatgaaagtagtggtaaaagatgctcgccgacacgctgtgcaaaaccaaattgatcagggagacgggccaattcaaaaatctgtgatgcaaaaagatgtcttatatgctaaggctgttgtatcaaaatcactttccattcagaagctttcagagttatcagtggattgtcagaaacttgcaggttcagatgacctgagttcagagtggaaccattttcctatgcttgcaatcaacagaaaaattgactccattctcaaccctaagaggaagtctgcaaagagtactggacccaatgacgtttttgtgccaaaacaaactctgaagctaaacatgactacagctaatctgatggcattctcatctcaggaatatgagctgcattctcatcgaacaaccgacgagacaatggatcactgcaaacatgcaggaggcattgtatctcgcctggaagatcatgctggtgtcatgttgaatcctgcagagcaaaaattaaaaggtcaattattgccagcaacgtcatgttcgtgtagcaaggatgacagtaactcatctgatagtctattagatgagcagcatacaagccgctacattgcagattcagatcaggaaccaacctgcagatctcgtgaaaaaaggttgaaatcttcagaaaacaatgacacgaactgtaaaattggaagttgctcccagaatcagaagtcaagagcacctggacatcataaacacaaaggttctgcgggagtcatgtttcgtacgtcagtacctggtaaagaatttgaagctgctgaaattaattgttccgacaaaattaatcagcgacatctgaatacacagagaatagtatctgcagcgaatgtcactggctcctgcatacctgatccagctgcagacatatctacagtaaatggtaggggggaggcagtgacccagccatcgagcatatctggagattcaactaaacgaaaagctccatatttatttgaaatgctaaccataccttccaaagctcaaaatatgaatcctgaagattcactgccttcaggaaactcgactgcttttggagttcacatgtacggcacaaatattggcagtcatctatttggagcaaataacaaatcatcaactgaaactgaaatattatccggcgacagtcaacatgtttcaaaatcctcagcaggtaggagagaagaagctcagataatactcatgcgacattcttttagcttatattgattaaaaggacttgtctctttccaatgttgtttgagtcgagattgatttattgggtatgaaagaaggcaataaaaaccttgaataaaatataacaattttctttattccattggtggtatcactcacagttttgttctctcttctttcaggcatcgcctcattgttggcacaaaaggtactagtgtcctatactactctcatgtttggtcgttatcatataagtttatgcaaatttactttaaaaatgtatataatattgtcggatatgcattttttttctgcaccatcaacattgttttccatatttaagattttgatcacatatataatcatattagcttggacatagcccatttttctcttcttatatcctcgcaaacaagttacttcatgctatctcatttatatgaacatgccgcggctaattcctatatggttgcaggcaaaatccgagcagctcgcgactctgtacatgaaaggagcatcaggatgcaatgtgaatgaacatcaaggtgtttcctccaaggcaattgtcgccaataagcaacaatgctacaatccaagaacagcacgcatggacttagatctcatgcaattccagttgagcagaatgagaaaccaagaatcacaagcgcgaaccgaaccaggcgacagatggctaaaacgcctacagattgacagcaaggaccctcatcatcttccttgctccaagaggtcaaaagctggagacggatccggtcgtccagtcaccggaggagcaagcagcatggcaccccgttgcgacgggagcaacgacgacgacgacattgttgaccgtgatcataaggaggaacaaggattggatgaaggggtggaaattcaaggcggccgagaagcatctcctgttccggcaaagagtgatgaccggtggattgggagatggtgccagggtggtgttcctgtgtaccatgaagatgatcatgatcagaggaaggaagtaacaaagcctgatcttgccgccggtgactccggaggacttgaaggtcagttcccaagcatcaaggcgatggcgatgatgggacgagcaatgagcaaggttcggccgtgtcaggaagagaggaggggatccttcatggtgtggaaggcgtagtaggagagatcctgatcacgtacaggtttttttttcctgttttttgttctgtgtaatgtagactgggctgccctctctcctcccgtggcagctggcttcagatccggtggctatcttatagggtatgtttaccaaagtatctttgtgccagcttggactccctaatcctcttaatctcttggcatctatggaaggaatgcaactctagagatttcgactctgcgctcttttttatcagtggttcagtgtaaacgatgtctggttttcaggtttatgagggtaattcggttgaccgtgatagtttgggagtaattcgtacttttttcatttctaaaataaatagttgtaaataaatggatctacgtgttataaacatctgcatttataatgttaaaaaattagtacccctccgtttctaaatatttgatgccgttgacttttttaaacatgtttgaccgttcgtcttattcaaaaaatttaaataattattaattcttttcctatcatttgatttattgttaaatatatttttatgtatacatatagttttatatatttcagaaaagtttttgaataggacgaacaataaatatgtgctaaaaagttaacagcgtcaaatatttagaaaaacagagggagtactctttttgtaagaaaaaaaaacttagtatgacagcttaacggatatattatgtttgttttttttatgtactaaaagggagcagtaaagtaaataaatctagcactgcaacttaatggatcgtcttttactagagctaatgacagaatggacaggacgatttgccttttgttccaactatctatgagactatgacatactcattccatcccaaaatataaggcttaactactcataacataaagactaagaaaatatttaatctcctgcttggttggatcaccctaatacatacaagcaatgtgattggaatatttgatggtataggatttaaaacaaatcaattctattggaaaatatttaatctcctgcttggttggatcaccctaatacatacacgtcttatattatacatgagaaaaaaatggttgtgtggaagggagtagtaagtacgtaaaccatcatcagtcatcaaatgaatctagtagctgattctaattaacggttgctatatgcagatcgacgagatgacattaagggggtgtttagatccagtagtgtaaggttttggcgtgtcacgtcggatatacggacagatatttaaagtattaaacgtagtctaataacaaaacaaattacataattcgcctgtaaaatgtgagacaaatttattaagtctaattaatccatcatcagcaaatgtttattgtagcaccatattatcaaatcatgaagcaattaggtttaaagatttgactcgcaaattaatcgcaatctgtgtaattagtttttctttgcctatatttaatactttatgtagatgttcaaatgttcgatgtgatagggtaaaaaaaaattaaggtggaatttaaatggggcctaactcctagtaagacacaaggaaagtgactccagctttacgagcaattttactgtctttgagaagataccatgaggtatcactttttggtacgaggtatcactttttggtacttagatactatgaaataacgaattttacactaaatttttgatatctcatggtgtatcctcaaggaccataaaattgctccaagctttagagccttttgttccgactatcgatgacgtaggtacgtaaaccatcatcagtcatcaaatgaatatactgaagggatggatttgtccctccaaccaaacatcacctattaattctaaacagttgctatatgcagacaaaaggaatgtgactccagctttacaaaagttcgtcaacgtaacctgtcctttggatagctgcaaaagctcaattatacacgtaggagtagttcctttggctgcaaaagtagtttggtgatgtggatgtgatgtttacatttgctgctgcctttggtgatcaagtggaatatggtagtactaaaaaatttacattagctgactagccattcgtgatgctatgtttgttgatttttccgatggagagaacggtgatagtttttttttattatttatttattggcacgtctcgtgtctatatatcgagaccgatcgtatccaggcgcacgacacttgacaactctgtactacgtagttcgtgcttctaaagagcgcgggggaacccatcggcgatgccggcgcagtcggagagacttcgcttgccagcggcggcgccgatgccgcgcggtgcgcacgctctctacggactactcgcgctgctcggcgcgtcggtggtggtgtggtccgtcgccggcaagccgcccgccgcccacgccgggcacgcactcgccggcttcctgctttggctgctggggatgatagcactgctgctgtccccgtacgccgcgcagccattgttcccggttgcaactactgccaatctcgccgtggagaaactgaagcatcgcttctccaacccccggacgccggcgcaggcgcaggcgccggctttggcttaaaaacccaccgacatgtacgcgacgcaacgcaagcggcaaagccggtcctacgccgaccaagccgcgccgtcgtttactactactactactactcgtacatagcaagtgaagtggtttgagactttgaatctgctcgtctgtgtgtgtgtgaataaaataagttcagtttggcgataattcgactgcaagtgcaagcagttggtttgatttactgatccagttctagcattcgcagctgatcacgcgttgtaaatataaagctttgttctttccttcattttcagtatacaagtttctgaagctactgtaacttccaaaaaaaaaactaaaaataacgaaaaaggctggacgatactagtactactcgttattactactaataatttactgtactactactagtagccaaacaaaggggacacattcaatttacatgcttctcatttaggagatttggtgcgaaaagaatagacatattttcagaagcaacgaactttcaatatcacaactagtgacaaaaaaataaaataaattgtatgtggggcgaaagatataacgagaatagcgccttaccatgtcctctgatgtagtttgttttccttctcttttttggttttttctcttcacccttggtgattgtgtacggtttactcccctacctaggctgcaatccatattgtagttcgtttatttatgttcctaaccttcactctcttgttttcacgtgtacaccttctaaccgtaaatgatgtgttttttaaaacgttctatggaaaaagttgctttaaaaatcatataaatttattgttttaaaattttaaactaatacttaattaattatgtgctaactcaccattacgttttcagaattagtttcgaacacaatcttaatattaaaccagtagcgtctgtcattaaaattactagtagctcggtttgagaaaccagaccattgattaagggcatgtttggagaatttaagattttgagaatatgaaaattttaggtttgtcagcttgtgtcttttaattcattttctgattctaggcctaaaacggtttgaatccaaaaagcccaaacccgcgaagaaatatcccaacccccttcgtcctcccctccttatccgccaccaccaaacccaaaaccccacctccacatctcatccttcccatccatggcgccaccgcgctaaaccccccaccacactccatccatggcgctctccgagctcccgctccaccactccttccgcctctcctcccgcccccacctccgcctcctcccgctccgccttctctcctcccgccacgcctcctcctcctcctccaccaccgccgccgcgtcctcctcctcctcctccggcggcaaccgcgcccctccggctccaaatccaacccgaggcgcgccgtggctgcagaagtgggggcccaccgaccccgccgcgccgccgccaccacctccggctccctccccgacctcctccatcgaccgaatcgtccaccgcctccgcaacctcggcctcgccagcgacgacgacgagcccaccgccgccgccgccacggccaccgcgcctcccgacggcaacgagcgcctcagcgacctgctcgaccgcagctgggcgcgccccgaccagcagttcgccgcctccagcttcgacgagtccgtcctcccctgggagagggatgaggtcgcgcgaggaagagagaacgaggaggacggggtgaagaggaggagggttagggcgccctcgctggccgagctcacgatcgaggacgaggagctgcgtcgcctccggcggctggggatgactcttcgggaccgcatcaccgtgcccaaggcgggcgtcacgcaagccgtcacggagaagatccacgacgcctggaggaaatcagagttggtccggctcaagttccacgaggacctcgcgcacgacatgaaaactgctcatgagctagtcgaggtgtgtgctatattagccctttctatcagcattggcagcttgctcgttgtaactgtttaatctattatgtttttttttggatatcagttcagtttagtgatttctagtggcaattgaacttgaattattatgtttgttgctgtgaattcgaggttttcgatgagttattagttgtgccatgataaatggattacttacatgacgtttgcctatcgatcagcgacggacaggaggattgatcatatggaggtctgggagtgttatggtggtttacagagggagcaattacaaaaggcctttgaaatctgaaacattggatggtaactcatcagcggtgaaaggggcagacggtacattgttcatcccggatgcatcaagccccacagagcatgatagccaggggaaggatgtaaacacccaacgtgagattgcagccagattaaatatgcagaatactgaggacatgactgaagaggagctggagttcaatcaaatgcttgatgagttgggccctcgttttgtggattggtggggaacaggcattttacctgtggatgccgacttgttgcctcaaacaattcctggttataaaacaccatttagacttcttccaactggaatgcgtttgaccctaaccaatgcagagctgactaatttgcggaagttagcaagggatcttccatgccattttgctctaggtgattatttcgacagtgttcatattgtttatcccctattatagcttttatttgttggtggcaaacgcctgactactgcttgataaaattcatttaagggagaaaccggaatcatcaaggccttgcagcagctattgttaagctctgggagaagagtttggtggtgaaaatagctgtgaaacgtggaatccagaatacaaacaacaagctaatgtcagaagaaataaaggtttggacaccatgctgttgctgttttgactcattgactggcatacctacttacttcacagttcacagaatttatgccaaggaacattgaaaactatggtaattgccagattatatctaaatatacaattgcttgtcatagctaagctgaatatatgatatatctagtcgtatttgaggcatgaagaaattcaactaaaaatcctgataaaaaaggggcaactataaggaatactcagtactcacttactcagcagtaggttttgatgaagtccatatttgtcctgtgaatattacaaaatccatgatttgttaaatcatccaaagcaacaccaggggtttcggaaaataataacaaaattgtgctgcactgcttgctctaatgaatataacttgcttaatgtaatgcttttatttgtctaaacaccatcatagacaatcatgctttaccaagatcatgatggagacagcttcatatagtttagttctattccttgtcgaactttcatagagttccaaaggtgtgtttccatgaatcaactgtgttcaactgttcatgcactatatttgatttaacctgtataggatttctgaatcagtgaagccttatctttttaacattatttcagaatctaacagggggcaccttgcttcttcgaaataagtactacattgtaatatatcgtggaaaagacttccttccaacatctgttgcagctgctttggctgaaagagaggagttgacaaaagatatccagaatgtagaggagcagaaaagatgcattccggttgtgcactcaatggatgacagtttagatgggcatgctcttgcgggtactcttgctgaatttcaggaggctcaagctcgttggggaagggaagtaactgctaaggagcaagaagaaatgaaagaagcatcttctagatcagtgaaggaaaagcttttcaagagactagagcacaaactttccattgtaagcattttctgcatgttctctgataaaacttgtcttattttgtattgccattttttaattatgccgttgatctaggtatgccagtgtgcttatttgacatatatttatttccatcagttgttatgcatgttctttatttcttcttcaattgttcaggcacaggcaaaaatacatagagcagagcggttactatcaaagatagaagcttctatggtccttgctaatccatctgatgataaagaaatgattacagatgaggaaagatctgttttccgtagaatcggtttgcgtcttaaggcatacttgcctgttggtgagtttcttgaacaataaccttggagagcattctatactatttctattgattgattattcccccttccattttaggaattcgtggtgtctttgatggcgtcattgaaaatatgcacttgcattggaagcacagggaagttgtcaaattgataacaaagcagaagactctgccctttgttgaggagacggcacggcttctagagtatgagagtggcggtatactagtcgccattgaaagagttacaaagggctatgcacttatattttaccgtggaaagaattataggaggcctattaacataaggcctaggaatcttttaacaaaagcaaaggcattgaagcgtgctgttgcaatgcagcgtcatgaggttagtttgctacaaaagaaaaaagcaagagcagtaccttctttttttatgataatcattgtacacaactttagcatccttctgatattgtttaaactcatgaattgttatgcaggccctcagtcagcatatagctgaactggaaaacaatataaggcagatgaagttggatttggtacgtaatttctcatattacagaaaagtagttgtgttttaattaaggcaaacatttagcataacgaacccttttttcttctcattatacagcactaaaactaatttctgtaggcttaaaatgtaatatgatgccatgccttttgtaatttttgccatttgcatcagagtaaaaacatattaacatgcatcttagttgatcctctgcccactaaatggcctttaaattccacaatatttacctattgttttagcaaaaaaacaaatgttgttattcattggcatttcattattaaggcaacaactttcccttagactgcattttttttcagcagagatgtttttgacagtgaggcatatatctgttggtgcgctagtgataaattgatcatatatgtcttttagttaatgtcttcattgatgaatgctttcctgattttatgtcaaaacaaaatagggcattgaggttgatgaggaatatgaagaggacggttcagattcagaaaatgagaataatgaagcagtttcctctgcaagatacgacgaggtatccaatcttttgaaactgatgctgtctgttttagaaccaccataaaatccattcttccctttaacgtgtccaggaccaagatgattttgatgaatcaagtgatgaagatgaatatgatgattatgatgaagatgatgacgatgacgatgacgaaggcgttgatagctagtaatatggaactgggctttgcgatgtagagtgatgtttatctctggaggtgatattgcaatcctttggacattcttggtaagagcaaagatttttgttttggagttctaccaatacctcaataggttcatgcatagcatatacagaaccatataggtacaaagaattaatcatgcagtttcggtttgtattttagggagattttttattaagaacactggggaatttgtagttggtttgtattatatcaacacctcatctgttactgtatcaattaatcaaccactagcctgtaaggggcttatcttttctgatgtccttctcaagaacattttgatgttagtaatgggcttagattctgagattttgaaaccacctccatttttttatttgagagatatttataccagcataaatggattaatggattttctcccgtactattcacttaggtctttttgttacacaagtactcctttgtgaatccttactgttattcagcattaaatgcaactttgaaatatcggcacattgcaggagccaagaggatcgccggcagaccttgacaactgtattgctgctgcttctgtttacgcatggtcttttggacgaagggcatataactttcgcatgtctctactctgtatatcccatttgctttgttgtttgcaaattggctgctgggatctgccttagaaaagctgagttgggtgtaaatggtaatcttgtgtcgatgtcttctcatacttctcattttgtaacaattatttaagcaggctcgaggtagaaggtacgtttccacccccaaaatgtactagcacacgagcactgtataattcttctgctgtataaccggatattccaggacacgaagaatgttgaatatacttggtttttctcccttgcacggttgcacgcattgttcatgacatgtttatacttaggttctttgtaagttttaaggtgattgttcttgtaatgctgatctggttcttatatcttcctcagtcctgttggcctttttcaccgtaaaacgtcattgtttatctgtctgtctaagtactactcgtatcaactactgaagtgtacgtcaaacaataaaaataaaagtgagtgtgcaatatgcttcgcacagaagacacgtgaacaagtttcaccaaatttattggttttcgactgtttggttttcatacaatctgtttgttggtgaaagccgaccggtattggatttcatatgacgttgatagaaagttatcactttttactagtttccacttcaaaacaaaaagatattggtgcgttgaccgaaactcatcggtttttactagttttcacatcgaaaatgaaaagataaaccctgcacgtttggcttgtcgattcgtgcagcatgtcgattcacaaaaatgctatcgatcggtggctattggcttgtttgttttattttccttcatttttacttgttgaggaggtggtcagagtttgagaacttttacggtacactacacttgtaatatatacttgtagtataaacaatctaatacactacacttgtaatatatacttatagtataaacaatctaacggtgtggatttatctgatctttcttttacagtataaattatgtagggtatatttgtctttctatatttttgcggaaggttatttttgtattttcatgattccttctttagtcagatcggatcgtgagaaaggggctagtcccatgcgctgccggtgacagccgctgcacgcgtccctggctcgcccccagcagccacggcgatcaagggccgccacgcgcagcaaaacaatgaaacgtcagcaaattaattctgaaagcagtcgaagattcatagggtcttttagagttcgtaacttcgtatgtgctagcaaatgctgatattcgtttcgatcaatcatgtatacaagcatcgtagtcgcacaaccggacactggctggatgatggcgtgccggtgtttgggaatctttcgatccgccgccccgcgtgatatattccgaagaagcgccgctgctcgtcgaacggacgacgagatccaaaacaaataccaactaagcaaacctttccagattaactccccccggtgcaaataaatctcaacttcaaattactaaataacccattctatattttgaacaaatactaaacatacccttctatataaagagatgcggcagctctactgtagacgctgagccatgccgtcggacgccgttggacggcagaggccatgtaagggaggtctagtttgcattgggccgagcccgttaatctgatgtaatttttttttccttttcagttttatcggttgaggaggtggcggagttttcttctccgacccctgttttcgcaagaggatcgccggcagaccttgacaactgtattgctgctgcttctgtttacacgtgtcttttttttttgtggacaacgtataacttcgatgtatgtactctatatatccccattgctttgttgtctccaaatcgctgttttgttgttcgtaccaacagttctacatcgtcctcggtcctgtggccttctttactgttccacaactgtgtcagtgtttatctgcctatcatactagtagtatatcaactagttcaccaatctgtttcatgtaggagacgcgggagcgattcgtgcagcatgtcggttcataaaaacactattgatcggtggctgaaggtattggcttgcttgttctgttttccactttttctccagtgaggaggaggggttcggagttttcttccccgaccaccagttttcctggtttgacgaggcagcagagcaccagcgcaggcagggtagtagcggctcgaacaccgtcttctcggctcccgtgtggtagagttcctcgccgccatacattccgcttacagcgcaacagatgcggcggctcggctgtcgacgcctcgacggcaagccggccgtcggcgccggtggacgggaggtggggaggagagagcaaccaaccagcagggctgctaattttctagttgggcctggcccgttgatctggatgttatcggcttgtttcttttgttcctttttcttgttttgtttatttgttagcttgatcatttccgtcgcgcggtctctttcgttattcgaacatctcgggcgcgcccacaaggcggataacattttattattccaaacaaaatagaaatacacaaacaggtcagcttattttcttgggctttttgggtttggccaggtgcccccatgatatatgatatataagtctaattggtaggctgcgtttgtttgtgggtttgggaatgatattttgagtagcataactaaacatgaaaaatgaattaatttatttattaaaaaattatataaaaagtttttcgtggaacgcacagtttagcaattcaagaaagtagcctaagccgagaagtggcttaaaactcagcctagtctccgattttaaatgtatgttgctgttgtttttcactttctttttaatctaagttggttagtttctaagacatttattcactatattctcgttgttaattgaatgatactcccctgtcccgaaacataatgcgcaactaccactaacacaaaaccaagaaaaattactatcactttcttgtttggatcacgtcaataaatataatacatgtatccaataaaattaaaaatcttaagggtgaaagttttagaaaagaattaaaggagagggggagatgctagttaattgcacgtatgaatgcgcgctttatattactatgaaacatcgaaaaggtggttgcggagtatattttaaagaggacggagcgagtattattttcgtgaaagaataggatctcattttcagtttcaatgtgcaatgaatacagagcaacaatgtcacgttaactgtttaattactcctgtacacatgcaagtctaaaacgacttgtatctggagagtattactacaatggagttatgacaaatttgtgacactcaatttggcaatttgtcacattcctttcccattttgctgggcactgaaatttgtggttggaaacattttttttttatcaatacacaagtggtagttcccaacaactgccccattatcttgacccttttttggtgcctaatacatatatatccaacttggtaggtttcagatgaaggttttcatgtgaaatcagcaatgattgttttatgggagtacagctcgtattgctgcttgccactcgagcaggagatgacacgatgcatttaactccacattattaattgggcatttgggcaacttgatttgggagttaaaataccggaggcccataatgagggagcaaaatgatcaaagtaatgccttggacgtcgtcacctattcccatttctgaggcgcagcatggcacttactaattaacattagcaattggattggtacgagttgaattttatagtacttcataagtatatttgcagcctgttgtatttttctactatatttggtgtgaaaaaaaaatgcgataatcagtatggctttttgcatctttaaatgcagtgatggggataaaaagagatcatcatcttcttctgtaagtcttttttttaaaaaaaatatggccaaatatgttaataagagcatattacagtcctattgttacaagaacgagaatgtaaaatctgttaaaaataaaacgtagagacaccgcaccttatattgccacaagacatgcaaacacacaagtacaactataacactgagtcactgaccaaactagggtacatgcaaaacctgcatactccctctgtgctgtaaaaacctacacagaatttgatttttttttttacgtaacagatggagtataaatgatcaaccacttctcccttttttttctacgagtctcagtaagcacatcagcaatatatgcctaaaaatttatctccaaaattttgttttcggattcttgaggtgtaagattcctcttttcaatatatatatatatatatatatatatatatatatatatatatatatatatatatatatatatatatatatatatatatataagttgactcataataataataaaaagtgaatcaaccccaaactaccaacagaaatagaaaaaaaattgctcacccccttcctcagcgagcacgatccctcccctcctagcgcatgatacctcccccatgcgtcactcaatcccgtgcatgggaggcggattaggaacctgggcgctttcccactagtggagagcaagaatgacgagaagggtatttttaattttggaaagtaatcagataaattgttagagccaaattttttattaaaaaaatattaaattttaggattaaaaaccatattaaacatccattggcgatgctttaattctctcctcaaagaaaactgcaagtgctcttctactttcaagtttttagcattattaaaggctggaatgttacattccattatcttaaaaaaaaaagttcagcattagctctaggggtctcatattttcgcttatgcttatgtataagccaaaatttgaattttcaattttaaatttggagttaattttggggttgcttcatcgaagtttatttttcagtttttactttaaactgctaagaacacacacacacatatatatatatatatatatatatatgtgtgtgtgtgtgtgtgtgacactcatatggggcactatggtgcccgggcaccatggtatctaatgcacaaagtcacttaaattttttaaattgtgagtatatacctagttataataattcgatccatacctatacctatcaacaaaacaactcaaatttaactttatttcacaatccatgattacatacctaactaattatatgtatggatgctatatatctagaatcaaaatctaacgaaaacaagttcaaattcagttcaaacttactttgaactagttagtaaagtagttaatgttaataactaagtaattgaaaaagtttcatactcatttgaattgggtatatactcaatttcaacaatggttcccgggcaccatggagcaccaaatatatatatatatatatatatataatttataaattattttcttatttgtaaatatgccatgaataagccaaatgatagggcagcaggacggtaaaccacatgactgattgactgcaagagcacacacccagtaaaccaccgaccaaatggtagaatataatgtgatatactagtactagtattgttctggagagaagctaacaagatagtagttgttgataagcagtcacaaaaggacatggaaagacaatggtccaagcatgtagaagcaactcagcaacgtctctctgctaaaagacatgctttggttgtagtggtggcttaaactactgctcagatcacttggactgctcctcatcatcaaccattcaaccctccaactttggacgtattatgttcagccgcacatatgcagggttaaacccttaaaaaaccggagacatgccaacacatcgaaggtgacggctgcctccactctttgctgagactaatatagtatattaggaccttctatccaggataatagttgacctgttccctccaactcttcacttaatgtttttttttagtttgttcttctttttccaagaaccttttcttttgaaggtcaatgggactcttgaatggagattagttagacacttgcatagcttaaggatattgttttttttggggggtaggatcattattgtgagatgctatatagctttgaccatggtcttaattagctctataatgcatcatatatagtgcacttccccaccactaagcaaccagtttgcagaggatagaaattgtttccattatccaaatcttctttgtttgtagtattaatgtaaagattaatcaaactctgaagcattagaacatatggattgtaatcatatcaactcgcgatgttgctcaggaaaactgtaccaccctattccagaagctagactattctgattgtatagaatcactatgaaaatgtacgaatatccgtctgggggagacctgtcagcgcaagtgcgcctatgtagaaccaataaaaaaaaccctcattcttgactaggggcttgtttagattgatttcatttcaaaccctatcattttttcggtaaagttgtcaaatatgtgcatccattttgtttcttaccaaactttgataaatatataagaaatcctaccaaaattttggtaatattgccaaaatgccagtaaggtttattttggctacaatctgaacaacccctagctttttacgagtaaattcactactatagaatttaacaaattgagaaaagtagtatttccttcgacgaaatctctgagataaatagcggagggttagttaacatcaccaaaattaggataacttacgatgaataagactagtatattgggaacgttggctggcagctgtggtgaggacatgttaacatcactgcaatttacaatataaatttgtcattactagctcttcatagtgctaaacttttgatatccagatcgatacttgatcgtcatccttgagtcctgtcaattgagttaagtaaaaaaattatatatactccttacatggatgttcgtcatctcccacattcatgcatcgatgcacaaaactacagacacttggcagataaaattttcattaactcaatagacacatgacgccatgatggtactgacaaaaataacaaacaaataaaacatgggcaaatggaataaactgcagtaggcattatggccagtgataagctcatcatccaagcacacagccaaaacaactcacaaaagaataccaactttgtatatcttaacatttcttacataacctatcgttttaacgttgttgataaactgtctgacgcatgctacattaataatcgatacagacattaactgcaagagaattttagttaatagtactaatttctagaagaccataaggctttaattctattggtcggcttcggatagatctatgtgacaaggtcttttgccaagtggaagacacacgctacgtggaatatacccatcccatacatacgttttagctatgtgcattgcattttgctgtggctagttgcactttaataaaacattggcttgcgttgaatcagatcgcaaatgatcacaaatgtgtgatttattctgacgatacacgatacatatatatatagttatatacccataatattcagagagtaaaatgatgctagtaatcgacgttgatgatttccacaccacaaaagggataaataattaaggtattggaagcaagtggtatatcaatatcacccttccctcctttctctgctactaggtacctagctatataggctgggcctttttatccaggattttgtgctttaattgatgactatggttttaaggagacgtggcacgtagaaataaattaagtggagcggcgtaagagcaagtttaatagtatagcccactactagctccaatttatttatagccaatctaatagtcaattcatacaatagttacttactatattattaatatatggtcccacatgtcatacacacattgcgtcttggagtccgtgctacagctagctacagatctgtagcccactactcttctctcacatcttttatctcattaaaatatgtttatagctgactaatagtctgctattgtacctgctctaatagcactctccatgtatagtactccatccattcctaaaaactttcgcggttgatcggcattgttttgactttgaccaccaataatattttttttagatggttatacaatgatgaacttaaaaaactcaagcttatgcttaggatgcaacatacttggtacgccttctttccaaatttttataaattctttggaaaaaagaccgagtgctcaaatttcgagtaacaaacactccctatgttctaaaatataagtgcttctgggagttttacccaagaacaaggtatatgcctcttgttaaataaggcatttgttgggggtaggagtttagtaggggataagactggaagtaaattgaatgagggtgattattgattggacaagtaatactttataagtgtttacattttgataaaaaaattaattcttcaagtgcttatattttaaatacaagaagcattgagattattatctaaaaaaaagaagcattgagattattcagggcagtcataaaaggttactgttgttttacctaactcatcgttcgctctatgacccataatcaagtgaaaaatgaatgaaataatcaaaatgctttatatctatgacttttatatatgtgttttcaatgatttgaaaactaatattgaaaaataaagtacgataaagaaaaccttaaaaccagcttcaaattttaagtttcgaaataaaagttttggttatggctgacaagccaataagaaaacaacgagtgaggtaaatgcatcaatagtctttaaaatgcaacatttgacaaaagaaaaaggaaaaaggaaatgcaaagtagaatcatatcctatgtgtaaattttacaactcctggatttgtagaacttttcgcctaaaacacatgattgagggcaaatctttccaagggacagcatgggctgtgtcctgtgtccaactcgttcctgcaccaccgcggcacacacaaggccacgtcgacgtcgggacccatgtgggcgcggcgcgtgtggcgttgccgcgtcctgcttagagcatgtacagtgacacgctacaagccagctataaacatattttaagaagataaataagaagagagaaaagtagcggactacagatatgtagccaattgtagcacggactttaagacacagtgtatgtataataggtgggaccaaatattaatagtgtagtatgtaaatattatataaatgagctattagattggctacagataaattgaagttagtagttagctatagtattaaacttgctcttaattagcagcgacgatggagcatgcaaacgtcgccgtcgccgtcgtcgtcgtcgtccgtctttatcgattgatctccacttgaaaattaatcagggatggctgcaccgccgcaggggagaaggcttcattaattaattccacgtcgaaattaatctcaggttgggtgttaacttcggaagttggaataatcctcctgtgtagtatgtacatggaggatgatggacgccatggtccaatgggcatcaatgcaccgccatgcatggaccggcttccatttgcatagaaattgaccacccaatccagtgcacatccaaggaaaaaaggcatgatttcgtgtcaaatcctagcctgttcaaaattattgaaaaaaaaaggggcctcagatcatttaccccgaatcatacttcggctatgttttagaagcccaaaattataagaaacaacggacgaaaattttagaaaacttgatttttccaatatctacctgctaaagttcatatgccgaattctagaattattgatttaaaaaactactcctatataagattctaagctatttggagaactggagattctgaaattgcgagatactcactccgttccaaaatactccctccatatacttttgatagtcatatttcattttagcacacagactaaggataagtaattctacttatcatccatttaaatatgctactagttattcctcgtaaacaagcgattcattaatatttacatttctcgatgcccatgtagccaatcctgtgtggaagaatggagagtcacgcattaaatccgagaaagtcactaagagaataggttttggattgtaatatgcctataaaaatattttttttcagatttaaaaatatgcctatcaaaagtagatgaagagagtataaggcacaaccacccttaaccaaaagatcaagaaaaacaattattatcatctcttagtttggatcaccctaataaatactacctctatctacttttgatagtcatatttcatcttgacagacaaaggataagtaattctaattatcatccatttaaacatactactagtcattcctcgtaaacaagcgattcattgatatttacatttctcgatgcctatgtagccaatcttgtgtggaagaatgaagagtcatgcattaaatccaagaaagtaattaagatgataggttgttgaagtgaaatatgcctatcaaaaataaaattttcaaatttagaaatatgactatcaaaaatagatggaggaagtataatacatgcatccaatagaattagagatcttgagcgtgaatgatttaaaaaagtaataatttaatggagaaaaggtgctagttaattgtatgcatgtatgcatgctggaacatttttaaaaaagtagttgtgttttatattatggaacgaagggaccgagggagtatctaattatataaagtagggacaaagctagctgaactctaaattacacagatcaattagagcacacctcgtcggggtctcacgatcgatctcagtgcccgaactgctcgcttccaagttccaactccgcgcttcgcttggccaagttgggtcaggctccacgccggattttgccgtgtctgtatccatcacgcgacgcggtttgcagagcccaccaccggtggcggagaaccgacgcggagaaagccggttgcactcgcgctgttacctgcgcattgcggcggcctcccgtgctccgatccgatatacgctcgtctgatgtggatgggagatgcaacgacgtcgttgaagaggtgagtcggacaaaacagtactgttctgtgacagtttttgcctaaaaacttggtggttcggtatagaaagttttgctaataacattgtgcttgtttggccgttatttttgtggttgcgggtatagccgtgagtagtagacgccagggtttcccaaaccgccggggccggggttaccgtaccccggcggtaagcacagtaatcgcggtaaccgtgaaaaaccgtacaaaaccataccgaatttatcaaaaattcaaattatttttaaaatttatttgaatttaaagaggttaccgtggtatttatattaccgtacccccgcggtaaccatgcggttaccggcggtaacgtaaaccctggtagacatggcttactactctaaaaatcatagccgaacaacttttttttctttttgaacggtcagtctgattagacttgtcttatattgatagaagggagtttaagtacacacagctaaaggccaaaagaaaaaaaaagtacaaattcgagtgcaaacaaacttgcacgtcaactctccttacacctcatggcaacattctcctgatgtgctttatgccggtgagtcccaccatcccaactcctattggatgcgattgattatttgatggattgttgcctctttccctctaaagattcccacaatcatttttctccagatttcccaagcaatggcaagaataccgaacaacctcttgtccttgttgaagatacacatatacatacaacaacattcacttgcacacaatatacgtgtggtattatgaaatgcacaacacatattcgaggataatgataaatctgcgaactcactaaattgttattgaaatgcatccgcccacataattttactcttatataagccgtttatttgttttttttttgtttgggcacatggaattaaccagagtgccaacgacaggcacatggacgaccatcttgcgatcgaggacggacagccctgatcgagaagacatgccacatcttgattcgattccactggagtaagtggccgggcacatcaaaagggccgtaacaaatacgtatcgatttctgtacgtactggagtacttccttttggcgaaacaagatcccgatcaatataccctccatctttccgtagcaaaagaaaggtaccgaaatgtatgtgcatcagtaccatttcacacaaaattctcttgctgatgaacaacgtacaccacatcctcccagagtccaaactgtggccgcgatcgcataatatctggtgctttggtgcagctcatttttgtccggtgaggattctctactataatgtataactactattatagtcactggttgtgagtcatactctcttattgttcgatctacacgttagtgtctgtagtgatagttgtagtgacagtgatattatgatagaggatgtgaacccacttgtgtcgtacgcagtcgtctctgcatgcatccatcgatccttaataatcaacggacgcttttgacgccatgcatggcttttgagggattcgatcgcctaaataattggggttcgtatagatctcgatactgccacagattttcctcatttggttctaatcaagaattttttttgtgatgaaaaacagtgagaacaagttgattcgatatgagaatccaactgcagccgaaatatgccaacctaatggcaaaggatatgtgcagcgcaaggttatgggctctgacctataagcgcgtgcacagacgaggtatcggattatatttgtcaatccaacctttgcttttggaagttgataaaaaatgccaaccaaaaacttttgcaatgttctttgtttatactctagctttgatgctccaggtgcaagtgcatgaattcggccatgttcttttctgattctggattctagattttcatttgcacgcttctaaagctactaaacgatacgtttcatataaaatactagagtatgcaaatttttcatgggatactttttaaagcaactttttcaactctatagcagttaatttattcatctgtatatatcctcaaatggttaccataaaaatcaaataatccatcgatttcagttatcacaaacaagggccttagcagcagaatttactagtgtcacaatcaaaatgtcaaacaagccccaagtcctcgcgcatctcttccaccctttctctgtggaagaatgcaaaaggatttggcaagtatatgtaagaataaagcaggggtctctctcactcgcttgaagccaaccttcagaaagcagtagtattttagagggaattcatgtgatacgatgacgaaatttctcacacacgtaagtgacaattcaaaattagttcaagttgttcttgaaagggaaacaattcgttgccgttccaaatattacggccatggtgagctgacctgtcagttttctcgcttgatagcaacgcaacaatatatatgcatgtcaacgacggagtacaaaataatcacgtactcctactaactcttcctctaaagattgtttctcatcttatatttcgaaccttcctccgtttggtcatggagtcacctttcaagtgaccgagtcatgtgaccaagcaatgtgacatttccattcacctagctagagtcaatttcatggctcatataagatctccattttatacccacgaactcttataacactacatttatcccttaatatttgatgctgattagttcaaaacataaaaaaaatataggaaaaatagtttaagataaaattaccatatcaaataagggaatatttcctacaacagcaatggcattttttggacgttgctatttgacaaaattttgagaggagcgtaaaattaaggaaaaattggttatatagcatcgaaagttcacgttttttattttatagcacagaaagataccggttcactttaatagcacccaaagatcaccctgttcccatttttagcacttccgtcaattctcaatcgttttccgtccgtcttgatccagccacacacacaatataatgtttctacccctcacaagtacaagtagaatgcatgttaatgaggggtagaaacgtcatatcgtgt

SEQ ID NO: 62032 - DNA, 1660 bp, Oryza sativa
aattcctgcagcccgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagggatccgccggggcgccgctccgcacgcgcgtgtgcatcatcgggagcgggccgtcggcgcacacggcggcgatctacgccgcccgcgcggagctcaagcccgtgctcttcgagggctggctcgccaacgacatcgcggcggggggccagctcaccaccaccaccgacgtcgagaacttcccggggttccccgaggggatcctcggcggcgagctcatggatcggtgccgcgcccagtccctccggttcggcaccagcatcatctccgagaccgtcaccgcggtcgacttctccgcccgccccttccgcgtcgcctccgactccaccaccgtgctcgccgacgccgtcgtcgtcgccaccggcgccgtcgcccggcgactccacttcgccggctccgacgcctactggaaccgcggcatctccgcctgcgccgtctgcgacggggccgccccaatcttcaggaacaaacccatcgccgtcatc

SEQ ID NO: 62033 - DNA, 59023 bp, Oryza sativa
cagtgaagatcagcaatttctcccctggtttgcttgccgtccaaaaaaaagatgtcccctagctttgatcagtgcgcatgcatcgactctactacgtgtaaactctacagaggcacgcctcatgagactttccttgatcagctatagcttcatcggtctgaacccactcatgatgaactctctgaaactctccccgttccactaacaccacccactaacatcatcataaaatgttttgctccgctcgtacacgcaaagagacgaacacgtcgccgcgcccgagctcacggtgcgcctcacctactgcaaacctctgcaaatgcctataaatacaccgacgaggcagcgatcactctccattcacagcaacagcacatctcgcagcttaatttcagcttactgatcagtgatcactgagctagctgagacaagtttttgagtatggcagcgaaggcatctgcagtgttcgtcctgctggtggtggtgctcgcggtggccgcggcgatgcggggagcggaggcggcgacgtgcacgccgacgcagctgacgccgtgcgcgccggcgatcgtggggaactcgccgccgacggcggcgtgctgcgggaagctgaaggcgcacccggcgagctgcttctgccagtacaagaaggacccgaacatgaagaagtacgtcaactcgcccaacggcaagaaggtcttcgccacctgcaaggttcccctgcccaaatgctaagcacctcgtatggtcacacacgcactggtcatcaatacagtagcacaccaatggcatatgcatggttttcaggctgccattatgccatatgggtgtcagtttaagtatactaataaaatgagtcactagacagtgttctgtttaaagtttcagaataaaatccaggctcagtacgtgctcggtgtgttatgagcttctgctctgcaagctttatgtgtcatgtatatgttacagaaataaatgtgagacggctttctgcttaaggtccaattgcacttttgtacttttgaagttcagtcatacaagatcaacagttacacaatacagatttgtcatgttgtttttagacgatgttaactcaagaaactttgtggtggaatcttcagatcgtctgcagagctttgtaacatctcaaccactctagtcatcgaaggccgattgttaggcagtagttgtatgcaccatagaccgatgattatcatcttccttacgagtacagaggtgtcaagtcttatctcattagctgtgacacaatatccctccaaatgttcataaatccattgaggaaaatatttgctgctgacatctgcacttgcactgatattctttcttgctccaaccatctcaaggatcatcatcccataactatagacatcagacttgctgcttgcatctccaaattgctttgaaaatacctctggggcaatgtaacctattgtccctcttgcaccatcaatagagatgatactctctttttgtttgcacaattttgccaatccaaaatcagatatcttaggacaaaaatcttggtctagtagaatattgtggggtttaatgtcaaaatgaacaatacgagtattgcaccctcgatgcaaatattcaagtccccgagcaatcccaattgcaatatcaaacaatttctcccaactaagtgaatcttcagtttcagagtttggtctgaaagcaaatctctccagtgatccattaggcatgaactcataaatcagagccctttttgatccctgaatgttggaattaatgaatgggccttagcccactcgaagattaattctttggaaaatcacaaaagcccacctcatgggatggcatgcatatggagtttagtaccaccttgcttattctaggagagggggacctccttaaaagggaggatgccctcctagtcacttgaagcatgtgtggtggagagaagaggggaaacacgcgcgcgctcgctcgcctcgccgggccgggccgggccggcggcgcgcgtgcacgacgtacgcgtcgaatggtccgaaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcatgcaatatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtctttccgtcatctcggtacgtgttcaatatgttgcgcatatttgatctgttcatgttatactgtgtagtttacatgtgtagatctaatgatgcgtccatgctagttttcatctgtaatgtcatgatttatttatggaatagattaaatcattatatgtctataatctcaacaatccaaaaaccttattgtaggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggagaaatacaaagctcagcagaccaccaacttcaagaagcagaagaagaacaacaacaatcctaatcaggatgagaggacttgctttgtgtgtggccaagttggtcatctggctaggaagtgtccacagcacaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaatttctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgttactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacaccgcgggactgcctaaggcatggtggggggaggcattgttgaccttaaatcatgtgttaaacagagttcctaacagaaataagaacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatggtaccttctttgagagcttttgcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagcgaaatggattccattatcgctaacgggacttgggaggtgacagagcggccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagtagcctcacatggtcttctcgttcatcaaatgaacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaagcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagttaattagaggtgagaatgggattacactcttgcagtcccattatgtggagaagatcttgaatcgctttggctacattgatagtaagccttctccaacaccttatgatcctagcttgttgcttcacaagaacaagagaattgctaggagtcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtaaatagttctaaggataatatgaaatcgtctagacatgtgaaaagacgattgaagtctgtcaggaaattaagaaactccggagttataatgttggattacattcaaacagcgagaaatctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgagggatagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctctatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcgcgctcgctcgcctcgccgggccgggccgggccgggccggcggcgcgcgtgcacgacgtacgcgtcgaatggtccgaaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggctacgcgcagtagagatcgtgcgggcgccctgatcaagcgacccttctctatataaccgacctgccgcttcatgcaatatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtatagtatacatgtgtagatctaatgatgcgttcatgctagttttcatctgtaatgtcatgatttatttatggaatagattaaatcattatatgtctataatctcaacaatacaatatcccaacaaggtgacaacgttaacatgagaagttctgctgatgcttgctacctcattcatgaattcttggccatcatccttgcaagacttcagtaacttcactgcaattggcttgccatttggcatcttgcccatgtaaacagtaccaaagccaccttggccgagcttgtgactaaaagatttggtcattgttttcacttctgagtaagaatatctctttgggtgttgagcttcatgcttttgcaagaaggactcgatgtttggtgcttctttggattttcccatcgaggacaatagaccatgccagaacttcttaacacacaaggtgcacatgagaagcaggaacaataaaattacacctgaaacgactgatacacctacagtaacattttaagacaatgtcatattaccaaggataaagaaatttcaattactctattcctttttcaattgaaaatgcgtggttctggtatatactctctatttttgtgcaaaaccttcatcaaattttttcataaccatttaggtgacatgcaaataacaagggatattccctcgagggattaaaatagtttctccatttattcatagggaaaagaatgtactgtatgttagtggcaatcctactcatgagagtttttttgcttacaattttgtactcgcaatatgtgcaattagttgactaattacactcgtaatgggttcctgtcattaatattttccgttgctagattcagatttccggaaaaatatataggaggcagagttttcatatatttacctattgcaatagcctttttcttcgatatctttgatcctgcaaaatcatgaaacaattttatcaacgaaacaatcagcaagcgacaacattagctaattatttgacaaaaaaaatgtttttgcaggtcataaaaaaatagaatgcatgcatgctcctttaggaaaaaaaagacacaatatcacactaaaagtgcatcatgataccggtcctatttttcatcttcttccttcttttaagacatcttcatcttatggggtgagaaaacaaggaatacaagaaaatggtctacttggtttgccattcaacacgagcttaattatttaaacgttttggtcaaaaaataactaattcagttcatactacctaatcccctagttgtcaattttgataatgcttataggttaacagtcggcatcaacaagagaaaattctataaatttaagtgaagagattaattcaagtaagtctgaattttgtagacttgcagaacgtaagcgaatacttgtcatttgagccatgtcaaatgcacgcaaatcaaaggttgatcaaggccccgtcaaaactagaacatcaccaaaaaattggcacattaatcaaagaaagaaacgaaaatcgccactcactatcctaaacttgtctaagatgaggtcaccagattaaactataggacccaaacatagcagaaacagacatcttgagtcaaacatagttgtcctaatcgaaacaaattaactaaaaaaacaaccttatcaccaaccttgacttgccctcaagtttgttagaagatacaaacggtacctgatgaagaacatgatccgatagcctgaccatcaggacagtaacatgtatactgatcaggaaaactgccattaaacccacaatgccctccagaagccttacaatcactacaccaacctaccccaactttccatctcgccgtgaaaccccctctaatcacatccacaaggctagaatttccggcagccaatgagcctgccatggttgaattgaatggaacaacgaaacttgagctgcatgatcccagaatatctgattccaacgagtcatccttgttcttgtgcagcctatagtaggagcttcccccagaaacgcatgacagaagatcatagataaaaggcagagatgaagacttggcactgcagttgacatagaccgtcaggaactgatcaaggtctgtgtacatgaacctgctctcgtcgatggtggtgttgtgatagcgatccgggcatgtctcctgaggttgagtttgatcgatgaccgcaagaaacttgttgccatagtcgatatctgtaacctggaacacggtggaattcatgtggatcatcagcttgttgtctgggttgcagatgagacggtacccagggtaagagcagtagtttggacggtcgacgccattcgccgagaaggggtaatcgacgtcgagcttgagtgatccgcactggtaagaagctgtggtacaatttgtgtaccggaagaaggcatcggattcttgtacagaaagtggcactgaagagatcagcagtagggtgatgaggagtggcagcgcacacaggggatgcatctgctccaaggcgtggtgatgatgaactgaagagcaacaggaaaggggagaggaggaggaggagctgcttgatgaacaaagataagaggggacaaagaacagctacagtaggtcaagaagggttggctgagtaaacgtggggaacagaaaatcgtgggaggaaattgacctgatgggttgagttaaactaccattgaccatggacctgcgtaaaacttaaacttttcgtaaaaaaattcttagccacaaagaaatgccttaggtaggtagcttgagcacagagcaggacgagcgtcaccgatttcgaccgcgttagtatagtagtattatctactaactgaattttgacctcgtcaagattagcgactttgaacagtatcaacaagactgcacgtcaacgttggttgccgcgctacttctactgctgcccacagttcgtcagagcacccgcaatggtaaagtagggtgctctctataaaacatgtacatctcagcaatagactagattaatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctcagtgtgtttttcttattctgtattttaattaatttcttgtgtttccaaaattaattaatatcagtttaaaaataaaatttgtgtattaatttcgtggggaagacgagttaccgcaggtcgagctgctggcgcggccatcggagcacaggcatcccaggaactcgttcttcgtgccgtagctgcagcgtcccccggatacctcgcactcgtggcacatccccgccgtcgggtcccagctcagctggaacccgcgcttcagcacggcgccgtatccatcgtcgcccaatttgccgtagtacttctcgttcatgagccaatccttgagcacgggcaccatcaccacctccttgcacagccccaaccactccgtctcgcctgccacgtccggctgcgtggcgacgaaagacggcgccgtgtctcgccgccccgggaagtcgaaggtgctgcagttgatcgggcggatgtacggcggcggccgcagcacgacgttggccgtggagttgcagtcgaagaagaaggtgatgctgtcgttgccggggctcgggaacgtgagcacctccgggagggtgacgttgtgcttcaccctcgggcagtcgccgccgtcgagcgcgtcggagtcggccaccgtgacggtgtggttgccgtggttgatctccaggacggtgtagttgtaattcccgagtcgcaggatggcgcggtcgtggtcgcagatgatgcccagccacgggtagccgcagtagcgggtgttcccgtcgacgacgacgacctgatccgtcgtgttggagaggtagaaagggtacttgatctccacctgctcgccgcaaaagatcggcctcgcgcatatggcgtcgtcgtacgttccgccggccgctgtcgcgccctcaccgccggaagcgatgaaccagaagaggaggagaaggtgggaagcatggctaccgagcagagcaagcccgtatcttctcattgtttgctcgaaacgcgtcgataattgtcatactttgccgtgcttagtgcctcggtgctttaatgcttactaatgacgcagaaagttcaaccgaatgttcaagtcaaaggtgtgtactatcgtctccccgcgaaattttttgcttcagaattatcttgaaacagtaacaaacaagacaacatgcgcgagttgataaggtaaatttttttttcgcgaacgcgcataaagattacacgttaatatattaaaaaagaaaagttttttttacacaacgtattcaaccagaccggcttataccagaaaaagggataaaacaaagaaaaaaaaactaaggaagaaaaaatggaaagacaaacacaactccaatcagcgggagtggacaaagccacactacatacactcccaacaaatcgcaaacgaagcaacgccaactaatgaccacagacggccctccaagatgatgaactataaaactactaggacagtaagaccgaagaaagcgtagagtcgaaaaccatatggttccgttaattccacagttgtcaagagaccatgaggactagaaagtcgaagccggcttggagactggagagacggagatactcaggtaagcatgtcctagaagatgctcaggtctgccacgggagagagagggcaacccagctaggagacgacaacacacatagccagacctgtcgaacaaacacgcagtcgaggagggcgtgggataaggtaaagttgctcttcggctgtccatttgcgaacacttgctcagctttgtatagctcggaactggttttacgaactgtttttcgctagtactactaactttacaaatttagcatctcgaaacgttgaaacttgcgattcttgaatccggaagtcagaaaacttgtgcttgaattttgaaaccatatgttatgctaaaaagcccaatatccttcacagcccaagcgcctgcgttgaatttaggcctggaacaaataaggctgcttcctaagatacatacgtttcggcctggcccaaaacatacgagcctggccagctggcctataatagctagcaggccgtcaagggaaacggcccggtcgtttctaagaatacagatgtattaccgaccggagtatatgctaccatgtctgactgtacatatggcgccatatttttcatcaaaaatagtcagtatgtatttacattataagttttaaaattacatatgtaattttattgtacttacaatgtatataccaaaattacacatgtaagtttcaaaattacatatgtaagttttaaaattacatatgtaattgtagtgtaaatatgatgtaattatggtgtaacttactacacgtatctcatccatcggttaaatcagcatgtccctcatcaaacaacacacacggagtcaattgacgaggcaaaagctgtggaagagccgtaaaacgtgcgcggatacaacacatgagcacgaatctacatgccatcctaaggcaaaaaatcgactgcgattggacagaaaatctgtcgccacgattatagcaaatccgctacgaatctacgacggatgcaatgttcacatatacagtatactgttcattgtatggtcagcaggaattgatgtcgcgatgcagaagcagacaagaatcaaagaagtagctagcactaataaaaaaagaatggactagaaacatgttttttctcctggtctgcttcacaagtcaagagacaatcttttcttcttctggcccgtgttgtgatttgtgagggggcttatgtttggcacaaaacgtattttttgggctttttctgtcatcctacctataagaatatctcagagttcaccggacatggaaaagaagaagattcttaattcgttttatcgtttagtttctcttgttcacattgcgcgtacggtagaccatggttcgacttccgccggtaaccgcacggttaccacggtaacctccttaaattcaaataaatttaaaaataatttgaatttttgataaattttacgcggtttcatacggttttttacggttaccgtgcggtaaccgtgcttacggccggggcgcggtaacctcggcccggccggcggtttgggaaacctgcggtagactggacctggattgacctactgcaagtctgcaatcctaggacatctgttcctcttggactggtatttatgatcataggctaagaaaattcagaaagaaggtagcgaacaaaacatctactctctccgtcccatataaaatcaaaccctagcatcccaatacaaaattagtagagagtgaaatgaccaaaatactctttattatttaaaaaaatagtaattgtgacaggtagataaagggtattgaagaaataaaacttttcattttatatactgagagtagttaggatgttagaagttgattttttatgggataaaatttaaatgataataaatgcttaaagtattttttaataataaaacaacttacaacataataaatgataattacgtaattttttaaataagataaatgattaaatgtgtgttaaaaaatcagcagcttcatccgtagaaaacgaaggtgtagaaaacactttccgatatggatatgtctcttttgggatatgttgagtttttatgggacggaggtattatgtcatagtggagtagtatgaaattgcaggatcaatccgttctggaagcagttggtacggcagctaataagttcatgggagcagaccaaataaagagcatctgccattcaaaagacgactgcttaattaagtgctcatcactttcttatacctgggttgtttgtttgtaaagagcattatatttcacatttgacgcggaccggatgtgcggatgcttcctttccatcgcgttaggagcaatcgaaaatcacaaaaaagacaatgagaaagaatctgaaacgagaagcagcatgtttatttgccacgaaaacgacagtagcactgcttccgttcaaaaaaagaaagaaagaaagaaagaaagaaaacgacagtagcagcagcatgcgtccatgcagcctggccgagtccccacccgaccggacgcagacgcacgactcccacgaggtcgtcgttccggtggcgtgccaccagcaaccggatcgaggaagcaggcagcgaaccccaactgcccctaccccaaccaatcccaacacgccacgtacccccaatacctacgcacaccaaccccctcaggtcaaactcgtgctcgtgctgtcgtgcagctcaagaagtccgttttagtataggaccaagctagtagttcgccaacacgatgtcacaaaaaaatttaagcagccggtgtaagctcgcaccgtgcgcagtcgtcgccatgccgccactactcttccacctcctcgtactctccgtcgtcgtcgtcgtcgttagcggtggcgcggccactgccggcggcggaacgtacgacgacgccatatgcgcgaggccgatcttttgcggcgagcaggtggagatcaagtaccctttctacctctccaacaccacggatcaggtcgtcgtcgtcgacgggaacacccgctactgcggctacccgtggctgggcatcatctgcgaccacgaccgcgccatcctgcgactcgggaattacaactacaccgtcctggagatcaaccacggcaaccacaccgtcacggtggccgactccgacgcgctcgacggcggcgactgcccgagggtgaagcacaacgtcaccctcccggaggtgctcacgttcccgagccccggcaacgacagcatcaccttcttcttcgactgcaactccacggccaacgtcgtgctgcggccgccgccgtacatccgcccgatcaactgcagcaccttcgacttcccggggcggcgagacacggcgccgtctttcgtcgccacgcagccggacgtggcaggcgagacggagtggttggggctgtgcaaggaggtggtgatggtgcccgtgctcaaggattggctcatgaacgagaagtactacggcaaattgggcgacgatggatacggcgccgtgctgaagcgcgggttccagctgagctgggacccgacggcggggatgtgccacgagtgcgaggtatccgggggacgctgcagctacggcacgaagaacgagttcctgggatgcctgtgctccgatggccacgtcagcaaaacagactgcggtgagttagtaccctcttgcatacatcaacatatttaattactagtattacctagtattactttcattccgaaataaactaacgtaatacataacatcacatatcgtaattctaagaatttagataagtatttgtttatcaaattcgtaacaatataatatgtcatatctcgtactagattgatttattttgaattgaatgaagtgtgtctatgatatattacgaaagtttgacaagttatttaaaaagtagatagaattaaataggaagaagttatgattggttaagaagtaaagctagttagaaaaagtgaatgatgaatgatgagggttagtaattggttgcgaaaagaatgtaaattataaatgctaggagttataagcgtgatctctctccaacttttaattgcttgttgtcgaaacaaaacatttttttgcgggtaactttgacagtgttgcatgaatgcattgtggcatcccaaaagccaattgctgttcgtataggtgtggtaggcatccccgcacatctttcttgatagaaaatgaaacctggttttgttgatgcgttctgccatgttggtgacggcactgcttgtgccaaccggtatgacggcagcaaagtatctagaaactcctattttcaccccagaattctcgtttatttggcagaggttatttggtactaggaactgtgaaatccctgtgaggtaggggtggagctggctcgtgctcggttcgtttgagatcgttgtcttaactcggctcgttaatgttaatgagctaaaaagctagttcggctcggttcacgagctagctcgttaggctcgttaacgagatatatctcattaataccatattaataattttaaatttaacattttattatgtattaacataataataaacactaactaatataatactctctaaatatgaatagttttgatgtaattaaaagactaaacactagttcatgaagatatgatgatattttatactaacgagctaaacgagcagttcacgagttagcttgttaagctcacgagctaaaaggctagctcgacttgactcattaagactacgagttcgaatcaatccgagccacgagttttgagctttttatccacccctactgtgagcgcaagtgcaccaccatgcctccgagttgaagatcactggtgatcagtagtcacagttggtgggtaacttctcctggaacaagacgaaggttctgacttttgaccatcgcaaaccatcgcaatcttatttgacgtgagccagacgagagtgcgacgtgccagttcacataaagaacaggtaccaagacgcctcaaatctttgacttgtaccaagtgtttgcccgaaatttccttcgggctgagccgccacggaaggagaaaagaaaaaccataacccataaattcctgaaacctgacgccatgatctgtctcatgaattcttctcggccgtcctctcttgacctatatgaaaacaatcaatgagccgtgcagtgacttaatcgccgtcttaagtagtactagtacactcatctggtattgcatttctcgtccatacatctacccaggcaggcagctagctagtatcctcttcctctccccttttcttgttgctcttcatcaccagttcaccacacctttgagaagatgcatcccctatgttcgttgccattactcatcatcatcctactctcatcggtgccaccttctatgcaagaatccggtgcctacttccggtacacaaattgtaccccagcttcttaccagtgtggatcactcaagttcgatgtcgattaccccttctcagcgaatggcgtccaccgtccagactactgctcttacccaggatatcgcctcatctgcagcccagacaacaagctcatgatccacatgaattccaccgcgttccaggttacagatatcgactatggcaacaagtttcttgcggtcatcgatcaaactcaacctcaggaggcatgcctggatcgctatcacaacaccaccatcgacgagagcaagttcatgtacacagaccgtgatcagttcctgacggtctatgtcaactgcagtgccaacttttcctctctgcctcttatctatgatcttgtgtcgtgcgtttctgggggaagctcctactataggttgcacaagaacaaggatgactcgttggaatcagatattctgggatcatgcagctcaactatcgttgttccatgcaactcaaccatggcaggctcattggctgctggaaattctagccttgcggatgtgattagaggaggtttcacggcgagatggaaagttgggctaggttggtgtagtgattgtaaggcttctggagggcattgtgggtttaatggcagttttcctgatcagtatacatgttactgcccttatggtcaagctattggatcatgttcttcatcaggtacccctatgtatcttctaaccaaacttgagggcaagtcaaggttggtgttaaggttgtttttttagttcatttgtttcgattgggacaactatgtttgactcaagatgctctgtttctgctatgtttggtgtcctatagtttaatctggtgacctcatcttagacaagataggatagtgagtggcgattctctttgctttctttgattaatgtgccattttttttggtgatgttctagttttgacggagccttgatcaacctttgatttgtgtgcatttgaaatggcccaaatgacaagtatttgcttacgttctgcaagtctacaaaattcaaagttaccctgaattagtctcttcacttaaatttatagatttttctcttcttgatgtcgactgttacctataactctataagcattatcaaaattggcaactaggggatttggtagtatgaactgaattagtttcttttttaccaaaacgtttaaataattaagttcgtgttgtatggcaaaccaagttgaccattttcatgtattccttgttttctcatcccataagatgcagatgtcttagaagaggggcttttaactatttgccacttttagatttggcaaataattatttgccacccctatctcaataacatgtgggtccacatatgtctatgacatgtgggtccagtggccaaaagttaattgccacatctaaatgtggcaaatggttaaatatctccttagaagaaggaagaagatgaaaaataagaccggtatcatgatgcacttttagtgtgatactgtgacttttttttctaaaggagcatgcatgccttctatttttttatgacttgtaaaaaaaaaatttagtcaaaaagttagctaatgttgtcgcttgctgattgttgcgttgatacaattgtttcatgattttgcaggatcaaagaagtcgaagaaaaaggctattgcaataggtaaatatatgaaaactctgcctcctatatttttttttccggaaatctgaatctaagcaacagaaaatattactgacaggaacccgttattatgagtgtaattagtcaactaattggacatattgcgagtacaaaattgtaagcaacaaactctaataagtaggattgccactaacatatacggagtagtgcatctatttttttttctgtgaaaaatgttcttttctgaacaactttcatccccatttgctactttcagcaacctccatcgcctccggtgttctgttcctgcttctcctcgttgtgtccttcttgtacattcgcaagaggagacagtacaagatgacctcgtcgtcgaggctgctcaagtacaccacctccggcaggacgccgcggtcgaaaggcagcagcgacaagttcgtggagtccggcagcttccactacctgcagacccaccacttcgcctacgaggagctcgaggaggccaccgacggcttcagcgacgcccgcgagctcggcgacggcggcttcggcaccgtctacaaaggtattttcagttccctccgttttaggttacaagttgtcttgagtaaggcccagtttagattctaacttttttctcaaactttcaacttttccatcacatcgaactttcctacacacacaaattttcaacttttccatcacatcgttacaatttattcaaactttcaattttggcgtggaactaaacacaacctaagtttgtataaaaaaataataattttttaacctaacataaatatattataaaaatatattcaattatagatttattaactgaacaaatttggtgttgtaaatattattatatttatctataaaatatagttaaatttagagtagttaaaacgacttataacctggaacggaggatgtagttgatttcgttgggtttttggttgatctggaaatgtgttcaggtgagctccgagatggacgcgtggtggccgtgaagaggctgtacaacaacagctgccggcgagtggagcagttcgtgaacgaggcggcgatactgtcgcggctgcgccacccgaacctcgtgctgttctacgggtgcacgtccagccgcagccgggagctgctgctggtgtacgagttcgtgcccaacggcaccgtcgcggaccacctgcacggccaccgcgcgccggagcgcgccctgacatggccgctccgcctcaacgtcgccgtcgaggccgccgccgcgctggcgtacctccacgccgtcgagccggcgcccatcgtgcaccgcgacgtcaagaccaacaacatcctcctcgacgccaacttccacgtgaaggtcgccgacttcggcctctcccgcctcttcccgcgtgacgccacgcacgtctccaccgcgccgcagggcacgccagggtacgccatgactgacgctctgcctctgctccattgctgtctcgccattaccggtggagatttgctccgttccaataaaaaatatctcgaggtaccagtacctcatggtaccaacgatcgaaaatgatttggtaccttgatgtatcttttattggaccggagcaaatctcttgccggtgacatggtgccatgttcttgatggtgatgcgatcttgtgtttgacgcggcaggtatgtggatccggagtaccaccagtgctaccagctcacggacaagagcgatgtgtacagcttcggcgtggtgctcgtggagctcatctcgtcgaagccggcggtggacgtgacgcgggaccgcgacgagatcaacctggccggcatggcggtcaacaagatccagaggtgccaggtggaccagctggtggacgacgagctcgggtacagctccgacgaggcgacgaggaagacgatgaccatggtcgccgagctcgcgttccggtgcctgcagcacaacggcgagatgcggccgccgatcaaggaggtggccgacgtcctccggggaatccaggacgagtgcagggcggcggagaaaggcggcaagaggggctcgccgtgctcgcccaacaccgtgcacgcgccatgggacagcatgagcacgacgccgaacactagccagtaacctctctgtcgatcgagattcgcttgttttgtaccggacagcgtactgattttttttcctgccggtttgatgtaaattatgttattttatatatctttgaaacagcggaaatgacgaaatgtacatagaaacttctgaagttgtgatagcgtttggcatgagtattgagtaaccagttactgatgattctttttatcctgtaatttgccctgatacaacattgagaaagtatggaataagctcagacttctgacttctgagtggagggtggaccggtggagcttgcaagcttgttagtgtcaactgccaaagctcaaaacatgagcagaggcacgatctgaactaggcccatctcgcgtcgcgcgctggccagtctagccgggcccggggcccagcggctgcgtgaggccttgctgccttggtgagcgagagtggtgcgggccgcggctcgtggctggcccgagcaacgcatgcagcaagcgaggggcgcctccccagccttcaatttagctagagttagagctgtgccaaacggtacatattattcatttttcggagcggagttagtagatgtcagggttatagataccacatacctaacagtagttgactaaatctcggcaggatccaccacataccatgttctatacggaagcaaccttcggatataggaggagttccggataaggaaagacaaccagagttctacatggaaacgacaaggactactcggattgtatccatattggtttccctagttctacttggacaaggggacacctatggacataaatacaagcccccctaggaggacagggggacacccatgaccatgagacgatcaacacccaccatgaagggatcaacacccaacacaatcgacatagaagccataacataaaagcctatatccaccaggacacgccgccggatatcgacttcagggataagcacggctagtaccctacggtgtctccggatactgtcaggagagacgaaagtgctatctctgatctcgccgggcacggattcaaggagtaaggctaccctgttgtcgactacgagtcatatcgtcagaccgccatgtcgacaacagttagatgggctaccccaaatattgtactggtgtgattatcatgaataagagcaataccggcttcgcccaacaggatgtagggttattacctgacaactcaggggcccaaacctgtataaaaatctctgtatccatgtcttttacctcagtctcgcgtatatcctagcaccaataatccccataccatgcaaataccagaattacgacatcaaacgtcaacagtagagctacttcacaaatttgtactacaggggtatagctgggtttttctgctccacagctccactccaccttaaagacccactaccctttaattttttagtctatttacacaaaaatgccattgagctacccttcctatcttctttcctcccgttctctctcctcccccatcctcctcccgaggccggccatggaaggtttcatttgcgtcgttggcagcgagcggcggctgagtcacgtcggcggtggcggctgacggcggcacgcagtggcgacaggccgcgtccgcagcagcgggggcacgcggtggcgagggcagcacgggcgatggcggtggcagtggcgcgcgggcggcggtgtcgacaggctgcggtggtagctcacgggctaaccggcggcggcagctcgcgggctgcccggcggcggcggcggcgtcgacagctggtgggcgtgggctgaccggcggcggcggctcgcgggcggcgaccacgataggttgacgccaacaaggtgttcgatgaaatgctgacgaggaatatggtggcgtggagctgaatagtctagccaagcactttctgtccccacctcagcttctataggagtcagctctcactggagttagagtttagagttgggagttggagtttagatccctaccaaacggggccaaaatcttcattctagcccttgaatgatcgattgataggctcagctcgacccaacgacgcatacacttcattctaggcttctagcaatatatacagccacgcagcggggaggaagcgagagcaagcgagtgacgacgccatatgacatcaagggggttcggtgattaaaatttcgaacccccagagccggacttcattagcaagtgtttactgtagcacaatattgtcaaatcatggcgcaattatgtttaaaagatccgtctcgcaatttacacataatatatgtaattagcttttttctatatttaatactccatatatgtttccaaatatttgacgtgaaaagatgaaaatttttttgtttgagaactaaacatatccttcatatacaacctcaaaagggccgagttatttttttaacgagataggaggggctcggagtttaaaaccccgactctcctttgaccggttttttttttttttttgctttatcccctggtggcgcgcctgacagcgtgcgttcgcgttattgcggcaagttcgtggcgcaaaacctacgcctacgcgtgatacttggtgagtgcacgtacggcttcgctggctcgggagcaggcagcaccgcagcaggcgagcacgtgagcgcctcgtgcccgcacggcgtccgcgttccctcgcgcgcggcaagccacacccgcaccgcacggccgcacgccacgcgcgcgcgcgctgcgagtgcgatggcaatcggcgataagccggtctcgtcgcgttgttccatagattagttttctttccaggctcatccgaacagaagaagctaatcgctaattattggaatctctgaaccgaaacagctaatcatgcagctctctcggtcaatcactcgagcggagatcaacgatttggggggagtgctcacttggagctagcgtacgtgcaaacgtgtccgcgactgcatgcatgattcaggcaagcttcgacttggatcgatctcaagacaggtcatcactcatcaggttgttcaaaatgccggcaaaataaattaaggctgctgcaattctatcatgacaaggactcttcctttttttcccctgaaaagtactgaaacaaatgacgactcggccgaactaattagcatcgcaatcgctgcaaccatggcaatacatagtgcatctgtgtgcatatgggctggttgagtttgatcgatcgatcgactcagctcgatccaacgacgcatgcacttcattctagcttgcgtacatgcagccacctgtatgatctgtatctgtctatgtagctagtgactcaccacttggacagcatgaacctctgcctcccactaccatccgaatatccagtgtgatgaggtgattgttccactcaaatcatatccacgtatatgtccctgtcctttcctttcaccaaaaatcacttatatttgtgcattcgcgatcgatcctactagcttctgccacgatagcacatacacagtcttgcatatgaagagttagctagctactccccgtattttaatgtatgacgtcgttgactttttaaccaacgtttgactattcatcttattcaaattttttatgcaaatacaaaaatagttatgtcatgcttaaataacatttgataataaatcaagtcacaataaaataaataataattacataaattttttaaataagacgaaatgttaaacgtttgttaaaaagtcaacggtgtcatacattaaaatacggagggagtattttaaaagaacatggagaaaaagggctggttatcttaagcttatcttcgtttttctggtcaaggcagctgaggcacatgcttgcattcgtgcatgaatacagcatgcacatgcgtccaccccaatacctaacgaagattattaattaatctgcctctttttgtgtttgtttaaagttatctggtgactggatcccaagttccaactgaaagtcagtcacatttctttttttctaaaaaaaatacaaacgcatatacactcacttgatgaacacacgtgtctacgtcaccaatatattttgagattaatgaagtcataataaatatctcaccgtccgtcgatgtgtacgacgccaatcaattaatgaagtcataataaatatttcgctgtcgatgtgtatgacgccaatcactaaaagaataacgctacgtctaggacttaaatcctaatgaacatgtttattttttttaaaaaaactaactagctgagtattcacaaagtgagtctcgtttttatcagcttgcatgatgattgttgatatgttcatctctccaaattgcacctacatactccctccatactcataaaggaaatcgtttaagacagcgatatggtctacaaaatacaactttgacttcttatttctataaaaatatttattgaaaagtgatatatgtatacttttatgaaagtatttttcaagacaaatctatacatataatttttatattttcaaacttaataacttgagagttattcatgatttatattttcaaggtttggcttaaacattattctaaacgacttcctttataaatatggagggagtaatgcggatcgatgttgttcggatattaatatggtcatacatacatctatctgaaaaacagtatgtatatatgtgtaacttgcataaacagaatactccatgctatatacagtatatgttcaacttcagtcttcagataatgtgattgcgacgcaagggtaagcagactacagaatgcagattaacatatccaggcatgggtggagagcgcgcacgcctcacgccgcctgaatactcaatcattccatcccacaatctgggcgatacataattaaattagtagtatagcggaaagcagatggatacctcgacagcatcctttcggggcatggaagggtcaggcaaccagaaaccagtttgttgcgatctgatgcttcttccattctgggacttgttttatgtttatctctctgaatctgatcaagccctgaaatgtcattgactgcatggtacgtacgtacgcgtcgttggaggtgacagagacctgcaagatcagattatactactactactagattttagtatatattagattataatttgtctcgtctgattaacaatggttttaattaccggaccgatttgctcgatcggtgccacgcgccacacgatttgttttctatgtgcatgcatgaattcgtacggagcccaggcgtaatctcacagttatatatgttaacccaggtggatttcaattgaaagttgcttcaattcaaaagttcaaaacgtgactggaagttattctcgttcagttttaagtttgagctgtcaaacttttagttgcacattgtacacgaatttagggctagttacaagtgtattttgttccattccaaaattacgatttacaaacaagacaaattttgctactggacattaaaaaattgcataatttgctcatagacatcgaaaaaggtgtcatggctaaaagactttaaaaaactgataatttgttagagtacactttcggctcaattgtattgataaattcttaatgatgataagaatgtccctaaagaccacatgctttaaacatgatgttagagtaaaaatttagaaaccacgaaactctaaatttgccatcaccctaagtacatcactagcatacattatattcaatcttagctccagtctcagctcgaagcttttgaccttaggggcattcttgtctttttgaagaattcctctctccaattgagctaaaagtgtccccagcaaattactttttttaaagtgtctttcagccgtgacacgtttttatgatatttaccagtaaattgcacaaattttaagtgttatgtagtaaaatttgcctacaaacaatatatgcttaattttcaagttgggccggaagcgaaagtcattggtgtgtgactgatatacatggtgatgtgtataaatatactcttttgccataaaataaaccaatctaatactagatatgataaatctacaagcgaattataatttgtgccatcttttcatacctactggagtaagttttagtttggaccatatttatctaatatcttcgttttggactatataaatttattttatctttgttaccctttgaactaccctaacgtttttatctagccacatccaatctcttctctaacaaagatgttaactgcacgtcaacagaggatatcatcggtatgatggtgccaatgtgcttgatgctaatgctgtgcttgtgaagatactttgggtggtcaaaacacaaaaatggaaaaaaaaacctaatccaaaataaaaaagattggagaaaaatagataaaggatgatccaatctaaaacttgaggacaaaaacaacaaaaacacaaattcactctaagataatgagaggggctaaagtttaatccctctcgttaccaagcaccacctaaatctttcgtggcatcaagaaaagaattaagagagtgggggcccacaaggccacggtgtccactcgctgttccacctctcatctcattggctacaaatacaagcagcccacagaggcagagagaggagcgcacacagacaagcggaggcgaaaagtggcgcattattttatccgagcgagcgagtcagacgcgcacgcggagcagccgcctccgccgccgccgacgacgaggaggaggatggcgaccccgttggccgacgagggctcgatcgccgccgcggtgatgccgcgctcgccttctccaccggccgccgccgcggggtcggcggccgaggcgccgatgctgatattcgtctacttccacaaggcgatccgcgcggagctggagaggctgcacgccgcggccgtgcgcctcgccacggagcggtccggcgacgtgggggagctcgagaggcggtgccgcttcctcttctccgtctacaggcaccactgcgacgccgaggacgcggtacgtacggggtgaatgccgccgccgcggccgtagcccctctcttactctctcctctctcgcgcgggatcgctgttccggcgttgtttatggtagaattgcggggagtgacaccatgcggtgtgtgttatgcgtgcagaattgggtagtgtgaggctctgggttcggaaatcgtggcattggttggaggatttgggttggatttgtgttgaattgaggtgaaaccaacattatctcaaaatgaatgaagtttgcaggcatggttggttggttgtacaacttagttgtggacacactgttatgttcatgttgatcttctgagatgcatttgcatctacttagccatgtgattgcgaacagtatactgcattgttttttttttatccttttggtgatgtccccatcagtggcctatactgtcttagactgaatatgcaaaagtacatgttaaaatttctgagtcctgaacattatgcaattatgcatcaaagtcacagggtttcatctcggattacatcgttagcttatgttaaccggactagtgtagccaatatgaactgcctactcatgcaaagggtaaattctactctatttaagttccttcagattagtggctgagagtcaggaaccaatgaaggatcccatccattttttattgaagactattccgttccgaacatgaaaagttgaatattgttctgcactgaatgaaaatgaattttgctggagttcacgacagttgctgtggtatttcataggtaaggtagggtattttagttctctttgcatttatgttgtgccagtagtaagcttttcggttctgcactgcaaaactcttctatacataaaggactgcaccagcgtcgtgttgattgtttagaacataacacttactagtttgacttctagctaattctcccccaaacctatagattgatatatttgtgaaacagttccagacctttctcataattcatgatatataactatattgaacgtttggggggcataagatctgtttttttgattgcaggttatctttccagcacttgatattcgagtgaaaaatgtagcaggcacgtattcccttgaacataagggggaaaatgatctgtttgcacacctgttctctctgttaaagcttgatgtgcggaatgatgatggtcttcggagggaactcgcgtcctgtacaggtgcaattcaaacgtttataacccaacatatgtccaaggaagaagagcaggtttccttttcccctgtttactctgttaattcctttgtatgtcatttgtcgaaataagaccaacatgcctttctatttctcatgagcaacaatatgagaggcgctgacatgatgcaatagtctaattgggtgcactagagttctatattagtatattgaaatttatcatatcaagctggcaactgtttgataaaagtatttggaatgatgcttctggatctattttttatttgatatatttaatcttagagataaggggctacataagagaagaatatatagcatctgtagttatgaagagtacagtacaatacagaccatataaagagcaacttcatttctacatttgcttgaaggtgaggccctgtagaaagttatttcttaccaatgttatgcgcttctgcttattggaagtctgctatctatccacttcacaagtacttgcttgctacttggtactcaccatgcaagtagaacgaactatagtgctgactccaattatttatctactctgtgtgtgtgtgtgtgtgtgtgtgtgtgtgtgtgtgtgtgtgtgtgtgtgtgtgtgtgtgtttgtcaaggctttgtaatccagaagccaactgcagaatgcttgagcatatataggctggcatttttttatgctcaccaatttctgtgttctatatatgacacggagctatcttgttatgtgtcttcacttgcatttactgttcaaaactcggctttaagcagtataaggacattgagcttgcattgtatataagctttgattaaagtgtttttaagttttgatagcctagagaactaaatgataagctaaactataaagatcaacattggccgatgatagtttctcaaatgctgcagcaattaatttagaccatgtacttgatgacaattcctcatgcactttttaaaatcatacgtatattattaatcagtatattggtatattatgtgtcctctatcattatcagttcctctcagcatagggcatacagctatacactgttggtgtctaatcatttctgaatgtttcaggtcttcccactgctcattaagaagttttcacatgaagagcaagctgatttagtctggcaattcttatgcagcatccctgtcaatatgatggcagagttccttccatggcttgctacttctgtttcatctgatgagcaccaagatattcttaactgcttacataaaatagttccggacgagaaacttctccaacaggtctcgtgttgatgcatcgttttctatcaataatgttgccatgctttacttaactatagtttcgaaatttgtgaaggttgtatttgcgtggattggaggggaagcagtgaaaacaatatcacatgatttttgtagtccttgttcaaaaagcaatgttagatgcaaggatgctattgatcaaacagacaagtatggatgctcacatgagcactttaaaactggaaagagaaagcgtgcagaatctagttatagtcagcttgttatgcatccaatagatgagattttgtgttggcacaatgctatccgaaaagaattgagcgatatagtagaagaaacaagaaggatccaacaatctggggacttctcggatatatcagactttaatgtgaaacttcaatttattgcggatgtgtgcatcttccacaggtatgtggctctgaatctcaactcatgcgccactttgtttcaaaagcttgcatgtaaacactttcttattcaatgtgcaacataagaattgattagctcttgtttctatcatgttaaacacatttacttcttcagttgtacattacacagcttagaagaacatgagcaatcgagatactgggaagcacaataaatgtgtggtaccagttccctgctataacatattctttgttttatgtggctaatagtagagcttacatcttctttttcaaaagaactggaatttctagaattgtggcacaaatattgattttgccaagcatagtggcctagccgattttatatgttgatctgcagtattgcagaggatcaggttatatttccagcagtcaacgatcaagtgtcctttgagcaggagcacgctgaagaagaacggcggtttaataaatttagatgtttaattgaacaaatccaaataacaggagccagatcaacagcagtggatttttactctgagctatgttcacaagctgatcagataatggagaaaatcgagaggcacttcaaaaatgaggaaacaaaggttagtattttagacataaactctgtagttaaggaggaatgttgtctacttgggtcacgtgaccaatgtagtctaacatgtaattcatctaaatatccaggtacttcctcaagctaggattcatttttcatcagagaaacaaagggaacttttatataagagtctctgtgtcataccgttgaagttattggagcgtgttttaccgtggtttgtatcgaagctgaatgatcaggatgcagaagcttttcttcagaatatgtttttggcaggttattttccaagtttactattttcttctttaaaacaccagttttttttttccaaaaaaaaaaaattctcaacattttactgtttactaatatgttgaactgaacagcaccttcctctgaagctgcattggtcactcttctctctggttgggcatgcaaaggtcgctcaaagggcacctctaactctggaaaattcatatgcttgacaccaagggcactgagcagcccattggatgaaaatgggtttaaagactgccagttatgtccatgttctttacaatcagatatttgttctaggccagccaagaaatggaatgacacagaatctagtaacataagcaactgctcacaaacggctgatatagcattgacatgtaaaaacagaccttgtcacattcctgggttaagggtagaaattagcaatcttgctgtcaattcgtttgcttctgcagagtccttccgatcgctgtctctcaattattctgctccttcattgtattcaagtcttttttcatgggagacagatgcagccttttctggcccagataacatttcaaggccaattgacacaatattcaaatttcataaggcaattcgcaaagatttggagttcttagatgtggaatctagaaagctcatagatggggatgaatcttcccttcgccaattcatcggaaggtttcgtttactgtggggtctttatagagcacacagcaatgctgaagatgaaattgtatttcctgctcttgaatcgaaagagacactgcacaatgtcagccactcatatactcttgaccacaagcaggaagaagaattatttaaagatatatccactattctttttgagctttcacaattgcatgctgatttgaagcatcctcttggtggtgctgatgcagttggagcgaaccacattcatccatataataggatcgattggtccaaaaagaataatgaacttttgacaaagcttcaaggaatgtgcaagtctatccgggttactctgtctaatcatgtccatagagaagaacttgaattgtggccactatttgataaacatttttctgtagaggagcaggataagattgtaggccgtataattggaagtacaggagctgaggttctgcagtcaatgttaccctgggttacatcagcgcttagtctagatgaacagaacaatatgctggacacatggaggcaagtaactaagaatacaatgtttgatgaatggctaaatgaatggtggaagagatcacctacttcttctggcccttcaagcgatgcctcccatccagaaggtctgctcaattaatttccatcccatctcccctcttcaaccacttccaccatattttagtttgctatgttatgtaggcactcactgttttccatttcataaaattgtgtcaaagctatatccttttccccattgaagaaacttctatcgaggcccacttgttatatattgtgttagataaaggtgttatcccttacaatggttatcaacaaataagattggccttctaatgagcaacatataaacttcatacattggttagtttctgtgttatctgaataaaaattatcactaattggacaaatgtagttggccaaaaggaaattcgggaaatgttcaaaagcaaagaagctgtaaaattatatccatgtatttgttgatatgtgataagtgataacaccatgacaacgaggacttcccaattgatgactaatttcaactgtcctagctagcgatagtgcaaatctattatgatgtaaatttgtgataaaagagatttagtgaagttggacttagcataaaggaaggtagaatggtgttagaagagagaaaagtagtgggtctgggatgtatatttatgataaaagattaagcactacagttttcatgatcagattttgaattatcttaactcttgttctttgctttggcctgtagaagatcatttccaggaaaagttcgatcagagtgaacagatgtttaagcctggttggaaggacatcttccgaatgaaccagagtgagcttgaggctgagatacgaaaggtttctcgtgattctactcttgacccaaggaggaaggcttatctaatccaaaatctcatgaccaggtttcttatatgaaattttcagaaaacaattttaggatcttttcctactgttcctccactacaatataggaagttattttgaatgactattgttttgctaattatattttttcagccgctggatagctgctcagcagaaatcgccccaacctcagtcagaagatcgcaatggatgtacagtattacctggatgttgtccttcataccgagatccagagaatcagatttttggctgtgagcattacaaaaggaaatgcaaacttgttgctgcatgctgcaataaactgttcacatgcaggttttgtcatgataaagttagtgaccatacaatggaaaggtaaactcagtgcaaccatgttgtctatttttttgagatttactgccaatgatacttctgtattggtcgcagtagtaatgtgttcaatattcatttttaaacaccaaacaacagacatcaataagcatgcagtggttaaagatttaactacagttagagaaccttgtgataaatttatatctgtgcaaaacagtgaggcagaatgattattttaggcatgacttgtggcctttgtattgtccctttcgttcttctcttcatctgttgttttcctcccaagtaaatgtttggttgaaatgatgcgatggcccaaaaagttgtccaatatgaacttttccgtctttagttttttaatcgctgtatttgcatgataggtgtatacagagttttaagaacatgtgagagaggataggaggcagaaactctcctgttttctatcatattatgtgttggttgttatagctttgttataatataaaatgctaaatgatattgctaagtctggggagctgatatgtcaggaaagcaacggtggaaatgatgtgcatgcaatgcctgaaagttcaaccagttggtccaaattgccagaccccttcttgcaatgggctatccatggcaaagtattattgcagcgtatgcaagttttttgacgatgaaaggtaaaaaaaaaaaaaggacgtggttgctagttttgctaactcgggagattgatggggtccaactttgcaatgttttggtgaccacgctaatagtgaatcttttttcaggagtgtgtaccattgccccttttgcaatttgtgtcgtcttgggcaaggattgggtattgattttttccattgcatgaagtgcaactgttgcctgggcatgaaattgatagagcataaatgtcgagaaaagatgctagagatgaattgcccaatctgctgcgacttcctatttacatcgagtgcagcagttaaaggtctaccttgtggccatttcatgcattcagcttgctttcaggtacaataatctagtcgcattctgatgcatggtttcttgagcgatatctcttactgtgagtagtgctgttctgacaagtttgtaaatttcaggcgtacacctgtagtcactacacctgcccaatctgctctaaatccttgggagatatgacagtaagctacaccacttaaataacattttttttcattcaccatagattatattttctccaactccatatttttaccatacacagaacagcttgtaaaaaattccgttcttctgattcagtagtgcagttaatgtatgttctttaaatcgcgtttctctgcaggtatactttggcatgcttgatggcttgctggccgcagaagagcttcctgaggaataccgggaccggtgccaggtaaattattctcctattcctagttaaaaaaatttcagtggctggggtataccgtttgatatgattgattgttccaggatatactttgtaacgattgtgaaagaaaaggaaggtctcggttccattggctgtatcacaaatgcggcttctgcggttcatataacactagagttatcaagattgatagagctgattgttcaacatcagattaaccaggcgagattttccctctcatattcgaaattccttttgaatatatatattgttgtaaatatacatcaacttaaagaaatccatgcgtcatgcgtgctcttgtgtgttgctgcgattaacaagtcataggagatgctaatggtgggcgcttatgaaattgtgtcacagtctaaggtgcgcacaatctctagtttaatattcggggatgtttggtaaattggtagagctttcagcttccggggccaaattctttagagaatcaagagaagcccaaccaaatgggcacaaagggtgttagttcccaggggattggtggcatgtggggcaacaaaattgttggtacccaaatatggaagtgaccactgaggctcctttgaaatgcagggatggtaaaacatgaatagaaaaaaatagactgcaacaaatgaaaagtacatgaatgattatttggctagagcttgaaaaggaatgggataagagagatggatgcaaaggaaattttgtaagagatttaacttgtgctaactctcctctaaaatctctatgggcctcatcgtttggcatattcatatgcttatcagccaaaatttgaattttcaacgttaaatttagagctgattttagggttttttcatcgaagtttatttttcagcctttgcttttagatcgctaagaacacatatataaaagttttattcacaaattgattttcgtttgtaaatatgccatttggcatattcagaaaatatgccaaccgatgcggctgtatgcatctttgttatcaattctaaagaaatttcatgggtgtcaactgtcaatcctttgttccagagtaaaaaaaaacaacaacaaatcatttagaattcaatcgctgcataaacatgaacagctgggatagattccttgtgcgcaaaccttcccacttggttaaaactaaagtcgcgtacggcaacgagccgatccgcatcggcccagccggtcttggaccccccaccgccgtggcacgggcaatcagcacgcgatcaccgattggatgcattggcatcagccgccactggatcgcgttagcgcgcggtgggcacccactgcccagcccatcatgcatcatcgcatctggccgccaggcacggccgcacggtacgtacaggccgcctttgtcatcttcacgtgtaagcgtcgcgtcgcgtggcgcctagcctggcgcctcagtgatcgccccctcacggcctcactcggtcactcccggtcaacccccacggcaatctcatccctcgcctttgtcaccgcacgcaacgcacacggcaaaaatgaccaaacttgtaacatataatttcaccatattgctacgaaatcatcatcatcacgtcacaaacgcctcaacatatccatcccgatctcggccaccagctcttggagcagatcccgttcgatctgggcaccaatctcaaacgcctcgtgcaggacatccacgccgatctccacccccgagtgctggacgtcgctcgcgatcagctcatccacctccttcccggccatgccgctgcacctcgcgatctccctgtccacctgagcagccagcctctcctcggggcagatcaggggaaccctcgagaacgacctgtatcctgagtcgcagaactgggtgaacagcgagtccaagcactccatgacggaatcgaacgcgaggcttcccagcgggctcctgctcttctccccttctgtggccttgacgacgccggcgttgaagctgaacccgttcttcttcttcttcttcttcttcgtggagcttgtggtggtcacggtggtcagagcagactcgaatgtcttgacaaggaacgccttgaatggtgcctttgatgtccgtggaggagtagtagaagtagaccggcgaacgtttgttagtagcagctcaacagttgctgcaacctctccagggtgtatcaggttgctgctgtcttggccaaaattagtttcagagcacctggagtttcttttgttagttccatcttgttgcattgtgcaattctccgagcggcgtcggtctctgaatccagcttctgatgctggcagtggttggaaaagcatgaaagggtcagcatgcaactaaaaaaactgtgacttaactatacgatttttttgtgtttatagtgttttgtcacaagagatcgtagtaacaaactacttgtaaacaacctaaccaacaattagtcaatgcacttaaacaaaggtcccttacctgcagttttgagcaggctcccagaaaagcactcatcatctgcataataagatggatcgctagcatttgtagtaacctgcagatgatgacagccaaagatattcatcagagaagaatgacccttgcagttttgatgagaattaactcggtattgcaccatgatagagaacaggaaaaaccaaaattactgacctcatgctttttatgagtttcacgcaatttaccacttctaggaacctctctgaagccaaaagtcagactgtccagaaagttacactgccatagaaattcatcacttggagattcttccattacattgatagcactcgtctttcgaaacaatgaagacattactctgtcgtccagaatttctctgtttctcaactcatttcgattaaagcacactgattctgcactttccagacttgatatgccttgtaaagcttcactcaagaccaattccctttctgaagaaatattttggcagtccctacgatagtctctcttaggacaagaaccagttggagatcccagaacaacactatctgatcctttagtatgaccattcagcaaagcgaggacagcctttctcggtgaattagaagagatggaaatgatgcctgagttgttacccctagaagcaatgcgtgactctacctttctccgcgagtcattccttacagagtttggactggtagactttggcttctcactaactaaccctgcaccttttgcaattatcatgtctttctctgtagctttcagtgttgcagtctttgatatctgtttattagaacaatcaccatgcaggccactggttcggtgacattttgtgctcaagttcctgttctccgcactaccatgtggcatgccgattttatcctttacttttcctttggacctcaaagatgcactgttgttcatacctctgtttgaacagacaaagtcattggctgtgtttgccacattttgctccttagctctatgtttctgcctttggaccatatgccctgtatctgctgctctataagtttcaggcaatgcattctgcttcagattgttctgtttaagaggtctacaatcaacattctctcgggatatgtttttcggctgtattttttggacaccttgacttgaaacaaggacatcatctgatgttctctgaccactgtccttaaatccgttcctctgacccttatggtttccttcagattgtgcttgacatgatatgttctggtttggcctcctaacagaaacattcctcatagtatcctcttcggaccactgattggaagtagaattgtgcagagaggtggctcctacattttgagcacctgaccttgatgcatcaacatcacacatttctcttgcgaattgatcggagaaatcgtgcatggcttcagcagcactctgcacatcactgctgttgcatctatactcgaggcgcgcttgcctccgagcctgatggtggtgcctggattgtaaaccgggttccaggaccttgactgctgcttcaatcagcctaaccttgttcctgcttgaaactgatcttggactcttaataggtgaggctaacttgtgtgctgcatgcttccgtgaccacaccggctgcgcatctgcatcgagctgattgccattgtcatgccggccatctctgatatgccctggcttttgttgcttctgatgcgagttgtatatgcttccataggagcattcactccggtgaccaccaagctcggaggcatccatggtttttactgccttttgatggctggtggctggcattgcgctgagccccattagcctggctaccacacccggtgtgcacatttcactgcttttgttgtcttggccaggaggtggcaagcgagtggtaacttcatttggatagtatggagcatcaagctgaaggaaaatagtacaaggtgagccagcaacttagcattctaaaaataaataacaaaggtgaaaaggaggtaaaaagggatcaagaaatgttaatgtaaagctaaagctaaagtgttaaaaactccatttctgaaaaggcaccggaaaaactttcctaggtcaagaaagctaagaaatctgaatgtaaagctaattgtttaactgatttttttaacaagagaaaaaaaagaggcttcatagcacaaaatattggcttaaaggggaagaaaaaagagagcttttttgggcatattctttggaaaattcaactagatctcataaagaatcaacaaacaattgtagctttacaacgagatgctaaaagaaaaggagaaaagtaccataccagcagagtcctcatcttggccgccggcgtcttctcgccgccggcaggtggtctcccaggcgagaacttctgtgtgcgcactgaaacagaaatggcagtacaatccattcagaaaaaaaccagaaatggttcaaaagccaattgaacacatctgatttgcacaatccaggaagaagaataataagaagaagaagcctgaacagtgtactactaccatccttgcaatctcacctgggggaagcagcttggtcttcttggaggacgaggagaagagcttcttcttggcgagcatctggaacagcgacgccacgcacgacgtcgccggcttctgccgctcgacgatcgccaggctgttgccgccgccgccgctcgccgcggtggcggagctgccgcctttcatgcctccaccgctccacacgcacacgcccacaagaacaagaaattcaaactcaaaaatctttcaaagcctcttcttgcttcccctctctctatctctctctctctctcttgccgtttcttatgagcgaataaatgcaacaaatcctggaaaaccagtcgcttcaactctttctccggataggcattaattgccacatcaaattcttcatgactttgcgacaatgcctttgcagcaacaacagctcgagaaagaactatggcttatggccaaatgctagagaacaaaaaggagaagactactgtggcagcagcactccaactcttgctcaagacatgactaatgcatgccattattcctcttcctacacatagaaccggaatggatcaacactcatcctgaatgttcttgtatctactcctgtttgtgaactcttctaaaaaatgaaatgctataataaaccttgagaagaaaatatttggggatgaatctagagcaagtgggcgatgactggatgagccaaatggtggagttggagactggggaggagggggtccgggagaaaaagagaggggcttttgggtggcaatcggagaggaagagacatctcaagctgcttttgtttcttttttttttatgtgtatgtcatgggtagctggctggctggctgtgccaggttttctcggctttctttgctgatctctccttttttgtttgcttccttggccgtctagctgtacttttagggttcttcttggagtttgcactttggagtttggactggtctaatcggaagtgattagtattagtactcctgtaaaaaaaagataatgtaaattttagagacgaacctagataatttatctttagaagttactccctccattaaaaaaaaaagtaaatctagtactggatgtgacatattttgtataatggatttggacatatgtatgtccagatttgttgtattaggatgtgtcacatctagtacattggttttttataggattgagggagtagctttttctaatacagagggagtatcctcgataccgtttcatatgaatcttccaagtatttttttagaaatatgaaaaaaaaatccatatctcacaacggcccctaaaagtctaagatgaacgagtaaagaaactatacattttttgtggaaaaattctgcttggagtagttgcccactttcatttcctagctgtcattgttggtatgtttgattgtatacggctgaggctaagtagattctaagcaagaaaaagggaaataatgttgctgtcttgttggatggtaacagtagttgcacgaccagattgtaacattctacttaccaaaacaaggcaatctctgtatagtacttaattagaatcaccgtgtctattatctagcactcccagattcaggctttgtactgacagagctggtgtatctaccttttggttgatgtttagttgtggggtcaaagcaaagagaagcaaggttgttgcatacgggcagctcaagtaaactgaagtagaaagtctagtatactttgtactccctccattcaaaaaaccttaattcctgggtttccgtgtctaacatttgaccgtccgtcttatttaaaaaaattataaaaaaattaaaaagataagtcatacataaagtattatttatgttttatcatctaacaataataaaaatactaattataaaaaaatcatataagacggacggtcaaatgttggatatgaaaacccaagaattgagtctttttggacggagggagtactgctgattaggacaaggtgacatttggacagtttcacagtattgttttctccttctgtccgtcagtttgaaatggatggtactcctaatctacatatatgacccagacaagtgttacacttttcaaatgcgcctagtgtttcgtaatggcagatttagtacgatatcttgagactctagcgtcaaattgtacaagacaacaaagaagaagctgacattttttagttatgagacggctgaacttgagtgctgagcccactagtatacttgtaaatcaaatctgcaagtggacaaatacaaaagatttcaagaccagttagtcaaatgcaaccgtatcaataaatttttaagtcttatggaaggacattcttgggtatatcgttgactgctagagctattcttggacattcttggagtaagtagcaaagattagctcctaaattgccattcagttcatcaaagcgtaaaccgcactccggaaggaggaaacactatctcacgtgattcgagaaatttccactcggctataaaaaaaatcgtggcttattcaataaacctgataaaagttggcttattgtactgtgacacggtattaacaaattattattcaataaacctgataaaagattgcaagagcatatgatgatattcatgtcaattaccacctagttgttgatcgttggtaaatttagttcatgttctttcttatgttgttttcgacatcgatacaatctataatacatatgtttgattattattattttcctaattacatatttgcaaaaataataaaacatttataaccttgtggaagtggttttcatgataaatctattaacatcctttttacatattaaattttaatattttaaatgtataactccctcaattctataatataaggtataaccatttttttcaggtgttttgtaatataagacgtgcatgtatgccttcaattaattaacacatcttctccagttccactatattattattatttttaaatccttcaccctcaagatatctaattctattagatgcatgcattatatttattaggatgatccaaactagaagatgataataattgtttattgatttttaggttaagggtagttgtgtcttatattttaaaatgggggagtaatggtttattaagaatctaaggtttgacttcacgggttgcatcatcatctactccctccgtcctaaaaaaagacaaaccccggtttccgtgtccaacgtttgaccgtccgtcttatttgaaaaaaatatgaaaaaaattaaaaagataaatcacgcataaagtattaatcatgttttatcatataaaaacaatgaaaatactaattataaaaaaattcatattagacggatagtcaaacgttggcacgagaacccacggtttgtcttttttttttttggacggagggagtaactaataacacgtcatatttcagtttgactaatatgcctgctggaaaggctaagctctcccacggccccacccgtccagttccaggctctcagagatcactcatcctaacagcaaaattgaatcaactgtactatctcgggatatacctaccgggagatgtatatcccagcctctctcggatccttatcccagttgcagcaaagcgtacaaaaagagtaccacgtaccattaagtactccacagtggaatgaggcaaacaaacagcctggccaaacagaggacctccaacactcgccatggtcccagagcaccaacactcctcctttacaggcccaccttcagtctgacctgcagatacgagcaaactgttcctctgtgccatatccatggaccatccaaaggtacgcggtagttctgcaaaaagaaatgctactggagtagtagtaaaagtaaaaaccactaagactattttttctcaaatatatctcatattaatatttacctattcaaaaccacatcattacaagtacttttatactacgcgatgtgccattttctacacactggacactattggacccacgtgcaagcatgtacccctgaaaatcaatcatatctacgaaactggacacacgtgcgttcagattcatagctagaaattcttttttttttatagagtagtatttttctatcacccaaaataccccgctacgtatcttgtctctcacctcattgatatgtgagccttacatgtcatcccaactcaatcatctcctacagtaaggtagcggcatcctcattggatgacacactcatggcgagatacatgctcccttgcagatggaagacagacgggaatggacacaagacgggcgagaatggtgaggtccgccaccactagcgtaacatgtttcctcgggcaactaccgcacgacaagtgcgatggtgacttcgtcagcctgttccccgctacggctctcatcgctcggactcacttgatgttggctcgctcaccgtctacctcatgccatgatggtcatggatctatcgccgtggttgtctccctcgacgttggtttgtccatcgtcccgtttcccgttgctcttgctctgcctctccaacgtggatctatttgtaaaatatttttttttgaaaatggccaaaatataagtatttttttatataaatagatctttggtgccaaagtagttggcgtcgaggaactatttataaggaaaaaatatttatatgttggctcttttttaaaaaaaatatttacaaataggatctcgttgtcaatctttttttgcgctgacccctctatattttgtttgctggggatgtaagggtgttggtgctagtgtcgttgtgtcgttggtttagagacgttgaactttaacaacaacataaaaaaaagggtatattcttaaaataagtttatctatggatccatttataaaataagttttgaaaaggggccataatataaaaaatctaggccgttttggcgacgaggaaaaaagacgtgttttgagttgcgaattttgtatgtgatcaggaagcagaattattgcttttgtacttgcagaaattcattttttgcagaaaaaaaatggagttgtggccggtcagcttaaattggatgggcacttgtcttgaaggcgatagtacgcgatacggttggctttattgtccgcgctgcgttgaattgacactactgactcgcatgtttaggcattgaagtgactgaaaactagggatagttagagcatgtataataacagactattagcaagctataaacatattttaataatataagcgatgagagagaagagcagcggtctacagatctatagccaactgcagcacggactccaaaacacaatgtgtgtatgataggtgagaccatatattaatagtatagtaagtggctattgtatgaattagctattagattagttataaataaattaaaaccggtagtaagactatactattaaacttgctcttagtgcacattcctttaccgctgcaagagtttctctgtcacccttcgtactcctgtgcgtagattgtgctcaagtgtccattgtccgcaatctgcatgcaaagtcctgtccaaatttctccgataaacagaaagttcattttaacccctcaattattcgttctgtctgagacacaccctcaaactctaaactaggtagaccatactcttatcaaggaatgtgttcttttctcttgaagataaagataaatatgaagattaaggctgctttcgttctaccttcttcccaactccctctatcttgttttccgtgcgcacgtttcccaaattgctaaattgtgttttttttttgcaaaaagtttatatataaaagttattttaaaaaaattcatactaatctatttttttaaaaaatattaaatattaaattaatcatgagaaaatgtgtcgcttcgttttccgtgcggaggggaggggttcccccaataaacacaacctaagtattttatgtaaaatgaggcggattaacatataattaattgagttttaattattccaatacagttccgttgaccccactctcctctctctggtttttttcttaagttatgctgatgtggtgatttaatcaagcaaaaaataaataattggacccacatatgagctgctaacctgccatctatctcccaccctatctctctttcccttcatttttttcttcgtgagatgagcttgacgctagcaaagagtcgtggaaccatggtccccactgtaccaagagtgctcggcactaacgtgaagggttgagaccattattcacggtggtgcattggacatggtcggatggcttaaaatgtaatatgaaaatgtgatattataaaagttagtcaacatagcagaataacgattaaactttccgattgctttggtcattaatcattcaagacatgccaaatgatgacacagaggcacacgatatttcttaacgaagttcagtcgaaacctacaccttcgaagctttgattatgaacgtttctccccaaccaacatagcacctagccactacgagtacttagtatcgctaccatcttatctcagcgtgtctgcagtatattgtagtcgtcatggttgtattactctaacttcacttcctatcacttattataactttgaatttacttattatgtataactgccttgtactctcaaaaccggacggaaagaaagcactatttcactgaactagatacccttaacggcaacaagcaacagcatgtgcacacacgaaacgacctgcccgtgcgatggaaaaaaaataaacaaaagaaaacaagcaaagaaaattaaggatcgtacgaatgcagttgagtcagttgacacctgcccggacgaccggacgcctacgccacagggcagccacttgtgctttgcattgcttcgcaatatcgcatccatccaacggtgtcaggcagcagcagcagccgcaccggcgagaaattccgccagtgtcggtgggcgcttttggcccccggaccaacaccaactgatgatgatcaggtcaaagcttagccaagaatgagatgattggctctgctgccggcaccgccatggacaagagaaacgtaagagcaagtttaattaatagtacggcctactactagctccaaatcatttatagccaatataatagccaatttatacaatagttacttactacattattaatatctggtctcacctgtcatacacacataatgttttggagtccgtgctgcagctgactacagatttatagcccgctgctcttatctttcttcctttatctctttaaaactctaagtcgaagtagaccccggtcgccgttcccaaaaaatcaggctctgttttgaaagagggtctttttcataataattggcacacacacctgcaaagtgcgagtgatctgggcgtgcacccgtttcggaggtgtggatttggttgcgagatggtgaccggacaaccgagggagtgtggttgtggtccagtgaaatgaaaaactgacaaagtgacatggatggtaatggtatgcggctcaagtggcagaattgctaagggaagcttctggcccaaggtccaaaatgctgggctatagttttgggtgttctatggcccgttttctaacaaaaagaacactgatgttcaggacacatttagtggaatatgtccactctgactccctcaaatatagctccaatctgattcatacagttgaactgtaaaaccggatatctgactcatcatgaaagaaaaaggaaagaataaagaatgagagaagaagaaaatgtgacattgatatgtgggtcccacatgcttagttggactattttttctaattaagaaatcaattttaatccgattttcgttagcattatttttaaactgctagatggtttttttttgtgtgaaatctctttatatatgttactttataaatccagttttcaagtttaaaacaatcgtgcgctaatagcttttgttttttacgtgttccgactttatcttcatcttgagtgaacttaagctgggctcaatcacgagacgaatccctagccctaatcactatcatatatagtagtactccacttaagtaagtacatactccttcctcagattcacattttattccaaaatagttgttatattggagtactaattgtcttatcaatcactttcaattcaaatctctctcttttctactgtcaaccgcgctcatatatccaaccatacagtatttaatagatgatactatactattttccctcaaactttaatctatgccaattaacctagaacgataagtaatatgggagggagtactacagaattttgaaggcataaaagctctcacagcccccctggattcttggcagaatctgccacccctggaactctaccgaacagcaccatagcttgacattgatggttgatgcagctccactaaaaaatccacggactcgcgtgttttttttttattttgaacgaatcgaccaggccgtcaatctattatattattaaattaatagaaaaaggagcctccacgttcgctctcatggcctaaaaattctcacattaatcggagaaaaacaagcagagtccatataaaaatacaatttagaaatagctgaaattcggaattaaaaataaggaatattagaagaggagactagagtccatatagaaattttcggaattaaaaataagtaatattagaagaggagactagagtccatatagaaatataatttagaaatagctgaaatccggaattaaaaataagaaatattagaagaggagactagagtccatatagaaattttcggaattaaaaataaggaatattagaagaggagactagagtccatatagaaatacaattaggaaataactaaaattcggaattaaaaataaggaatactagaaaaaatgcccgtgcgttgcaacgggtgaaatctattttaattttattatttttatatggtttagttaagataaaattcattgttggagttcgcttggatatatatatttttagaaaatcatgagctgcagttaggagtccgaccgtctcaagttggcatgcgagtttttttaaacatacttcttatatgatttcttctgtattaccaaaagtgaacgatattaaaaaccgactcaggatatgtatttcgaaaagcaaatgaatttaaaaaacgactcatacacggatgacgtaacataataccggcaaaaacatatttaatttttataatagtagagatggaaaatttgggtgatacggatacgatcgatctgagaaaaattattggaagcgatctggagacggagtcggacaaaaaaaaagggctattggtgcgatctgagaaagaaaaaaaccgtgcgctattgggagtcagacaaaaaaattgtgcgctaaaaaaacaaaaaaaccgtgcgctattggggagtcagacaaaaaaattgtgcgctaaaaaaacaaaaaaaccgtgcgctattggggagtcagacaaaaaaattgtgcgctaaaaaaacaaaaaaaccgtgcgctatttccaattgggggcgacgcacgaatttttttttggggagacaagaaaaaaccgtgcgctaaaaaaaccgtgcgaaaaaaagaatacgctatttccaattggggacgatgtacgcaattttttttgacaaaaacaccttgaatttttataataggctagaaaaaagtacttgtacgttgcaaaaggttgaagcaattttaatcttaaatattactcacagtctacaagatatcctacttaaaaaaggaagctcgagattgatcaaggagctggccattatttgcctgatgaaaataggagctttgctatgattttgcatccatgtaaaacctatacacatcatgcgttgataacagccagttaggtagttcagtattgatgtttataatctcatcgttgtcccttgaaccagactgaaacggattacggattctatgtatgcatggtgcggtcgacataggaaggtccggcccgtcttagctcacgtcgtctaccgcagcagtaaagaccgtgcgagatacggaagaaggaaataaatcaggctatgcggattttcttcgcgcagagacgacgtccgattgacgacgtactaaaatttgagacaaaaacaccttaaatttttataatagtagagattagaagtagattatagggtccatatagaaatacaatcaggaaataataaaaattcagaattaaaaataaggaatattagaagtagagtatagagtccatataggaatttaaaactaactaaaattcggaataaacataataaaattaaaagtagagtttagagtccgtataaaaatataatttacaaataactaaaattcgaaattaagaaaaacatgggaataagagtttaaagtcaatatatgaatacaatttagaagtaactgaaattaaaaattaaaaattaaagaatattgaaagatgagtttagagtccacatagaactacaattagaaataataaaaaataatattggaagaagagcatagagtctatatagaaatacaatttacagaaaattcagaattaaaaaaagaaatattaaaagacgagtctagagtctatataggaatatatataatttacaaataactaaaatttgatattaaaaataattaataactaacacctatataaaatgcaatatgaatattacacattagtaatttcgtaaagttattgcaaaatttaaaattatgttgtcatacataatatatttgaataatataatgagaaaacatatatgttattatataagagaaaatacaatgatgttagcggcgcaatctgcgcgggccatcatgctagtttcattgaatagaggagacgaaaactgtaaaaaaggataaagtacagaaaacaaaaaaaacctagggccgtggccctaactataggcggcgagatttttttgcacccgctaacccccatgtttttgcttcctcctttatctttatcttggctagcaaagttagcaccagcaactccttgtgttggaaagtcctccggttcctttcgttccatatctcccagttgacaagcaaggctaacatgcgtagtgccttcttaggtgcttctcgtatgcttacggtggcctcccaccactcatgtaccgtcaaaaatatttgccagttagaaggtcttagatgttcatagtctgtccactgcgcgatttcattccagattctccttgtgtatctgcattccgcaagcaagtggagagctgtctcttgagtctggcgacataaagggcatgtggatccgttgggccagcctctggttgctagtctgtctgatgtccacactctgttttggagtatcagccaggcaaaggtcttgcacttgcatggtgcccaaggcctccatatcaatgtgtcaaaatttgacgatgttgtacccaacagctgcgccttataggctgaggtggctgtgtattcgccgtggttgttgagcttccaggtgatctggtcttcatgttccgtgaagtgtacattccgaacggcgctccaaatagtgatgagctcgtcaatcagatccgttgtccatccttcgtttgttggtagagcaaggtcgtgcagccattggtatgctaaagcggcatgtttgagggacctgctctttttcctagaggccgcgtggactagcggtgcgacatccttcaatcttctcccttggactcacgtgttggggatcagagaacttcgggtgtgtttagtttatatcaaaattggaagtttggttgaaattgaaacgatgtgatggaaaaattggaagtttgtgtgtagaaaagttttcatgtaatgaaaaagttgaaagttttaaaaaatattttggaactaaacacggcgtccatgttgagttgagctccgtttcgtttccttctcacagctcgggggcagccgcagcgcgtgtgatgctgatgccacgcaacggcgcgaacacagccaaagccaagccgcgtagccgcttgattaacagtgcagtgcaggcaaggggtaaaaatcgagaaaattgacatttagccattctcagggtggggtttcgccagaatgccatcgccaaatgtggcttcgttataatgccatcttcaaacgaccccatcttgccatactgccatttcaaccaattttgattatttgcaaatattttccactgttttgcttatttggtttgacccaaatgcccttgcctcagccgtggggcccacttgccaggagcgtcttccacctccgtccgccaccatccttccctctctccggtgaactcatgccccaaattgacctccctcctcggttgctctcgccccaaattaaatgcaaaaatcggttcctctcgtcctcctcatcaattcccccaacaaatcccactcaaatcggcttaactcagtggtggattttgaagtccctcttcaatggcgagctccaccatagccagcgtcgatctctctccccgacgaggttggagcgggcaagcggctggacgccgtggagtggagctggctacggctgcacgcgcgagcaggttgcctcgacgaggagctccgccgcgagtcgctgcccacgtcgaggagctcatcggagaaggaagtgacgccgtggcgcgcggtcaggtcgagcgcttggtgcgccacgccgccgagccgaaccgtcgtcctcgtccacgccgacgccttccccgttcccagtcgcgccgccgtgccgccttccccgttcccggtcaccatcgccaccgccggaaacctacgcgcgaacccggtgagctacgccgtcgagctggtgagggcgccgaagggcggcgtcggtgccatccccggcgtggccagctttctcatcccgtagcggttcagcgaaggtcctgagctgcgccggcgccgcccaccatctgcaacgaagagagcaagaggtaggagaagagagatgagataggatccaagggtattttggtcatctcaacaagaaaaaatcattaaactgagaagaaatggatgaaatgacattgtaacatgttgcccctgtttgagggtgacattttaacgaaaccacttttgggagtgtcattccagcgaaaccccgttttgacagtggcaaaatgtcaattttctcgtaaaaatcaccaaaattatcgatatttggttacgagcttggtggctcgacgacgtttgaaagcgaggcgatgcgatggcgtccgcgtctcgtttctttctttgggcccagcttggccacgtacgtcgtacgtatcgcgacgtacgacacagtgcagccgcaaaaaggcctccgcatcggcagggcccaagtgtaaaacgtgctttcggtgcgccatcatacggcacgcggtacggtacaaacagcgaattccatgtaccgaagtaatttgctgttgtatagcttggacaatttgttaggatttaccaggtactacctccatattttaatatatggcgccgttgacttttttccaacgtttgactattcgtcttatttaaaaaaattatgtaattatcatttttttactgtgactcatcatccaatattctttaagcatgacataaatattttcatatttgcaccaaaattttaaataaaacgaatggtcaaacgttagtcgaaaagtcaacggcgtcgtacattaaaatacggagagagtacgtaatttgttagaccggatagatttatatcattggaaaaaaaaaggagatgtgttaagatggcactccaagtggtgcttcaggtggcttaaaaaaagctactactcaccagcggctaaatcatattttcactggtggccaaaggtaagtgaaaatagagtattttcacaagcaaggattagccacttgcaaaaatatattttcggaaagtctaaaaaactgtcgacacatttttctttagaaatatgtcgatttctgatccattagatcaactgtaggattcgtgctattttggttgacgaaaataaaattgtactgtaaagaatcgaacctaggatctgacttgtccagcggccctgaccaactgatcgagcaaagattttggcttgaattgaaattacatactaattacacttaaattacatactatttacatatgtaatttagaaacttacattgtaaatacactaaaattacatatgtaatttagagacttacatatgtaattttaggacttacattataaatacactaaaattatatatgtaatttatggacttacaatataaatacatactgactattttttggtaaaaaatatagcgccataaatatagctactccctatattttttactgacaggtatctaaaaagcaacatttgccaaaatcaatattaacagacgaaatgcttaacccacctgcgacacaaaatatttttggcacgaaaaaaaatcagcaaatcctccaaaatcccctaccacccataatccattcaccaatcacaacttccatcacaaacctcataatccattcaacaaattcattaacaaactttataatccatttacaaattacaaattcatcacaaagagtgatcagagagaggatctcggaaaaattcattgccgaaaatcagtagaagagggaggaaggtgttcaaattttgctttttcacaattaagcacacgagcaggttttttttgacaactttattgactgcctgccaagagagtagtatacaaactgtctattctttttgaaggaatggaaatatggaatgatgtatgaatacgcacgcttcttaggctcttaaacgatgttttttataattttttttatataaatgaattcttatgaaaatgttttaaatctaattttcaactttgtaatatttaatttattcatcccactcaaatattccaaatcattcatcaatttaaccacattggaaaaaaatgaataggggccaatttggccaagaatcaaaaaacaaagtgaaggcatgcaaaaaagttgaccggcatatatcggccgtccgatctgcgatgaacggttgctaagccgacctcgagccgtcagacccacattagggcgctctctgcagtttgaatcgcatggacgctcctattattccggggtgggcctggatgcagcctcaaaagcctgcgttggtcgtgcaggccgagcaaactgccacttacaagcgggcccatctcccccttcccggccaggcctgcacgtatctcttcctcctgccattcacgtaccggcttaaccctgacacgtgggcccgacaacatcgtgccacaaagtacacatcctgattcccttttaatggggcataatgttgcgtttaaactcgatcgatcgatcgatcgaccatgtatataactatatgtgtacggactcgagtatacattcatgcatgtacatgtgcgtttttgtacgatgtgacagtgagcgaaaggccggtctgatcgttcggcctatagcagcaactaaaattaatttatatgtaaacattttatatctacgtacttaattgcttaattgcctatagtaccagtctgtattatattataagatgttttgattttctcctaagtaaaaaagacaataccaccaacattttgaacccaaaataaacatattatcaaaatatatttaatattagatttagtgaaactaatttgtattatagatgttattaatttttttataaacttaatcataactaaaatggtttgattagaaaagatgtcaaagcgtattataagtatgaaactgagggaataacgttgaaaatcaacaaataatgataacagatttaaagtaagtttaaaattaagttttaaaatttaatactattttttttgtggctgataagttaaaaggcaaaacatggaggcgtctcttgacctaggatgtcaacaaagacaaataatagcatcgctagatagcagtgctggaagtaggcaccaatagctcgatgattgcatcagaaagagcgatgctaaaggctttccctaatccctttcttttcgagcggcctatgctaactaataatgtacataacgcaaagctaatttcgctccacttgaaatgctacagtctgcaatgatagcgttgctcgcctttgatatttgatgatactactactactgctgctactgtgtgttgtgccgtgtcgaccccagtggaggagagtgaggggtccaaagaatccaaaaaatgcccggcccatcagcctaattctctcgttttatttttcttttctgaaaaaaaagagcctaaatacgtcacgtaatcccctctctctctctctccccggatatttttatccattgggtagcccccaagaaaaagcatggacccggaccagaacccgcaaaacccagccacgtaagcagccacagcagcacgggcacagccagagctgaagaagaactgatcgataacgagagcgacacagatcgatgagaagaagtacaggtactaggatgaattagcagatggattacaacaagcacaccgctgtacaaaaaaaaaacaaaaagaagagaaaagaaaacaacatatgctgaagcgaagaagaagaaggaagaagaaaaaaaaaactgaagttgagacatgacaaaagcacgagcacctaccggctcgacgcgacagagtagtcctagcagttataaatccgggcgcggctcgatcttgagccgcgatgtggtggtgaggtgaggtaggtggggtcttcaaagtttggaggatcttggcggcggcggcggccgccgccgtcgtgccggagcaagcggcggctactcgtccggcactcggtacgcgtcggcggtgacctccgtcagccacaacccagggaacagcgactgcacatgaaacagtagcaaccactgtgagtttgagtttggattgcaggagtgccattcttgcacacaacaatttaggtttaataaaatattaagtctaagcatacgcttaaagctgtattgtatcgagggaataaataagaggagggctaattgggtgattaattaaataatggtggtttgggagggggagggggaggggtagtgtggggaattcgccttacatcgagctgccgctgtacgacgcgcggccgcttcctcggccgccgccgcggccgtgagccggtcagcgcgtagatgtcctcctcgatctcctccggcgtgagcgccaccgagaacggcgcgcgcttccggcgccgcgacgacgacggcaccggcaccgccgccgccgccgcccacgacatggaggcggctgggcgccgccgcgtccgctgccgaaggttccacggcctcgctgcaccgtcggcttgcggctgcgccatggggagaagtggaggcggaggcggaggcggaggcggcgccttgagctcgggctccgagtccgcctccgcgggtaggctctcgggcttcgtcgtcgtcgtcggcggcggcggcggcggaggcggcgggggtggggggctaggctggggcacgcggagacggtcggcggcgtctcgtaggtggcccatgagcttaacccggagctcctcgatcccaccgtcgaagggatccttgccgacgacgacctgcacggcggcggc

SEQ ID NO: 62034 - DNA, 1295 bp, Oryza sativa
  unsure (1)..(1295): unsure at all n locations
tcgtataacctcgcgctgagagcgaagcggaatcgaaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactannattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatt

SEQ ID NO: 62035 - DNA, 2254 bp, Oryza sativa
tttgagaatacatgctctagtgggccgaatttgtaatggcctgatagttcaagctggaattctgcggtggaatagatatgggcccgttttatttgtttcgtacgtcgaactgaaaacagacaaaggcacaaagctttgtcacaaatcattttcttctcactcatgaatcgttttgaactttgaagaagcaacatataaattctcttgtgaacttttgcctacaaatcatcctgacaatccaacaaaaaatggcgaacaaaaatagccttcaacttcgattaaaatatgcgctcacaaagatttcaaaattatcactcagagactacgtacagtacttaataatgattggtacttgataaggcgacaaaagaaagtataatcaaatcacaaacatatcatatacatagacccataaactagcatagttcatggtcccaaaagcacaagagtgctccggtgctcccccacaaactcctccggcccatgtggcctgattcggggggttacaatgtaacaacaaaagttacaagacaccacctccctgctgttctacaatataatccttaaattgccttgccaaattttaaaccaaggctacaacaatgcagaaaaaaaaaatgcccaactccatgataacttatttatgtctactggacctatgggagaaagcaaaggcctaagcgggtgctaattaataagcagcctcagaatagccaaagcctcttctcttttactatagcaaagaggctccctcctcctccacctcaatctcaatctcacactgacatttctgcagaaaagtgaactgaaaaacggaattagccgagtactcgatcagaactggccgccctcgaaggtctggccgaactgccagccggccggcacgacgttgttgctggtgacggtgcggccgtcgctgacggcgacctggaaggagaggctctggccgtcgaggtaggagttgctctgccagttctggccccagttgcgggacatgggctgccacccggtgctggaccccttgatcgacacggactgcacgtcgcctgggccggccacgttggtcacaagaaccaggttgaagtaggagtgcccgttgatggtgaacctgatcccgcccttcttcacgcacggcaccctgcaacacaccagcaaaaaaaaaaagcaaagttcagtgaaacagtagaattaactgtaatttgttactatttgttgcaacgattaatcatatggatgtgaaatgggatgcgtaaagtaattccgggacagcgaagtcaagtccacgtcggtgtcaatcgtgcgtgcatggctttgcctacagccgacacggacagatcgtggacaaaccaaatctgccgggtggcccacctacacatggcctgatcagccgattggggatcggcccatcgaagccgacacaccgcacggggggcccatggcttcaagttgcaaacagtttgccactcactcgtgacccattgacccaagtagagctcaccttctgtaggagacgggcacgatgccggcgcggtacacgccgatctggaggaaggccggctcggccatgtcgaagtgggggcgcggcgggttgcaccagccgccgtcgtcgttggggagcgcgtagttcggcgggcacaggttggtggcggtgacggtgacgctgcccggcaggcaccactgcccatcgttgtcgcaccgcagctcgtagcacgacccgcacgccgcgccgtcgttgaacagcaccgtgctcagcgccgccgtgttggtgccgtacccggtgctgtacaggttcccatacccacacgccccgccttttcatgtacacaaacaacacgacacgagtcagattactcccggttttgtcaatgcgtccaaaagaaaaaaaaacaaagtgttacgaggagcagtgcacacgtacccatcgtgccggacgcatcgccgccgccgtagaacgtggcgtgggcgctctgccaggagccgtagtcggcggcggctcgccgggcgaggaagcagaaggccgagaagaggaggagcagggcactactgcgtgaggccattgttgcaaaacagggagaagatcacactaccaacaatgtcctgctagctacttcactcggcttaagctaggatcgaatcgatggttgcttggttgtgaagagagcggtgctcccgggctcaggtacttataggcgactcctccttggcagttagaatcgttgatagcttttgcccaacgacagaggagagaaccgga

SEQ ID NO: 62036 - DNA, 521 bp, Oryza sativa
aatggtccaatggggagttcaagaatgctgttggtgagatactatttgagctgactgatgaaccaaacccgttcatttccctggaactcttgtactcaccgggtcacctgcgtcttcctgatgttggtcgacacgcaagatgcattgaccatcccaagactgtttctttcagggaccagattttggttgctctggttctgctcgttttcttctacctcttctggagataattgtacccaggtttgctcattaatcatgccctcctttgtcaaggcaacgaagccgtgaggtcaagtgtcctagaaggcttatttttacagcttttcttggacttagcttcctgtacttcttcattaatcgtgggggagagcaccgcacgggtggcggtgatgacaggtagtttgagtttttgcctctgtggtttcaaattcagattttgttgctgttaaacaatacgtgatagagtggatatccaacttgaagaaaatgatactgggtggattttgatttgttgattgagg

SEQ ID NO: 62037 - DNA, 597 bp, Oryza sativa
cgcctccggcaccgtaatctcgtcaagctcgtcggtaagctctactacttttctgaacattcaaatcttagctcgatattgtttatgtttttgttcgatgcatgatagtatctttttgtgatttagtgattaagaatagctgagtaggacattgatgccgccctgatgaactgctaatttcgtgatgaaatatttcctcaagaacatcaccttaataaatgccaacccaaatcgccagattatcttttgatttgatttgatttgaaatattttcgcttttattgaaatggatgctccgataagtttagactttgtactttgtacttgttattagaccgcgtagatgttgtctactcgtgccaatttttaactgttacattctcagcaacaatttccttcgtacggttgcgtgaaaatgaaagcttccgagttccgagccgtcggaaatttcagtagccgtctgagaatagacaaaagtaagcaatttttcatacccacaatcacatgaaaacgatacaccacgacaacgattactgcctttatctcaagaaaagtagcagataaaattctaagataattacacacaacagatgtact

SEQ ID NO: 62038 - DNA, 681 bp, Oryza sativa
attcctgcagcccgtttgactcgacgggatagatagatatcagtagatattagagcagttacaatagcagctataaaccggctataaccacatatcgagaaaaaaaagtgaagagagagaataaagcgggctacatatttatagccagttacaacacagactccgaaacgttatgtgtgtatgagaggtgggaccgggtataaatagtgtagtacattttatagtaaactattatatgaatagtctattagattagctatagatgatttggagccagtagttgactatattattaaacttgctattaggaacagtggttctaaatttccaactctccttcggtcattttcagttttgtgttcgtctgatgcaacttgtttttgtccaagtgcgtgcttgatcttcgcttcgtcgactattcgacctctctatacactatacagccacgaccttaatgccgacagcagcgaattaattagggagccaattgcctcgctgactgttcatgcacaagtcaccgagaaacagtggcatgaattggattgtctgacaagttcaaatgacgggatttgttctggaacccaagaatcatttcaattttaaatcggctgacttccttcattgccagggaagcaatttggtttcgactggaagaccagatcaccagatgcaatgcacgcg

SEQ ID NO: 62039 - DNA, 699 bp, Oryza sativa
cctgcagccccaaataatttgatgtaatttctctccagcattctcttataatttgacaaatactttactactagtagttggtttctttttttcaaaacagtttcttgtcttgcagcagatggcatatcaagtaaaaaaattgaatatcacaagtaaaaatacatatatacctgacaacaggatgctctgatatgacagtagcatcggggacattagccgtcttccggagaaaatgggccaggggctgcccgtatgtgtgggggaacgcgtggctgatcacatgagcgcctgcaggatcagcagcaattgcagcgtcaccatactccactctcacagtggtgccctgatttacatggagtgaagaaattcagagcgtgaattcacaaaatcattcatccaccaccaatcacacgcacgcgagaaaatcattcgcaaaattatcatgaattcatccgatccagccaccagtcaaacagcataactaaacaggagaaagtcttacgatttgatagcgattcatgggtcaccacaaaagtaaacaacacaacacaggaccgtgaaagctagtccaaaaagaaaagtccatggttgctgtagacgaatcaatccatctactgtttattccaagttgctacgctccactactaaactcataaataaaacagcaacacgacaataccaacacggcaaaacgagctt

SEQ ID NO: 62040 - DNA, 1222 bp, Oryza sativa
aattgtacagtgctaatggagacttaactaacggcgatggtaaatcatagaagttaaacaaaaagtgatgatatattatggaattaaacaaagtcagtggcagattgttgaactagactaaagtcagtggtgtatagtagattctctctacaatcccgttgaatttctgagaaaaaaaatgtttcgctccaaataaagccgggctccttatggtttgtggagatgatccgctctctgtttaagcatcttcgtacaatgaagagggattagaacccaattgaaaacatgatcaaacatcaattgacgggtgattgatcaattcaattccaagagtccaaacagataattcgagtgctgagctataattgcaaacatacttttccgatgtgcagacgataattaagtcacactgtgcactcaaactgtactccctccatttaaaaaaacgaatctattattatatgacaccacataatacaacagatttaaacaaatatatattacatatattattaggttgattttttttagagttaattgtatattggaccactaatatttaccttggttgcacattggactagaggtaaatctatcttttcacattgggcctgctaaatctacaatagttatatattgaaccggtattcttctccaactctcttctccgttgagttgaattgtacccaatttgtaaagtctccatacctgtcatctagctcaaggtcgctaccacaaatgagcaaggctctgggagaccaggaccttgagtgagctgctgccggctggcgatcaagcccctgccctacgctgcatcaagctcgaccttgcactggagctacattgagcgttgcctcgtactcgagctcactattggcggtgagcagaccatccagatcgcgccaccaatctagcttgacctcctccgatccctgcctgcgcactggagctcaagtttgagctcgaccttcgtcagctctggccactcggtcgatctcgctcgcacccatccctgcatcaagctcaaccctcctggtcctgcaatctctcaagctaaacctccatccacaagctgttgcaagggagaagttgatggtgagtagctacgattaggttgagtaagcgttgcctgagctccttcgtagatatccgtcccaaaaagactcaattcttgggtttccgtgttcaatgtttgaccgtccgtcttatgggctgcaggaat

SEQ ID NO: 62041 - DNA, 78089 bp, Oryza sativa
tgccattgttaccgttgttcccaccgttaccattgttcggagtcgatgccgacgcgccaccattgccgccgccgccggcggcgagcgcagcgggcaccaggagggcgacggcgaggaggaggaggagagcccatcttgctggccccgccattgctgcgtggatgctggtgtgtgctctgcgctgctctgctgggtgctgcgtggctttgccgatttatagtgcaggatttgcaatacccgcatgcacgatgaagctgagaccggtcaggggattgactctgctgcactcacatgtccaattgcagcatgttcccgtcgccggcaggaatggaaagccacctttgcttggcttcatggcgattagattagaacagctaatcgccaccataattgtgctcttttgatttatggatatgtctggattgtgttttgtctctgagtttctgaaactaagctgctggatgcgtggacagagcaggcacagaagagaataacaaagaatgttcagagcagtgtttgtctgaattttgctgttcttccttgttcatcgatgttggttttacagtgatcttactgctcttgtaaaaaatcgaaattttcacaatgacgactgaaacgaccacgtacatacttgcatgcgttccgttgaaatactcgcataagaacttagttatatcatgagatcgatcgcttcatcgctggtacatgtcttattcaagagaggaaaatcttcagcacgctgtgcatcacgtgcaggctacgaattcacgtcatgccatagaatgttcatatatgcagttgccatcttgttcagtctgcttctgctgtttataactgttcagcagttgacatgattagtaaaatcccttttcttttctgcagccaaaagcccagatattgggcaagcaaactgaagccatggtgtctagccatatagggatggtccagatggcctctatgaatcactcttttatgttggtccaaatggcatagcttcgaggttgctcaagaaccatcaggcaatctgacagatcagattcagtcattcagagatggatgaatcggtggcgcgaagtgcgacagatcagccaattaggggaagcctcgttggcgtgcacgcgtgctcgttgaatttgagcggaaagatagtatagtactcctaccttcatttgtaatcagaacagttttcaaaaacctgcacaagatgcatgcatgcttcagaatgaattcaaaatctgacagatcacttgtttgtaaatcgttgtgacaagcatctggtacaacatgtcttcacttggttgaatattgtcatagatggattggtgatttggtggtagagatacaagataaaagcagagaacacggacgaaatggcaggattttgttggattagaagtgcattgcagtgccagtgcatatggccagatcatagagggtttaactacaaacatgaaacatctatggttgagtcaataaaaacatgcattgatcatgagagattactggtggatgttcagttcttttgtttactgtgcactgagaggctgattctaggaagttcatactaacagatatataccaccagtccaccacataaagcgtatgttattggtgagttgacgacctcactggaatcaatgcggggattttttcatatatttttaccaattgtcacaagtcaaaaatatatgagcaaatgggaataaatacttggagaacagcataaggttgtagtggtaattaaccatacacaacttgatagatgtgagttgaatacgcagcatagactgcagtggtgattaaccatacacaacttgacagaccaaggtggtttttttctctatcggtgatgccacttgtttcttgacatgtcattcaaagctatggaaaaaaattaagaaaattaagggcccgttcagattatagccaaaataaaccttaccaaatttcggcaagatgacaatattgctaaaaaccatcttgctaaaatttgggcaggatttcttatgtatttaccaaatttggcaaaaaattaaacgtagacatttttttgataaatttaccaaaaaatggtatggttgaaaatggcatcaaagtgagcaggccctaacatgggaaaatttatagcacatggttaaatttatacttgttggcatatcacatgttggtctactctataaatttttcaataactagtataatgtccgtgcgttgcaatgactttttttaattgtttaatattttatcattatgctaattttgctatcattttataaagatgaaaatttcataatattctattgtcatattttcatgtcgacatgatctatagcatgtggaggctaagagacaagcaacttacaattcatgggtctcgcatggtagttgcctggtggtggtgaccaccactgccatcttttatattagtatagacaattaagatgagaaaaaaaataattgaagagacgttctctcttgcaggacaaatgtctttcctttcacagataagtattgaatacgcactatagaccgtgtaaaatatccgcgaaaaacatgactgttctctagcagtggtattctcttttgatttaacgataaaattatctatatttatattactttaaaagatagtagttggtacttgtgtaacacatgtcggtacttgtgtatatgtcactaaaaattaactatggtatttatttctttttgttttttatgatgaataatcttgtttcaaccaagtagaatccattttttttaacaaggacttcaattatttgctattttgaataatctgttgcaacagttatttgacaagtaagttgtaactcacgcaaacctaacatgttaacactgcatactacagttgacttatgtatcaaatcgtcgcatttgtcttgatcctaaatttgtccaccaatatttccaaaaagttccaagaaatataattaaagtgaaagctcctaccaaattttgatatagcaaacaagattcctgctctaaatgttaaactcgaaattaggtaaggaaaaaaaaaacaagactagaagtattatttccaaagaactcttatgttcaccctgtttgactctcaaaaagcacaacgtagcataccacccaacccagcaacacatactagagtcagccagccactcagcccaactacagcaactgcatgtgggccctacctccctccaacccgtatggaccccacctgtcagcgacggaaagtctcactttagcatcgttagcttccacgacaagcataaccccacgcccaatcagagcgcgcctctcgaaatcgcatagctatttgcgcgaaaaagcaatttcttattaaagagagggaaaaaaaaaggaaaaatctaaaccccccctctagcctagtcccaccactaggactcaacgagaaggggggcaggtgtccgaagcggatcacggcggcgggagagagatccggtggcccgatccatggctgcggcggcggtggcgcgccgcgtcgtcttggtgctcgtcctcgccgccgcctccctcgccgcggcgccgcgcggggcggccgctcgctcgctcggcggcagggagggccccggggaggtgcgacgccgacgccgccgtcgacctcaacgccaccaacttcgacgccttcctcaaggcctcgctggagccctgggccgtcgtcgagttcttcgcccatgggttcgactctcgcctttgactcgtttttttctccccgattcgtgactgaggcgttagttgtagtacttggtagaatcgataagtggatgagaatcgtggtagtccgatggcgtgagatgcgactgcggggtttcgtcgtcttccccgatgtatggtttatagaatcgaaatgatttactcgtttcgtcgtctgtgagcaagtgaatgccaatataatccacaatttttggggtttcaagcatgtagggttgtgtaggtgttgcaaggtctgattggtgggatggatgcgtgttgttttttttttttttgaacgaatcggcaagctgccaatttcattgaatagagaaggagtaaggatgcgtgttgttcaaaactcgatgagagtaaccaataaatgcttcgctcgtactaccttgaaatgtcatgtgaggatgcgaccctgggagtgttgtccgtgttgtagtactgtgacctgtgaagttgtgagctagaagaaaggtgcagacatgaatgagccccgaagcttggaaatttgttatatgtaggactaaatcggatgtaggccagcagttaattatggaaaatcagtggagcatttactgtaatgatgaaagaggaattgactgggttgtaagtttatcactatatagtttctcagtgttgccacttactcagagtattgcttcgatgcgatatttcttgtgtgatttggggtgtgcggaactttctcaaaagcataagtacggtcatttttgctctatgtaagttccactgttccccacattgggctataaatgccatgccgtttaattctaatttgcagagatcatctctttttgaaattttagcttcatgagattgagttatatttaaatgcttcttttggatgttaacaggaaaaataatacacttatatgagcattgatactgtacctcacatgatttaatggaacttgacgatttgattaatacacatggacctgtttatggggaatcaaggacttgaatgattagcatccttttgttatccttttcactctaatgtccatgttctggtcttccaaatattccatgtcaagttattttgatattatattccattggttaatcattataagtcgtcactattcagaataggttagtccatatgcattagatatgaactatgaagtggcgtatagtttctccagagcctcaagttttcacttactcgagataattttaattggaatgaacttctattggtcatatcggtattcttttttttttcttttgaggctgcctagatggcatttgttttattgttgaattgatgctaattgaaatacgtaccgtgtttgctcaggtgtccagcttgcagaaactacaaggtatgaagcttattgtggtagctgtgtacttaatttaaaaaacagtggtgcacagtgtatttatgaacagcaaattgactcttgctaaattcctttcttacatccagcctcattatgagaagggtgcaaaactattcaatggtcggacgctgcacatccagggttaatactgatggctagggttgattgtgcatcaaaggtatagtagctctggtgaagagtgataactttcgtcagtctcctaaatgtagacaactaaagcacttacaaaagggattaggtttgatggaatggtccagttaaatccttaactggatgatgagattatccacaggagtatatcttcaatcctttgatatctatttttcgttaccaaactgaaagctatattgcaatgaagctttggcacctcttattttgactgattttagcttccatgttttgtcaaaatgtccaataatttggtaatttcaatggagtaatactttatttcttttgattgtttgacagcacaggtgaacatcgatctttgcaatagattctcagttgaccattaccctttcctactttggggtccaccaacaaaatttgcttctgctaagtgggatcccaagcaagagaataatgaaataaagttaattgatgatggaagaacagcagaacgtttactgaagtggataaataatcagatgaaaaggcaagttattatcctagtctttcctgctctacctaaaagttcagtagatatggaaacaggagctacctgtactatgctcatgcctctctctattgactgttacctttttggtttgtttgaccattataggcatgttggtattttattgatgcattgtttatttatggtatctgcagctctttcagtttagaagacaaaaagtacgagaatgaaaatatgcttccaaagaatgcttcggatcctgagcaggttcaattatcagatatttctttgaaacaatttgcttgagatactgctatgtgcactatgtttcaattttctttaacgtttgttgacttaattcgatcttttgttttagattgttcaagcaatttacgatgttgaggaagcaacagctcaagcgttacagataattttggagcgcaaggtgagttaacgatgaaatttcacagcagatgtgatgtttgctcttctttttctgactatggcctaataatgttacttgcaaactgtagacgatcaaaccaaagaatcgtgattcgctcatcagatttttacaaattttggtggctcgtcacccatccaagaggtacgagtgaacctttaaattcctagtagagaaaatgcatataactttctttgtgcatttggttgattctttaggtgccgaaggggatctgctgagctacttattaacttcgatgatcactggtcatcgaatctgtcgttaagttcacaagagggttctaaattgttggaaagtgttgcggaagagaaccactggatctgtggaaaagaggtgccacgtggatattgggtatgttgtctaatgctaggcctagcggttggcaatgaattcttcattaggcattcttttatactaaactagaaaatgcaacttcatatgaatcattcttaattttgattttgagatattctcattaaatgttgcagtaaatccgttatatgaatgatagcattaggagcaagcaacatcttgtatcttttgacatagtttacttcaacagcagcattatttgcatgtagcttctttagtactgagttaatctagtttcattgcagacagaggatccttaaccactgtagaatgtttagtcgacacacgtgatccacatattttagatcccacagcccatatttatttacatatcttgatcttatcacaagtaatatctgtacctagcaatagttattcccttgaattttctcttcttatttctgtgtgccaatgttgcagctgttctgccgcggcagtaaaagtgaaacaagaggatttaggtgacgcctctctctctctgcaaatgcttcgaacatatatctttacagcacctttactgaaaggccataggagttgataaactataacacacatacatctttttttattgtatcagctgtggtctatgggttttgatgcattcactaaccgtccgaattggggatggagagagccagtcaacctttacatcaatatgtgattttattcacaacttcttcatctgtgaggaatgccgcaagcacttttatgaaatgtgttcaaggtttggaaaactaactttgtgttgtaccatcattcaaaaaatatatctacgacatgcctgactgtagccatttacctgtagcgtgtcagcccccttcagaactgctcgtgagctcagtctctggttatggagcacacataacaaagtcaatatgagattgatgaaagaagaaaaggatatgggaactggtgatcccttgtttccgaaggttacctggcctccaaatcagctctgcccatcttgctaccgctcaagcaaggtcaccgatggagctgtggactggaacgaggatgcagtgtatcaattcttggttaactactatggaaagaagcttgtatcatcctacaaggagacctacatggagtctcttcagcaacaagagaagaagatagtttcagaggattcatcgatttctaatgctgcaagcgtcccaattggagctgccctgggtgttgcgattgccagctgtacatttggggcgctggcttgcttctggagggcccagcagaagaacagaaagtactcacaccatttacgctctttaaagaaaatatgattaggaaaaaacattttaggttggtagggtaccattgttaccgcgtgactacgtggaatttcatatcacagagaagtgattaggttctatttgtcaatttttttacaggcaaagaaagaactggaactgaaaaatagcctaccagttgctcaccctgcacttcatcagaggggctcatcaatgaatgtgtatttttctggacggattaaaatcttggtaagtgctccaaacagtgtgggaaaggaaatggtcgggcagtcagttacagatgaaaaactcacagaagtacgatgattaactcaagtgtattttttgtgcaacgatgtgagctttgttgcatcatgtcatagatcaacgtgtaatagtttgacatatagatttcggatgattggtgtatacgttcggatgttactatccatttaacgagtgaaattttgaattcagttcgtagctttctactaacctttatcgttctcagatatttacctgcaattaaatgctttgtgatcgatttatgaagtggagtactagtactactgacgccaaactgtttcacggcccgttgcgtcagcgcctcagcgagtgagcatctgtccgtcgcggcaccgggatagctaattagcggcagccgtggtgtcaaaacacacctcttttaaaagaataactttaatctaaaaaaaaatttgcatgggaaacttttatctgaaaactttggcctcaaaactttaatttcagtttgtagttaagcaatgcaaacctgaacttaagcaagcattggcaacggcgaaagtgcctattttatttctgaatcttctgaatgtgtttgacttcgaatttttagtccaattttagtaggatgatagaaagccatattccgcgcatcctttcttcttttgagaatttttcaaggtgatttcgtgagtcaaattcggaaagatgggagttcggagaacaaaactccgaccctcctgatgaatctgatcaaaggtggcctgtcaacgcaccgtcatctacttccggtgaaaagtcaaagcagtcttcgccttcgcttactcacactcctctcgcgccctatggtaaatttagttactcatccaaaaggctgatgagatgggggaaattgctcgcagttttttccaggagctgtacacgaaggatgagagcatcaggccgacggagcttttaaatatgtttgagccaaagatcacaggagaaatgaatgacaacttaactcgtccattcactgacgaggagattggagatgctctgttccagataggtcctctcaaggcgccaggatcagactgttttccggcccgattttttcagaagaattgggcggtcatgaaaaaggatgtatgtgaagccgttaagaagttcttcgagaatggtgagatgcaggaaggagtgaatgacacagtcattgttatgattccaaagaagaattcggcggaggagatgaaggatttcaaacccataagtctatgtaatgtcgtatataaagtggtcgcaaaatgcttggtcagcaggctccgaccattattgcaggacattatctctgaatctcagagtgcttttgtaccggggcggttgattacggataatgcacttattgcgttgaatgcttccacgccatacataagtgtaccagggagaatcagaatttctgtgcacttaaacttgacctgtcaaagacatatgacagagtagactggggttttttaaatggggtgatgcaaaggatgggttttggagatgtttggaggaagtggataatggcctgtgtgacatctgttcgttacagtgtccggctaaatggtaatatgacagagcctttctgcccaacaagagggttaaggcaaggggatcccctgagcccatatctgtttctattcattgcggatggcttgtccaaaattttagagagaagaaaggtggaaggacttatacagcctttgaaggtctgtcgtgctgccccactgccccaggtgtgagtcaccttctttttgctgatgatagcttgcttttctttaaagctaatattgatcaagcaacaagaataaaggaggctttggatctatttgagagaagcacaggacagttaatcaacccaagtaagtgctcccttctgttctctgaattttgtccacagattgcacaggaggaaattaaaattgtgcttcaagtcgaaagatccagtttcgaggagaaatacttgggcttactgttaaatatgtgatccaaattttgggtccacaatatattcggattagttttctagtagaacttcatatctatcctattaggtgtccttctattatcccctatatatactcttgtaagccatatgggaaggggtgacgttcccattgttattcccctacgtttgtaatcatctaccctatagtgatcattaccggttggcgtccgtggttttttcccgcaagggttttccacgtaaaatttatatcttcgttgtgcatctattttcataacaagtggtatcagagcattggagatcgatctactacagtcccggccaccggcgattttttccgattgaagaaatcgatctaatcgacggcacgcgtcgtcgtgttcgtcgttccgtcgaaattctgttcagcgaaatccaatccaaagcggagtcgacttcgtccttcctgccgtgcgagaatcagagcagcagcagcgcacgcgtcaggagaggaaaagcaagcagagagaaacccttccatctgcagtgcacgttcaccgaggaaaagtagggcagaagccagaagccatcgagataggagcagagcgctcctgtacatgtgaatttttattcacgttgaaattgctacgcgcacacaagcttgtctaccaggaagtttcagatctatactacgtgcacacgagaagtgtaccaggtttcgtgttttttgatagtttaccctaatttcttactagcaaatttcaggattaattcccatggcgagtttgaagtatgatctaccgctcctggaccgagacacaagattctcactttggcaagtgaagatgcgagccgttcttgcacaacaagacctcgatgatgcgctttctggatttgacaagaggacacaggattggtccaacgatgagaagaaaagggatcgtaaggctatgtcatatattcatcttcatctatctaacaatattttgcaggaggtgcttaaggaggagacagccgctgggctgtagttgaagctggaacagatatgcatgactaaggatctgaccagtaagatgcacctaaagcaaaagttatttttgcacaagttgcaagatgatgggtctgtgatggaccatctctccgctttcaaggaaattgttgctgaccttgagtctatggaggtaaagtatgatgaagaggatttaggccttattctattgtgttcattgcctagctcatatgcaaacttcagggatactatactttatagccgtgatactctaactttgaaagaagtttatgatgctttgcatgccaaagaaaagatgaagaagatggtaccctctgaaggttcaaattcacaagcagaaggcttggttgttcggggtaggcaacaggagaagaacacaaacaacaaatcaagagataaaagctcaagtatctaccgtgggagatcaaagtccagaggcaggtataagtcatgcaaatactgcaagagagatggacatgatatctctgagtgttggaagctacaggataaagacaagagaaccagaaaatatataccaaaaggtaagaaagaagaggaaggtaaagccgcagttgttactgatgagaagtctgatgcagaattgcttgttgcttatgctggttgtgcacaaactagtgaccagtggattcttgatactgcatgcacctatcacatgtgcccgaatagggattggtttgccacctatgaagctgttcaaggtggtactgttttgatgggtgatgatacaccatgcgaggttgcaggtattggaacagttcagatcaagatgtttgatggctgtattagaacattattagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatatgccaacctgtaccatctgcgaggtacaactatattaggtaatgttgcagcagtttctgattcgttatctaattccgatgctactaatctttggcatatgcgtcttgggcatatgagtgaaattggtttggcagaattgagcaagcgaggattgctagatggacaaagcatcgggaagcttaaattttgtgagcattgcatctttggcaagcataagagggtgaagttcaacacatctacacatactactgaaggtattcttgattatgtgcattctgatttatgggggcctgctcgtaagacatcttttggaggtgctcgttacatgatgactatcgttgatgattattcgcgaaaagtttggccttatttcttgaagcacaaatatcaagcttttgatgtgtttaaagagtggaaaactatggttgaaagacaaactgaaaggaaggtgaaaatccttcgtactgacaatgggatggagttatgttctaagatatttaaatcatattgcaagtctgaaggcattgtgcgtcactacaccgttcctcacacacctcaacaaaacggcgtagcagagcgtatgaacaggacaattatatcaaaggcccgttgtatgttgtctaatgcaagtttgcctaaacagttttgggcggaagccgtttccactgcttgttatcttataaatcgatcacctagctatgccattgataagaagactccaattgaggtatggtctggttccccagcaaattattcagacttaagagtatttggttgtactgcttatgctcatgttgataatggtaaattggagcctagagttattaagtgcatttttcttggttatctgtctggtgtaaaaggctataagttatggtgtcctgaaactaaaaaggttgtgattagtagaaacgttgtcttccatgaatcaattatgttacatgacaaaccttctactaatgttcctgttgagagtcaggagaaagtaagtgtgcaggtggagcacttgatcagttcagggcatgcaccagaaaaagaagatgttgctattaatcaagatgcacctgttattgaagattcagattcttctattgttcagcagtctccaaaacgttctattgcaaaagataggcccaaaagaaatactaaacctcctcgaagatatattgaagaagcgaacatagttgcttatgctttgagtgtggcagaagaaattgaaggtaatgccgaaccttctacatattctgatgctattgtttctgatgattgcaatagatggataactgctatgcatgatgagatggagtcacttgaaaagaatcattcttgggaattggagaagttgccaaaggagaagaaacctatccgttgcaagtggatcttcaaaagaaaggaaggtatgtctccaagtgatgaggcaagatacaaagcaaggctagttgctaaaggttatagccagattccaggtattgatttcaatgatgtcttttcccctgttgtgaagcatagttcaattcgcactctactcagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatccaattatgatagctgtgtttatctcaaagttgttgatggttcagctatatatttgcttctttacgtcgatgatatgttgattgctgcaaaagataaatcagagatagcaaagttgaaggcacaattgagtagtgaatttgagatgaaggatttgggtgcagcgaagaaaattctcggtatggaaattactagagaaagacattctggcaagttatatcttagtcagaaatgttatattgaaaaagttcttcatcgtttcaatatgcatgatgcaaaactagtgagtactcttttagctgcacatttcagattatcttcagatttatgtccacagtcagcttacgatattgagtacatgtctagagttccttattcaagtgcagttagttcacttatgtatgcaatggtatgttctcgtcctgacttatcacatgcattaagtgttgtcagtagatacatggctaatcctggcaaagagcattggaaagctgttcaatggattttcagatacctacgtggtacatctagtgcttgtctgcagtttgggagatctagtgatggacttgttggttatgtggattcagattttgctggagatttggataggagaagatcgctcacaggttatgttttcactgttggaggatgtgctgttagttggaaggcaagtttacaagcaactgttgccttatctactactgaagcagagtacatggctatttctgaagcttgtaaagaagttatttggcttagaggtttgtacactgagctttgtggagttacgtcttgcattaatatattttgtgatagtcaaagtgcaatatgccttacaaaggatcagatgttccatgagagaacaaagcacattgatttgagatatcactttattcgaggtgtgattgctgaaggtgatgtcaaggtatgcaagataagtactcatgataacccagttgatatgatgacaaagccagttcctgctactaagtttgagctttgctcaagcttggttggtgttacagtatagtcctagagactatttggcgcgcggtgattttacctacatgaggtatctttggtgattgatgtttttatgctacaagaggaaattcgtctcaaggtggagattgttaaatatgtgatccgaattttgggcccacaatatattcagattagtttcctagtatgacttcatgtctatcctattaggtgtccttctattatcccctatatatactcttgtaagccatatgggaaggggtgacgttcccattgttattcccctacgtttgtaatcatctactctatagtgatcattgccggtcggcgtccgtggttttttcccgcaagggttttccacgtaaaatttgtgtctccgttgtgcatctattttcataacacttaccaatgccggaagggagaatgaaggcagagcaatttcaaccaataaaagaacgatttgcaaagcgactaacatattggagtgaaaggtttctgtctgcggctggaaaagaagccttgataaaaagtgtggcccaagccctgccaacatacacaatgggtgtgtttaaaatgccggaaagattttgcgaggagtatgaacagatggtgaggaacttttggtggggacatgataaaggagaacggaaggtacactggattggatgggaaaagttaatgagtcccaaactattcggaggacttggtttccgagacattagatgctttaaccaagccttactagcaaggcaggcatggagactgctcgacaatccagatagtttgtgtgctcgggtgctaaaggcgaagtactatccaaatggatcactaattgatacggccttcccttcaggttcatcaccgacttggaagggcatcgagtatggactagagttactgaagaaaggcttgatttggagaataggagataggcgtcaaattaaaatctggaggagtcaatgggttgcacatggggaaaacccagtgattctgcagaagaaagcttggaatcgtctcaagtatgtacatgagctcatgttgccggaaaccaaaacgtggaatgagcctttaatcagacatatagtccaggaaaatgatgcatctggaattctgaagatcaaaatacctagaagggagatgacggactttccagcatggcaccttgagaagacatgaattttcactatcaggagcgcctacaggttagcatggaatcaatcagggaaggttcgtgtggaagcttcatctggtacggcgacaaatggtgaaaggaagatctggaagaatatatggcaaacaaatgttcaaccaaaagtgagaatttttgcctggaagcttgcccaggacagattgcccacttggggaaataagagaaagagaaagataaaacagagtggcatatgcccgatttgcgggatgactgaagagaacggttttcatgctacggtggagtgcactctagctagaggcttacgggaggcaatgagagcacattgggtgttgccggctgaaaggagttttgcatatacagggccggactggctattagtgctgttggatagtctgcagagtacataaaaggagcatgttatgtatttactctggagagtctggcacctgcgaaacgacatgatccatggcaaaggaagtgcatcaattgctgaatcagtcagtttcttggttagttatgaaggccaactgttgccaatccgacaacgagaagatgacaagaaaggaaagggtcctatgtacagggaaccgaaccagatatctctatctacaagtatcaacaaactgactgacaaatggtgtccaccgccggagcgcttcgctaagctgaatgttgatgcagggtttagggaagaaaccggggatgctagtgtcgggtttatattcagagattgcaggggtttagtgctactggcggcccatagaaccctgcatcaatgtggttcagctgcctaggcagaggcgctagcatgtctggaggggatcagagcggcggttgacttgattcacatgcccattgtgctggagatggacaatgcagaaattgttagagatttaatgaggcatgatcagttgaaatcggcctgggcgacgacgattgaagagattaaaggagtgatgcaatgccttcagcaagtgcaagtgcacaagataaagagagaagcaaatagggtagcacctgttttagcacaaatggcaatgtgttctaggtcctgcgcggagtggaggttgtgtgctcccgcaagaattctagatttattaatcaggagtgtaaccctttatttaagcattaataaagctctctctttaccctcaaaaaaaaatctcatgttactttcaacttaagcaggtacatcagctgtacccattttcatcgtgtattgtctgtattcttcttatgtacagtaatctcacttcatcttgatttacttaagaagcgagtggccgcttacgcatgcactttttttttcacaatatttacaaagagcaactactcacacatcacaccaatgtcttgcatatcttcgtatcttgatcgcacatcttgagcccaaaacctcatccaagtgacatgcctttgtatatacacgtacacatgttccatctctgaacttattggatgctgatgacatgctgtcgccgcggtgactgtggcgcctgctggttgatgttcaccgcagcagcagcgtctgaaatctggcaattgcattttctgacggttagattgcagtgtgaaacaagctgcatggattgttcagcagcattgaactgcagattgtgtcttttatatcaagaattcagaatgaggttggtgaacctgccgctggttgcgtcgatgaagcagttcagttaaggacagcaagatgatgtacacaggtataacgattccagccgttctaagcatcagcagctggttcagaagcatgattttggctcaaataatcaatcatcaaagtagtagggtaatatcaatatgtgtgctattatctgagaattcagagaattacagtgatcattgcgacggtgtaagcatcgtgatcaccgaggaaaaccgagattgcgtcgtggagtagcaagagtaccatcagctgatgaatttgagtgtgtctgaatgttaatttttggtggtggcacgaaatgatgattcttttttttttcaggcacttacagttagagcaactatgcgacaatagattacaccttttgggttggggagttcaggatcgtagcttgttgaggcagcagcacttcggtctgtgttttgcatgacctgtgcttgaatgtaaccaggagttctgcaaatgataaagcttgagatgatccatgtctaatcagaagctcagaatcgtgcttcttttgtgatgatacatcaattacctgaagaaaattgagtttcttccatgttgaaacaactttgcaggtgctgtgtagtttggtgtgtattgctgtatccacagaaatacaggctactatatgttaatttctttgtaggagcaacttgttttgagatggccatgagtactaggtgttcggtgaaaatttcacctgtaagcatatctcacatatggtgtctcccttctcatcacaccacctctgaatgcatttgcgatgagcatactgaaagaaacatgtatatagcactgttacaaaatttatttcgcagcactactacagattaagaggtctgaaatacaggaacaaaatttatcataagcctaaaaatatcctgtgcagaagcaaaatacgttgatggcctaaatagattccttgaccaataaagttgtttaacaactaaatctggcataccccgaattgcagaaacggaatttaattagtttgatactgaattttaccttcaagctgcccctgcaggagcaaggggtctccatgtaggtctgatcatcctcttcctggcaaattctacattctacaagaacaccactcttctccctctcatcttgaacatcattatgttcagaagcaatcactgaagaaggcatggcagcagcagaggcctcatcaatggcagactgaacagtcgattccgttagcaaccggccggccattactgcaaagtggtccgccatccctgagaaagttaagaaaatccaagcacaataaagatcaaatcagaacacatcgtttacaaatacaaatatgaatgtaatttgcaagaaaaaaaaagcaaattgtgtatctgaacatgtttatctgacggctcaagatgattcttttccatttcacgaagaagtgagcaattgagcatagcaaacgatcattacctgcaattgcagttcaaaacagagaaaaatcaaggcatgagcttcctcgacaattcgaggaggtgagcaaatgcagaggccaagaaaggccaggaggaaatagcagctacaagaggaggcttgcaatgggggatttggatatctgaagactgaaacattgggagattgtatagagagaagcaagagatggagtagttgcctgtattattattgcctctttgcttgcttctgagacttctttttttcctgattatgctttagcttctgatatgctttagttgttcatgcagaaagggaaccaaaagcattagagaaatttgacagcaaaaacggaatgatgcttattgactcaagaaagctattcttttcgagcaaaactcaaggaatgaaggcacttgaccacaattgcaggggaaggtttgcatcatcaagtcatactatattgccatttgcctaaggctcaggattaccctctaccaacgcaaacctatcttacaactgcagagttaaaagaataaaaaaaactcgttgattctgatacatctttcggttgcctttctttctgaattttgacatcacttttgcaatgtgatttgctggtttggatagtggagaagttgacaggtgcagatgttcaatggtggattaggcctctctatggcttttaggaatttattattatttacgtatatctaatcccaaaagcgaggattctcttgcagcttctactgctagtatgatttcacagtgtttatctaggtgtattattccacacgtgttgcaccggattgtaattgaagctccagagtgacgtcagacggtcagagtgagaaccccgcaaaaaaaaaaaaaagtttcacggcgaaacatagggctcttcaccaatccggcccaatgagcccaagcagaagaactcattggtccaccaaagtcttcgatatttcggaaagaaaattaagatactgcaagcctgcatcgtatttttcaaatttcaattcacactatctctcacagctcacatccaaattgaacagtcctatcctaaaaaaaaaattgaacggacacagcatcacttgaaattctgagttgaatggtgcaccttgttttcaatgttttcatagtttgatccgcactgtatttttcacagatacttccatcgtcaaaaaaacgaatttaaaattggatgtgacatattctagtaatccattaacacaataaaactatgataaaactactgaaaaaaatatctaaattgaacgggcgcagtataacttattcaacgaaatacccgattatttagagttcataggtcgacgaaagaaaaaaaaagaagacatacactcttggccgttcgatcccatccgacggtcaggatatcccgtccacgtctctagcccagataaaccctacccccccactcctcccgactataaattcctcggcttctcccctccgccgcctcctctcctagccttcccctcctccgccgccgccatctgccgtcgagagccccggttgcccacccccgcggcgacgatggcgggccaggagtcgctcaccctggcgggcgtcctgcgcggccacaacgacatggtgacggcgatcgcggcgccgattgacaactcgcccttcatcgtctcctcctcccgcgacaagtcgctgctggtgtgggacatcaccaacccgtccaccgccgtggccacggatcccgaggcggccccgccggagtacggcgtctcgtaccgccgcctcaccggccactcccacttcgtccaggacgtcgtcctcagctccgacggccagttcgcgctctcgggatcctgggacggcgagctccgcctctgggacctagccaccggccgcaccacccgccgcttcgtcggccacaccaaggacgtcctctccgtcgccttctccgtcgacaaccgccagatcgtctccgcggcgcgcgacaacaccatcaagctctggaacaccctcggcgagtgcaagtacaccatcggcggcgaccatggcgccggcgagggccacaccgggtgggtctcctgcgtcagattctcccccaaccccatggcccccaccatcgtctccggctcgtgggatcgcagcgtcaaggtctggaacctcacgaactgcaagctgcgcaccaagctcgagggccacaacggctacgtcaacgccgtcgccgtgagcccagacggctccttgtgtgcctccggtgggaaggacggaaccaccctgctctgggatctcaccgaggggaagatgctgtacaagctcgacgccggcgccatcatccactccctctgcttctcgcccaaccgctactggctctgcgccgcgacagaggactccgtcaagatctgggacctcgagtccaagctcgtcatgcaggacctcaagccagaagtccaggccttcaagagccaggtataccttttgcactttgcctctctcgttagccttgcttgtcacatgtatcgtgcattcgttgctgcctgaatctgaataggatgtaccgcgtgatgcatgttctgtcgttctgtctgattaggatgtattgtgtgattcgttccatcgtggttctcgcgtgttgcattttggattcctggtgctattattgttacgcccttcaatttatcaggatccctctgtagtaggatagggtagttttgatgcttattaagctcattgcgagcaggttatccaatttaactcacagcatcatgttcatgtggtcaagcatcacatgtacgtatgttatcagcaggtcatatacataattagtcccgctgatttatatttctaggtaccgaatcctctgttctgtgttgatctaatgatctaatcagttttatgatctgttctcagtaatacgtactcatcaatgatgctgttgatgtttatgctcatcccttctccactgaattgtatacatgtatttatattactatatactaagtagatataaaatgctgcattttatttgtttacatgttagtttcatcaaccatggtgctgattggtccctcatgtgcctgtgtaactatttggaaaccagcatttcggtatacctctgcatatccttgtagagctgtagcaatattagtctctgctataagtaattcaatttaacttcaaactataatttgaccgcaccttctcactagagtggtacagttttgacaaagttgatctttacaccttgaattttgtgttagttttgcaaacttttcttaatgtatgttttgttattttctaccacggaaaccttttctgttacagttctcataccccttttgattgagcacatgcaatttgttatagaggatgtgcattctccttgaaatctcaatagtccttaaattgttctattgtgcactttggctgtttccccctagacttatattctactgtgcaccttgtattaatatgtattcaattctttaactgaacttgattacgcatttattttccttaaaaagaatgtgtactgacacctgccgttacatttgcttagatgctgtactgcacaagtttgagctggagcgctgatggcagcaccctcttcgctggctacactgatggaactatcagggtttggaaggtctcagggtttggcggctatgcaatctaggtggtgaatttgttgaaaggcttaggaatcttaatttaaacatcgtgatgcctatcaagtttttgacagttctgaggcataacatttgcctggtactttctacttcattttcattaattaatgattagatttgccaatgagcttatcggtactctggaactatggaagaggatccttatgcatattttttgtttttggctaagttgaaaagatattagttatgcaactttcggagcctcattgcctagatgtaaataatgcttcatcaattgctattttctgatgattttgatggtgctaattagcttttcatctgccgctgataccttaaatcttccatttgtttgccttattttttattatctttcattctgtggtttttaccgtcaccatcaggttagtttgttctggacatgtacattggatgttattgcgtttgtaatatgtgatgtttatttagcccctaaaagcctcttaagttaagaaatagtatgtggtataactacgacagaccgaatcacctggtgtggctgtcatctagcataagcattgaccgtattatctgcatttcataatcaaccacagtgttcttcagttggataatcaactgtcacctgccttctgttttcaactgtgaccatcgtcgtcatatcttgcctaacctctatcattttttaatttcatcgtcttctatgattgaaattttctcaatgcttagtttcttattaaatctatgattggaatttttctcgatgattaattacttatttaatctcaaacacatggttatgcaatccttcacgcaaactgcgtcctcgaccaatccagtttcacgacgaagtcgtcgacccgaacctggtcaattattcttcttcagattcagaaatcaccatgtattagcaactctcttaactcgtctaaaattgcaccaattcattctatcattgttgccgccatgtcgtcgtcttcctcattgtacaagcagctcggcctcggagccggctctcccgtctccgcctctcacctgcttctgctcgtcctcggcgccggcttcctcgcgctcaccgtcttcgtcgtccaccccaacgagttccgcatccagtctttcttctccggcggctgcggccgtcctggcacggacgccgccaccgccgccgttgctgcctcgccggtcaagaatgtcagcggcggcgcaagtgatgctgctgccgcgaccacggcggcgcggtcgccggacaacgacgtgagggtgctcatcggcatccagacgctgccgagcaagtacgagcggcgcaacctgctgcggaccatctactcgctccaggccagggagcagccgtccctcgccggcagcgtcgacgtccggttcgtcttctgcaacgtgacgtcccccgtcgacgcggtgctggtgtcgctggaggccatccgccacggcgacatcatcgtcctcgactgcgccgagaacatggacaacggcaagacgtacaccttcttctccaccgtggcgcgcgccttcaactccagcgacggcgagggctcgggctcgggctcgccgccgccgccgcggtacgactacgtgatgaaggccgacgacgacacgtacctccggctggcggcgctggtggagtccctgcgcggcgcggcgcggcgcgacgcgtactacggactccagatgccgtgcgaccgcgagaacttctacccgttcccgccgttcatgtccgggatggggtacgcgctgtcgtgggacctcgtccagtgggtggcgacggcggaggagagccggcgcgaccacgtcgggccggaggacatgtggacggggcggtggctcaacctcgccagcaaggccaagaaccggtacgacatgtcgccgcggatgtacaactaccggggcgcctcgccgccgagctgcttccgccgcgacttcgccccggacaccatcgccgtccacatgctcaaggacgccgcccgctgggccgagacgctccgctacttcaacgccaccgccgcgctccggccatcccacctctgaaccgtgttcttcttcttcgcgccttctctctctcgatcgttttcgtgacggattcccgttgaatttggcggttgttggttggtggcgggtagttgttgcgcgaaagcacggtggattgcccctgtgttcctagctgatttgttccaaatttctcgagtttaaaatagatatgaaatggatatttgttcgttagtgcttacgtgttctttgataaaccaagtatgattattacgctgacgtttgcagcgagagaaaaaataacaggtgtgtgacatcttcagaggaaaatcacgtctgatagagaatgacacacggtatggatagaacgagcaatggtttcgccacaatcgggattggattctaatctcgaggggatgtcccttcgggtacttttttttctttcaaattctatataaatgattatgaaaaattctgaaaaaaaatgtagagtatagtgatatctattggtccaccaaaaatcaaattaaaattctacctacacatcaagaaaaaaaaagacaacttcagatattatcatatgaacaatgcgctactattaatatggtgaatttgtcttttatatatctgaacgtgtgagttgagttttatcgttgatatggtcccagggtactaagctcaggagagaaggccctccccgtatgacgcgtgtcataagactcctgaaggagtcgcgtccatgcattaggagcggccgtcccccccgcgaggggggggggggggctcagagcgttcccccgcccgaggggttgagccaccccgaggctctcacccgggcgccgcatgacgggagtgttggggtgcgtgagcgccgcccacctaaccacattcatggttagctgagcagccacctcccatcgcatttaatacgacgtagggagcgtagtgggtgcgcctgtaacccgtctgcgaccggtctatgaccaggcgatagacagatgggatagcggcagacgcacccacgcctcaagctcctgttaggcggcgtggggacaggtatgccctgtcccatcgtggataatgaggagccctatgtcccccatccggtcagcagtaggcttgactgaaagggacgtgaccgggtccaatgacctggtgtgtgtgtgtgtgtgtgcgcctatggagtcgccgagcattaaataccgagtgacggggggctgtccctcgtgtcaaccggagaggtttgatgggacccgcatgacggctggcgtacggatcgcctccggaccaaggcgcaagatatgtgctgaatataaacagtatccactctctccccgaggaagtggggggtggcgtgtgtagtatccccttgaactataaaaggaggaccacgcctagcggggatgggggatgaaaaaaccgaagcttgtagactagagattcagagactttgtaagcacaaaagaatcatcatgcacataggagtagggtattacgctttatagtgggccgaacctgtataattctctggttctcgctttcgccaagggacctagtcttcgactaatccaccgcactcgcatcctaaaaactcctcaagaattcacccgtgccccccgccgaacttaaaaaaaaaggggggggctcttagttccccgctggagggaatcactcttcgataattttggacttgagattttgtgaagttgtatagatatattgtatgagtgttcttaaatttttttcagaattttttataaacatttagatagtttttttaagcaaacgagggaatatcccctcgaggggatccagatagtttctagccacaatccgttagcagccaatctgcatgggccgtacattgagcccaacgtctgtaaagacgcaatgaggcctcacacgacgatgtatgcagcccaacaaaacaaagcccgatattgcagcaagcgtcaaacatccaacatccagagttaatcaagtcgtcacgtcactgttccagcctagctaagctagcaacaaacgggacaccacccaatgcgatgatgggtatggacgaatgatgccgctggctgccgagacagacagaggccacaagaatccgtcgtcgccgccgtcgggtcggcgagcagatgagatgggggcgaaggaagaagtgatctgatcggcatctgctcgggcgccgctgtctcgagttgaatggcaaccgctatccgatccgctgccgcatgcgacccgcggagcgcctcgggaccatacgttgtgatggccaaaaacaccggatgatacggagaaaccaatgagagctagtcgcgctcatgtttctgcacgaacagccagaagagaattactccgcgaattatgggtgacacgccatgtgcggtgcgatcctttgcctctctcaaattgattttaggagtacgacttgtgtgtgtaatttcttttctcctaagcccacgatgttgtgcaaattgtcaaactaattttgtgccggtgatctcaagtgctagggggtactgtttaggtgaaaatgagacccccagggttgcttttgtttcaagcctagtagcgacaaagttagcaccacccccctccgctcgtctccatccgccacacagacactctctcccggccgtacgctgccgatccgacggctcccacctcccccaccccgccgtacgtggcctcgactccgcttttcttcccccctcggctccggtttcttctccacacgtctctcctctcctcctcctcctgacctcgccggcctcacccaccacccgctcccgccgccggctttaatgcctccggggacaagccctctcaagcgtcaacgactcatccactgctccacccgcgtgggcggcgcgtacgtagaccctagccggcctctacctgctcgctacagagctcacgtacgtacgcgcgcgcggtggtggttggcgcgcgcgcgcgtgcggtgaggcgtggtactagtattatttattcgctcctgcctcctggggaggtggaggatgctggcgatcatgagcttgctgctgccgtgggaggaggaggaggagacgacggaggcggcgccggtgttttgatccgtcgcgcgcgcgcggcgaggtgcggatcgggcggtcggttttgaattttggagcgggaattgcgcctgagatctttgtatttatcctggttgttcatgtatttttcttcttaattgcttcctttggttggtggtttcagtaggaagaggttggagacgtggagaggagtggccgtctcgtttcagattcttctgcgcaaattctggttacaactagaagttgcaggacgcgagagggttgattggtaaggtaattctatggcgttcgtgtgttcctctcatgtaggttgagtggtttcttgtgttatgtttgtgcattctagatctgattgatatgcgtttgtcatctccatgaattctgtgttgttttttacgctagcctgactaatctgccaagttaatggcactgtttatgttttctgaatgaacactgctacacatactaattttttcttactaaatctttactaacaatcatctcaaccgtttgatttaggtagatggaagttatgaaaaatctagatacattcatagcatgacacatcagtgttagaatttagtaagaaaaagttagtatgtatagacttttcctttctgaatagtaatgtacaacaaggtgatcaactgatcatgtactaatagtgaacactttatgatgtagtaactttttttaaaaaaaaacgatatgatatggagtaagtaactttcctttgttgattcctcgccgttgcttgaattctggttttctgctcagctttggtacagtatcattatcatcgtaccatctctgcatctcaccagcaagcttgtcggaatgtttgctgcttcactatagagttttaaggaaccaatgtccagagctcacgtgttataggtgcagtaaagtcggatgaaatcatgaatatctgtttcggtctagacacttttcttttaagaatggtcaccgggggcgaaatgcccacctgaatatgttacttcaaacaatcttacacagggcaggcttagcttatgcaagcgtaggtggccctggaggataatatggaagaatacacgggatatacaaagaagagaatacaaacgtatcacaacctcccccacctaacacaaagaggcacaatagatagaagacagaagctttgacgtttgccacctgcaaaatcacccaacaaaattccaaatcaagcaaatgctagaacccttgttcgacatcatccacttcacatgcagtctggaaacaccaggaatcgaaagtgtcggagggcctctccgccatacgcatgcggctcggtaccctggcagtgtgaaaggctgtggttgtcgaagaccacccgcatcatgcaatcagaataatgacttagtcatgttgctgctgggatcaatgcctgtcggcgtcctttgggggaaggaagccccaaaggagggagggccactgaaagattgaggccataggccatccgcatcaagtcatcttcaatcagtctttaacaaattgctactccctctgtcctaatatattgcaacctaggatgggataaatttatcccattctaggacaatgaatctggacataccatatatccagattcatagtcctaggatgggttgcaatatattgggacggagggagtagctagtttaacgccctccaacatccttcgggggaaggaagcgccaaagtaggaaaggccgctaaactttgcggacacattgatacactgttagtcttgatctcgtctaaaaatttaccatggtaacagatcaaacttgtactacctccgtcccaaaataagtgcagccataagtttccgcgctcaactttaatcgtccgtcttatttgaaatttttttataattagcatttttgttgttatgagatgataaaatatggatagtactttactcgtgacttatgtttttaatttttttcaaaaaaatttcaaataagacgaatgatcaaagttggacgcagaaaaccatggctacacttattttgggacggagggagtatttttcctttagaaagaagtacagtatataccttcatcttggaaatgacaaagttctcagtagtgtgtgtgtgtgtatactaatattttttcgaaacgttcgtcatgatatgattatctatgaaaatgtttctactgcattatcatatattcatatttttcctcgacatattgtactatgaggacaaacttatcagttaattgacaggctgtaaagttgtaatgcgcttcttacatttttgacagaagaagaagtgctgtcaactttgagataaaggcaaaattacgagaaaaaagactttcaagttcttttgaggatgagtgaccctggagagccttctaagcattcccaatggatgtcacactggaccaaaggaagcagcagtgcagagccccaagttggcagaagtaatgattctccggaggatgcgaaatatgacatttgcgaggacaattctgggccttcaaactttgagatcatgaaatctagattgtttgaaaggctaatggtaggaatcagccaagaaagagcttcgttggagcatggacagaagttaaattctaacatgaaagtagtggtaaaagatgctcgccgacacgctgtgcaaaaccaaattgatcagggagacgggccaattcaaaaatctgtgatgcaaaaagatgtcttatatgctaaggctgttgtatcaaaatcactttccattcagaagctttcagagttatcagtggattgtcagaaacttgcaggttcagatgacctgagttcagagtggaaccattttcctatgcttgcaatcaacagaaaaattgactccattctcaaccctaagaggaagtctgcaaagagtactggacccaatgacgtttttgtgccaaaacaaactctgaagctaaacatgactacagctaatctgatggcattctcatctcaggaatatgagctgcattctcatcgaacaaccgacgagacaatggatcactgcaaacatgcaggaggcattgtatctcgcctggaagatcatgctggtgtcatgttgaatcctgcagagcaaaaattaaaaggtcaattattgccagcaacgtcatgttcgtgtagcaaggatgacagtaactcatctgatagtctattagatgagcagcatacaagccgctacattgcagattcagatcaggaaccaacctgcagatctcgtgaaaaaaggttgaaatcttcagaaaacaatgacacgaactgtaaaattggaagttgctcccagaatcagaagtcaagagcacctggacatcataaacacaaaggttctgcgggagtcatgtttcgtacgtcagtacctggtaaagaatttgaagctgctgaaattaattgttccgacaaaattaatcagcgacatctgaatacacagagaatagtatctgcagcgaatgtcactggctcctgcatacctgatccagctgcagacatatctacagtaaatggtaggggggaggcagtgacccagccatcgagcatatctggagattcaactaaacgaaaagctccatatttatttgaaatgctaaccataccttccaaagctcaaaatatgaatcctgaagattcactgccttcaggaaactcgactgcttttggagttcacatgtacggcacaaatattggcagtcatctatttggagcaaataacaaatcatcaactgaaactgaaatattatccggcgacagtcaacatgtttcaaaatcctcagcaggtaggagagaagaagctcagataatactcatgcgacattcttttagcttatattgattaaaaggacttgtctctttccaatgttgtttgagtcgagattgatttattgggtatgaaagaaggcaataaaaaccttgaataaaatataacaattttctttattccattggtggtatcactcacagttttgttctctcttctttcaggcatcgcctcattgttggcacaaaaggtactagtgtcctatactactctcatgtttggtcgttatcatataagtttatgcaaatttactttaaaaatgtatataatattgtcggatatgcattttttttctgcaccatcaacattgttttccatatttaagattttgatcacatatataatcatattagcttggacatagcccatttttctcttcttatatcctcgcaaacaagttacttcatgctatctcatttatatgaacatgccgcggctaattcctatatggttgcaggcaaaatccgagcagctcgcgactctgtacatgaaaggagcatcaggatgcaatgtgaatgaacatcaaggtgtttcctccaaggcaattgtcgccaataagcaacaatgctacaatccaagaacagcacgcatggacttagatctcatgcaattccagttgagcagaatgagaaaccaagaatcacaagcgcgaaccgaaccaggcgacagatggctaaaacgcctacagattgacagcaaggaccctcatcatcttccttgctccaagaggtcaaaagctggagacggatccggtcgtccagtcaccggaggagcaagcagcatggcaccccgttgcgacgggagcaacgacgacgacgacattgttgaccgtgatcataaggaggaacaaggattggatgaaggggtggaaattcaaggcggccgagaagcatctcctgttccggcaaagagtgatgaccggtggattgggagatggtgccagggtggtgttcctgtgtaccatgaagatgatcatgatcagaggaaggaagtaacaaagcctgatcttgccgccggtgactccggaggacttgaaggtcagttcccaagcatcaaggcgatggcgatgatgggacgagcaatgagcaaggttcggccgtgtcaggaagagaggaggggatccttcatggtgtggaaggcgtagtaggagagatcctgatcacgtacaggtttttttttcctgttttttgttctgtgtaatgtagactgggctgccctctctcctcccgtggcagctggcttcagatccggtggctatcttatagggtatgtttaccaaagtatctttgtgccagcttggactccctaatcctcttaatctcttggcatctatggaaggaatgcaactctagagatttcgactctgcgctcttttttatcagtggttcagtgtaaacgatgtctggttttcaggtttatgagggtaattcggttgaccgtgatagtttgggagtaattcgtacttttttcatttctaaaataaatagttgtaaataaatggatctacgtgttataaacatctgcatttataatgttaaaaaattagtacccctccgtttctaaatatttgatgccgttgacttttttaaacatgtttgaccgttcgtcttattcaaaaaatttaaataattattaattcttttcctatcatttgatttattgttaaatatatttttatgtatacatatagttttatatatttcagaaaagtttttgaataggacgaacaataaatatgtgctaaaaagttaacagcgtcaaatatttagaaaaacagagggagtactctttttgtaagaaaaaaaaacttagtatgacagcttaacggatatattatgtttgttttttttatgtactaaaagggagcagtaaagtaaataaatctagcactgcaacttaatggatcgtcttttactagagctaatgacagaatggacaggacgatttgccttttgttccaactatctatgagactatgacatactcattccatcccaaaatataaggcttaactactcataacataaagactaagaaaatatttaatctcctgcttggttggatcaccctaatacatacaagcaatgtgattggaatatttgatggtataggatttaaaacaaatcaattctattggaaaatatttaatctcctgcttggttggatcaccctaatacatacacgtcttatattatacatgagaaaaaaatggttgtgtggaagggagtagtaagtacgtaaaccatcatcagtcatcaaatgaatctagtagctgattctaattaacggttgctatatgcagatcgacgagatgacattaagggggtgtttagatccagtagtgtaaggttttggcgtgtcacgtcggatatacggacagatatttaaagtattaaacgtagtctaataacaaaacaaattacataattcgcctgtaaaatgtgagacaaatttattaagtctaattaatccatcatcagcaaatgtttattgtagcaccatattatcaaatcatgaagcaattaggtttaaagatttgactcgcaaattaatcgcaatctgtgtaattagtttttctttgcctatatttaatactttatgtagatgttcaaatgttcgatgtgatagggtaaaaaaaaattaaggtggaatttaaatggggcctaactcctagtaagacacaaggaaagtgactccagctttacgagcaattttactgtctttgagaagataccatgaggtatcactttttggtacgaggtatcactttttggtacttagatactatgaaataacgaattttacactaaatttttgatatctcatggtgtatcctcaaggaccataaaattgctccaagctttagagccttttgttccgactatcgatgacgtaggtacgtaaaccatcatcagtcatcaaatgaatatactgaagggatggatttgtccctccaaccaaacatcacctattaattctaaacagttgctatatgcagacaaaaggaatgtgactccagctttacaaaagttcgtcaacgtaacctgtcctttggatagctgcaaaagctcaattatacacgtaggagtagttcctttggctgcaaaagtagtttggtgatgtggatgtgatgtttacatttgctgctgcctttggtgatcaagtggaatatggtagtactaaaaaatttacattagctgactagccattcgtgatgctatgtttgttgatttttccgatggagagaacggtgatagtttttttttattatttatttattggcacgtctcgtgtctatatatcgagaccgatcgtatccaggcgcacgacacttgacaactctgtactacgtagttcgtgcttctaaagagcgcgggggaacccatcggcgatgccggcgcagtcggagagacttcgcttgccagcggcggcgccgatgccgcgcggtgcgcacgctctctacggactactcgcgctgctcggcgcgtcggtggtggtgtggtccgtcgccggcaagccgcccgccgcccacgccgggcacgcactcgccggcttcctgctttggctgctggggatgatagcactgctgctgtccccgtacgccgcgcagccattgttcccggttgcaactactgccaatctcgccgtggagaaactgaagcatcgcttctccaacccccggacgccggcgcaggcgcaggcgccggctttggcttaaaaacccaccgacatgtacgcgacgcaacgcaagcggcaaagccggtcctacgccgaccaagccgcgccgtcgtttactactactactactactcgtacatagcaagtgaagtggtttgagactttgaatctgctcgtctgtgtgtgtgtgaataaaataagttcagtttggcgataattcgactgcaagtgcaagcagttggtttgatttactgatccagttctagcattcgcagctgatcacgcgttgtaaatataaagctttgttctttccttcattttcagtatacaagtttctgaagctactgtaacttccaaaaaaaaaactaaaaataacgaaaaaggctggacgatactagtactactcgttattactactaataatttactgtactactactagtagccaaacaaaggggacacattcaatttacatgcttctcatttaggagatttggtgcgaaaagaatagacatattttcagaagcaacgaactttcaatatcacaactagtgacaaaaaaataaaataaattgtatgtggggcgaaagatataacgagaatagcgccttaccatgtcctctgatgtagtttgttttccttctcttttttggttttttctcttcacccttggtgattgtgtacggtttactcccctacctaggctgcaatccatattgtagttcgtttatttatgttcctaaccttcactctcttgttttcacgtgtacaccttctaaccgtaaatgatgtgttttttaaaacgttctatggaaaaagttgctttaaaaatcatataaatttattgttttaaaattttaaactaatacttaattaattatgtgctaactcaccattacgttttcagaattagtttcgaacacaatcttaatattaaaccagtagcgtctgtcattaaaattactagtagctcggtttgagaaaccagaccattgattaagggcatgtttggagaatttaagattttgagaatatgaaaattttaggtttgtcagcttgtgtcttttaattcattttctgattctaggcctaaaacggtttgaatccaaaaagcccaaacccgcgaagaaatatcccaacccccttcgtcctcccctccttatccgccaccaccaaacccaaaaccccacctccacatctcatccttcccatccatggcgccaccgcgctaaaccccccaccacactccatccatggcgctctccgagctcccgctccaccactccttccgcctctcctcccgcccccacctccgcctcctcccgctccgccttctctcctcccgccacgcctcctcctcctcctccaccaccgccgacgcgtcctcctcctcctcctccggcggcaaccgcgcccctccggctccaaatccaacccgaggcgcgccgtggctgcagaagtgggggcccaccgaccccgccgcgccgccgccaccacctccggctccctccccgacctcctccatcgaccgaatcgtccaccgcctccgcaacctcggcctcgccagcgacgacgacgagcccaccgccgccgccgccacggccaccgcgcctcccgacggcaacgagcgcctcagcgacctgctcgaccgcagctgggcgcgccccgaccagcagttcgccgcctccagcttcgacgagtccgtcctcccctgggagagggatgaggtcgcgcgaggaagagagaacgaggaggacggggtgaagaggaggagggttagggcgccctcgctggccgagctcacgatcgaggacgaggagctgcgtcgcctccggcggctggggatgactcttcgggaccgcatcaccgtgcccaaggcgggcgtcacgcaagccgtcacggagaagatccacgacgcctggaggaaatcagagttggtccggctcaagttccacgaggacctcgcgcacgacatgaaaactgctcatgagctagtcgaggtgtgtgctatattagccctttctatcagcattggcagcttgctcgttgtaactgtttaatctattatgtttttttttggatatcagttcagtttagtgatttctagtggcaattgaacttgaattattatgtttgttgctgtgaattcgaggttttcgatgagttattagttgtgccatgataaatggattacttacatgacgtttgcctatcgatcagcgacggacaggaggattgatcatatggaggtctgggagtgttatggtggtttacagagggagcaattacaaaaggcctttgaaatctgaaacattggatggtaactcatcagcggtgaaaggggcagacggtacattgttcatcccggatgcatcaagccccacagagcatgatagccaggggaaggatgtaaacacccaacgtgagattgcagccagattaaatatgcagaatactgaggacatgactgaagaggagctggagttcaatcaaatgcttgatgagttgggccctcgttttgtggattggtggggaacaggcattttacctgtggatgccgacttgttgcctcaaacaattcctggttataaaacaccatttagacttcttccaactggaatgcgtttgaccctaaccaatgcagagctgactaatttgcggaagttagcaagggatcttccatgccattttgctctaggtgattatttcgacagtgttcatattgtttatcccctattatagcttttatttgttggtggcaaacgcctgactactgcttgataaaattcatttaagggagaaaccggaatcatcaaggccttgcagcagctattgttaagctctgggagaagagtttggtggtgaaaatagctgtgaaacgtggaatccagaatacaaacaacaagctaatgtcagaagaaataaaggtttggacaccatgctgttgctgttttgactcattgactggcatacctacttacttcacagttcacagaatttatgccaaggaacattgaaaactatggtaattgccagattatatctaaatatacaattgcttgtcatagctaagctgaatatatgatatatctagtcgtatttgaggcatgaagaaattcaactaaaaatcctgataaaaaaggggcaactataaggaatactcagtactcacttactcagcagtaggttttgatgaagtccatatttgtcctgtgaatattacaaaatccatgatttgttaaatcatccaaagcaacaccaggggtttcggaaaataataacaaaattgtgctgcactgcttgctctaatgaatataacttgcttaatgtaatgcttttatttgtctaaacaccatcatagacaatcatgctttaccaagatcatgatggagacagcttcatatagtttagttctattccttgtcgaactttcatagagttccaaaggtgtgtttccatgaatcaactgtgttcaactgttcatgcactatatttgatttaacctgtataggatttctgaatcagtgaagccttatctttttaacattatttcagaatctaacagggggcaccttgcttcttcgaaataagtactacattgtaatatatcgtggaaaagacttccttccaacatctgttgcagctgctttggctgaaagagaggagttgacaaaagatatccagaatgtagaggagcagaaaagatgcattccggttgtgcactcaatggatgacagtttagatgggcatgctcttgcgggtactcttgctgaatttcaggaggctcaagctcgttggggaagggaagtaactgctaaggagcaagaagaaatgaaagaagcatcttctagatcagtgaaggaaaagcttttcaagagactagagcacaaactttccattgtaagcattttctgcatgttctctgataaaacttgtcttattttgtattgccattttttaattatgccgttgatctaggtatgccagtgtgcttatttgacatatatttatttccatcagttgttatgcatgttctttatttcttcttcaattgttcaggcacaggcaaaaatacatagagcagagcggttactatcaaagatagaagcttctatggtccttgctaatccatctgatgataaagaaatgattacagatgaggaaagatctgttttccgtagaatcggtttgcgtcttaaggcatacttgcctgttggtgagtttcttgaacaataaccttggagagcattctatactatttctattgattgattattcccccttccattttaggaattcgtggtgtctttgatggcgtcattgaaaatatgcacttgcattggaagcacagggaagttgtcaaattgataacaaagcagaagactctgccctttgttgaggagacggcacggcttctagagtatgagagtggcggtatactagtcgccattgaaagagttacaaagggctatgcacttatattttaccgtggaaagaattataggaggcctattaacataaggcctaggaatcttttaacaaaagcaaaggcattgaagcgtgctgttgcaatgcagcgtcatgaggttagtttgctacaaaagaaaaaagcaagagcagtaccttctttttttatgataatcattgtacacaactttagcatccttctgatattgtttaaactcatgaattgttatgcaggccctcagtcagcatatagctgaactggaaaacaatataaggcagatgaagttggatttggtacgtaatttctcatattacagaaaagtagttgtgttttaattaaggcaaacatttagcataacgaacccttttttcttctcattatacagcactaaaactaatttctgtaggcttaaaatgtaatatgatgccatgccttttgtaatttttgccatttgcatcagagtaaaaacatattaacatgcatcttagttgatcctctgcccactaaatggcctttaaattccacaatatttacctattgttttagcaaaaaaacaaatgttgttattcattggcatttcattattaaggcaacaactttcccttagactgcattttttttcagcagagatgtttttgacagtgaggcatatatctgttggtgcgctagtgataaattgatcatatatgtcttttagttaatgtcttcattgatgaatgctttcctgattttatgtcaaaacaaaatagggcattgaggttgatgaggaatatgaagaggacggttcagattcagaaaatgagaataatgaagcagtttcctctgcaagatacgacgaggtatccaatcttttgaaactgatgctgtctgttttagaaccaccataaaatccattcttccctttaacgtgtccaggaccaagatgattttgatgaatcaagtgatgaagatgaatatgatgattatgatgaagatgatgacgatgacgatgacgaaggcgttgatagctagtaatatggaactgggctttgcgatgtagagtgatgtttatctctggaggtgatattgcaatcctttggacattcttggtaagagcaaagatttttgttttggagttctaccaatacctcaataggttcatgcatagcatatacagaaccatataggtacaaagaattaatcatgcagtttcggtttgtattttagggagattttttattaagaacactggggaatttgtagttggtttgtattatatcaacacctcatctgttactgtatcaattaatcaaccactagcctgtaaggggcttatcttttctgatgtccttctcaagaacattttgatgttagtaatgggcttagattctgagattttgaaaccacctccatttttttatttgagagatatttataccagcataaatggattaatggattttctcccgtactattcacttaggtctttttgttacacaagtactcctttgtgaatccttactgttattcagcattaaatgcaactttgaaatatcggcacattgcaggagccaagaggatcgccggcagaccttgacaactgtattgctgctgcttctgtttacgcatggtcttttggacgaagggcatataactttcgcatgtctctactctgtatatcccatttgctttgttgtttgcaaattggctgctgggatctgccttagaaaagctgagttgggtgtaaatggtaatcttgtgtcgatgtcttctcatacttctcattttgtaacaattatttaagcaggctcgaggtagaaggtacgtttccacccccaaaatgtactagcacacgagcactgtataattcttctgctgtataaccggatattccaggacacgaagaatgttgaatatacttggtttttctcccttgcacggttgcacgcattgttcatgacatgtttatacttaggttctttgtaagttttaaggtgattgttcttgtaatgctgatctggttcttatatcttcctcagtcctgttggcctttttcaccgtaaaacgtcattgtttatctgtctgtctaagtactactcgtatcaactactgaagtgtacgtcaaacaataaaaataaaagtgagtgtgcaatatgcttcgcacagaagacacgtgaacaagtttcaccaaatttattggttttcgactgtttggttttcatacaatctgtttgttggtgaaagccgaccggtattggatttcatatgacgttgatagaaagttatcactttttactagtttccacttcaaaacaaaaagatattggtgcgttgaccgaaactcatcggtttttactagttttcacatcgaaaatgaaaagataaaccctgcacgtttggcttgtcgattcgtgcagcatgtcgattcacaaaaatgctatcgatcggtggctattggcttgtttgttttattttccttcatttttacttgttgaggaggtggtcagagtttgagaacttttacggtacactacacttgtaatatatacttgtagtataaacaatctaatacactacacttgtaatatatacttatagtataaacaatctaacggtgtggatttatctgatctttcttttacagtataaattatgtagggtatatttgtctttctatatttttgcggaaggttatttttgtattttcatgattccttctttagtcagatcggatcgtgagaaaggggctagtcccatgcgctgccggtgacagccgctgcacgcgtccctggctcgcccccagcagccacggcgatcaagggccgccacgcgcagcaaaacaatgaaacgtcagcaaattaattctgaaagcagtcgaagattcatagggtcttttagagttcgtaacttcgtatgtgctagcaaatgctgatattcgtttcgatcaatcatgtatacaagcatcgtagtcgcacaaccggacactggctggatgatggcgtgccggtgtttgggaatctttcgatccgccgccccgcgtgatatattccgaagaagcgccgctgctcgtcgaacggacgacgagatccaaaacaaataccaactaagcaaacctttccagattaactccccccggtgcaaataaatctcaacttcaaattactaaataacccattctatattttgaacaaatactaaacatacccttctatataaagagatgcggcagctctactgtagacgctgagccatgccgtcggacgccgttggacggcagaggccatgtaagggaggtctagtttgcattgggccgagcccgttaatctgatgtaatttttttttccttttcagttttatcggttgaggaggtggcggagttttcttctccgacccctgttttcgcaagaggatcgccggcagaccttgacaactgtattgctgctgcttctgtttacacgtgtcttttttttttgtggacaacgtataacttcgatgtatgtactctatatatccccattgctttgttgtctccaaatcgctgttttgttgttcgtaccaacagttctacatcgtcctcggtcctgtggccttctttactgttccacaactgtgtcagtgtttatctgcctatcatactagtagtatatcaactagttcaccaatctgtttcatgtaggagacgcgggagcgattcgtgcagcatgtcggttcataaaaacactattgatcggtggctgaaggtattggcttgcttgttctgttttccactttttctccagtgaggaggaggggttcggagttttcttccccgaccaccagttttcctggtttgacgaggcagcagagcaccagcgcaggcagggtagtagcggctcgaacaccgtcttctcggctcccgtgtggtagagttcctcgccgccatacattccgcttacagcgcaacagatgcggcggctcggctgtcgacgcctcgacggcaagccggccgtcggcgccggtggacgggaggtggggaggagagagcaaccaaccagcagggctgctaattttctagttgggcctggcccgttgatctggatgttatcggcttgtttcttttgttcctttttcttgttttgtttatttgttagcttgatcatttccgtcgcgcggtctctttcgttattcgaacatctcgggcgcagcccacaaggcggataacattttattattccaaacaaaatagaaatacacaaacaggtcagcttattttcttgggctttttgggtttggccaggtgcccccatgatatatgatatataagtctaattggtaggctgcgtttgtttgtgggtttgggaatgatattttgagtagcataactaaacatgaaaaatgaattaatttatttattaaaaaattatataaaaagtttttcgtggaacgcacagtttagcaattcaagaaagtagcctaagccgagaagtggcttaaaactcagcctagtctccgattttaaatgtatgttgctgttgtttttcactttctttttaatctaagttggttagtttctaagacatttattcactatattctcgttgttaattgaatgatactcccctgtcccgaaacataatgcgcaactaccactaacacaaaaccaagaaaaattactatcactttcttgtttggatcacgtcaataaatataatacatgtatccaataaaattaaaaatcttaagggtgaaagttttagaaaagaattaaaggagagggggagatgctagttaattgcacgtatgaatgcgcgctttatattactatgaaacatcgaaaaggtggttgcggagtatattttaaagaggacggagcgagtattattttcgtgaaagaataggatctcattttcagtttcaatgtgcaatgaatacagagcaacaatgtcacgttaactgtttaattactcctgtacacatgcaagtctaaaacgacttgtatctggagagtattactacaatggagttatgacaaatttgtgacactcaatttggcaatttgtcacattcctttcccattttgctgggcactgaaatttgtggttggaaacattttttttttatcaatacacaagtggtagttcccaacaactgccccattatcttgacccttttttggtgcctaatacatatatatccaacttggtaggtttcagatgaaggttttcatgtgaaatcagcaatgattgttttatgggagtacagctcgtattgctgcttgccactcgagcaggagatgacacgatgcatttaactccacattattaattgggcatttgggcaacttgatttgggagttaaaataccggaggcccataatgagggagcaaaatgatcaaagtaatgccttggacgtcgtcacctattcccatttctgaggcgcagcatggcacttactaattaacattagcaattggattggtacgagttgaattttatagtacttcataagtatatttgcagcctgttgtatttttctactatatttggtgtgaaaaaaaaatgcgataatcagtatggctttttgcatctttaaatgcagtgatggggataaaaagagatcatcatcttcttctgtaagtcttttttttaaaaaaaatatggccaaatatgttaataagagcatattacagtcctattgttacaagaacgagaatgtaaaatctgttaaaaataaaacgtagagacaccgcaccttatattgccacaagacatgcaaacacacaagtacaactataacactgagtcactgaccaaactagggtacatgcaaaacctgcatactccctctgtgctgtaaaaacctacacagaatttgatttttttttttacgtaacagatggagtataaatgatcaaccacttctcccttttttttctacgagtctcagtaagcacatcagcaatatatgcctaaaaatttatctccaaaattttgttttcggattcttgaggtgtaagattcctcttttcaatatatatatatatatatatatatatatatatatatatatatatatatatatatatatatatatatatatatatatatatatataagttgactcataataataataaaaagtgaatcaaccccaaactaccaacagaaatagaaaaaaaattgctcacccccttcctcagcgagcacgatccctcccctcctagcgcatgatacctcccccatgcgtcactcaatcccgtgcatgggaggcggattaggaacctgggcgctttcccactagtggagagcaagaatgacgagaagggtatttttaattttggaaagtaatcagataaattgttagagccaaattttttattaaaaaaatattaaattttaggattaaaaaccatattaaacatccattggcgatgctttaattctctcctcaaagaaaactgcaagtgctcttctactttcaagtttttagcattattaaaggctggaatgttacattccattatcttaaaaaaaaaagttcagcattagctctaggggtctcatattttcgcttatgcttatgtataagccaaaatttgaattttcaattttaaatttggagttaattttggggttgcttcatcgaagtttatttttcagtttttactttaaactgctaagaacacacacacacatatatatatatatatatatatatatgtgtgtgtgtgtgtgtgtgacactcatatggggcactatggtgcccgggcaccatggtatctaatgcacaaagtcacttaaattttttaaattgtgagtatatacctagttataataattcgatccatacctatacctatcaacaaaacaactcaaatttaactttatttcacaatccatgattacatacctaactaattatatgtatggatgctatatatctagaatcaaaatctaacgaaaacaagttcaaattcagttcaaacttactttgaactagttagtaaagtagttaatgttaataactaagtaattgaaaaagtttcatactcatttgaattgggtatatactcaatttcaacaatggttcccgggcaccatggagcaccaaatatatatatatatatatatatatatatatatatatatatatatatatatatatatatatatatatatatatataatttataaattattttcttatttgtaaatatgccatgaataagccaaatgatagggcagcaggacggtaaaccacatgactgattgactgcaagagcacacacccagtaaaccaccgaccaaatggtagaatataatgtgatatactagtactagtattgttctggagagaagctaacaagatagtagttgttgataagcagtcacaaaaggacatggaaagacaatggtccaagcatgtagaagcaactcagcaacgtctctctgctaaaagacatgctttggttgtagtggtggcttaaactactgctcagatcacttggactgctcctcatcatcaaccattcaaccctccaactttggacgtattatgttcagccgcacatatgcagggttaaacccttaaaaaaccggagacatgccaacacatcgaaggtgacggctgcctccactctttgctgagactaatatagtatattaggaccttctatccaggataatagttgacctgttccctccaactcttcacttaatgtttttttttagtttgttcttctttttccaagaaccttttcttttgaaggtcaatgggactcttgaatggagattagttagacacttgcatagcttaaggatattgttttttttggggggtaggatcattattgtgagatgctatatagctttgaccatggtcttaattagctctataatgcatcatatatagtgcacttccccaccactaagcaaccagtttgcagaggatagaaattgtttccattatccaaatcttctttgtttgtagtattaatgtaaagattaatcaaactctgaagcattagaacatatggattgtaatcatatcaactcgcgatgttgctcaggaaaactgtaccaccctattccagaagctagactattctgattgtatagaatcactatgaaaatgtacgaatatccgtctgggggagacctgtcagcgcaagtgcgcctatgtagaaccaataaaaaaaaccctcattcttgactaggggcttgtttagattgatttcatttcaaaccctatcattttttcggtaaagttgtcaaatatgtgcatccattttgtttcttaccaaactttgataaatatataagaaatcctaccaaaattttggtaatattgccaaaatgccagtaaggtttattttggctacaatctgaacaacccctagctttttacgagtaaattcactactatagaatttaacaaattgagaaaagtagtatttccttcgacgaaatctctgagataaatagcggagggttagttaacatcaccaaaattaggataacttacgatgaataagactagtatattgggaacgttggctggcagctgtggtgaggacatgttaacatcactgcaatttacaatataaatttgtcattactagctcttcatagtgctaaacttttgatatccagatcgatacttgatcgtcatccttgagtcctgtcaattgagttaagtaaaaaaattatatatactccttacatggatgttcgtcatctcccacattcatgcatcgatgcacaaaactacagacacttggcagataaaattttcattaactcaatagacacatgacgccatgatggtactgacaaaaataacaaacaaataaaacatgggcaaatggaataaactgcagtaggcattatggccagtgataagctcatcatccaagcacacagccaaaacaactcacaaaagaataccaactttgtatatcttaacatttcttacataacctatcgttttaacgttgttgataaactgtctgacgcatgctacattaataatcgatacagacattaactgcaagagaattttagttaatagtactaatttctagaagaccataaggctttaattctattggtcggcttcggatagatctatgtgacaaggtcttttgccaagtggaagacacacgctacgtggaatatacccatcccatacatacgttttagctatgtgcattgcattttgctgtggctagttgcactttaataaaacattggcttgcgttgaatcagatcgcaaatgatcacaaatgtgtgatttattctgacgatacacgatacatatatatatagttatatacccataatattcagagagtaaaatgatgctagtaatcgacgttgatgatttccacaccacaaaagggataaataattaaggtattggaagcaagtggtatatcaatatcacccttccctcctttctctgctactaggtacctagctatataggctgggcctttttatccaggattttgtgctttaattgatgactatggttttaaggagacgtggcacgtagaaataaattaagtggagcggcgtaagagcaagtttaatagtatagcccactactagctccaatttatttatagccaatctaatagtcaattcatacaatagttacttactatattattaatatatggtcccacatgtcatacacacattgcgtcttggagtccgtgctacagctagctacagatctgtagcccactactcttctctcacatcttttatctcattaaaatatgtttatagctgactaatagtctgctattgtacctgctctaatagcactctccatgtatagtactccatccattcctaaaaactttcgcggttgatcggcattgttttgactttgaccaccaataatattttttttagatggttatacaatgatgaacttaaaaaactcaagcttatgcttaggatgcaacatacttggtacgccttctttccaaatttttataaattctttggaaaaaagaccgagtgctcaaatttcgagtaacaaacactccctatgttctaaaatataagtgcttctgggagttttacccaagaacaaggtatatgcctcttgttaaataaggcatttgttgggggtaggagtttagtaggggataagactggaagtaaattgaatgagggtgattattgattggacaagtaatactttataagtgtttacattttgataaaaaaattaattcttcaagtgcttatattttaaatacaagaagcattgagattattatctaaaaaaaagaagcattgagattattcagggcagtcataaaaggttactgttgttttacctaactcatcgttcgctctatgacccataatcaagtgaaaaatgaatgaaataatcaaaatgctttatatctatgacttttatatatgtgttttcaatgatttgaaaactaatattgaaaaataaagtacgataaagaaaaccttaaaaccagcttcaaattttaagtttcgaaataaaagttttggttatggctgacaagccaataagaaaacaacgagtgaggtaaatgcatcaatagtctttaaaatgcaacatttgacaaaagaaaaaggaaaaaggaaatgcaaagtagaatcatatcctatgtgtaaattttacaactcctggatttgtagaacttttcgcctaaaacacatgattgagggcaaatctttccaagggacagcatgggctgtgtcctgtgtccaactcgttcctgcaccaccgcggcacacacaaggccacgtcgacgtcgggacccatgtgggcgcggcgcgtgtggcgttgccgcgtcctgcttagagcatgtacagtgacacgctacaagccagctataaacatattttaagaagataaataagaagagagaaaagtagcggactacagatatgtagccaattgtagcacggactttaagacacagtgtatgtataataggtgggaccaaatattaatagtgtagtatgtaaatattatataaatgagctattagattggctacagataaattgaagttagtagttagctatagtattaaacttgctcttaattagcagcgacgatggagcatgcaaacgtcgccgtcgccgtcgtcgtcgtcgtccgtctttatcgattgatctccacttgaaaattaatcagggatggctgcaccgccgcaggggagaaggcttcattaattaattccacgtcgaaattaatctcaggttgggtgttaacttcggaagttggaataatcctcctgtgtagtatgtacatggaggatgatggacgccatggtccaatgggcatcaatgcaccgccatgcatggaccggcttccatttgcatagaaattgaccacccaatccagtgcacatccaaggaaaaaaggcatgatttcgtgtcaaatcctagcctgttcaaaattattgaaaaaaaaaggggcctcagatcatttaccccgaatcatacttcggctatgttttagaagcccaaaattataagaaacaacggacgaaaattttagaaaacttgatttttccaatatctacctgctaaagttcatatgccgaattctagaattattgatttaaaaaactactcctatataagattctaagctatttggagaactggagattctgaaattgcgagatactcactccgttccaaaatactccctccatatacttttgatagtcatatttcattttagcacacagactaaggataagtaattctacttatcatccatttaaatatgctactagttattcctcgtaaacaagcgattcattaatatttacatttctcgatgcccatgtagccaatcctgtgtggaagaatggagagtcacgcattaaatccgagaaagtcactaagagaataggttttggattgtaatatgcctataaaaatattttttttcagatttaaaaatatgcctatcaaaagtagatgaagagagtataaggcacaaccacccttaaccaaaagatcaagaaaaacaattattatcatctcttagtttggatcaccctaataaatactacctctatctacttttgatagtcatatttcatcttgacagacaaaggataagtaattctaattatcatccatttaaacatactactagtcattcctcgtaaacaagcgattcattgatatttacatttctcgatgcctatgtagccaatcttgtgtggaagaatgaagagtcatgcattaaatccaagaaagtaattaagatgataggttgttgaagtgaaatatgcctatcaaaaataaaattttcaaatttagaaatatgactatcaaaaatagatggaggaagtataatacatgcatccaatagaattagagatcttgagcgtgaatgatttaaaaaagtaataatttaatggagaaaaggtgctagttaattgtatgcatgtatgcatgctggaacatttttaaaaaagtagttgtgttttatattatggaacgaagggaccgagggagtatctaattatataaagtagggacaaagctagctgaactctaaattacacagatcaattagagcacacctcgtcggggtctcacgatcgatctcagtgcccgaactgctcgcttccaagttccaactccgcgcttcgcttggccaagttgggtcaggctccacgccggattttgccgtgtctgtatccatcacgcgacgcggtttgcagagcccaccaccggtggcggagaaccgacgcggagaaagccggttgcactcgcgctgttacctgcgcattgcggcggcctcccgtgctccgatccgatatacgctcgtctgatgtggatgggagatgcaacgacgtcgttgaagaggtgagtcggacaaaacagtactgttctgtgacagtttttgcctaaaaacttggtggttcggtatagaaagttttgctaataacattgtgcttgtttggccgttatttttgtggttgcgggtatagccgtgagtagtagacgccagggtttcccaaaccgccggggccggggttaccgtaccccggcggtaagcacagtaatcgcggtaaccgtgaaaaaccgtacaaaaccataccgaatttatcaaaaattcaaattatttttaaaatttatttgaatttaaagaggttaccgtggtatttatattaccgtacccccgcggtaaccatgcggttaccggcggtaacgtaaaccctggtagacatggcttactactctaaaaatcatagccgaacaacttttttttctttttgaacggtcagtctgattagacttgtcttatattgatagaagggagtttaagtacacacagctaaaggccaaaagaaaaaaaaagtacaaattcgagtgcaaacaaacttgcacgtcaactctccttacacctcatggcaacattctcctgatgtgctttatgccggtgagtcccaccatcccaactcctattggatgcgattgattatttgatggattgttgcctctttccctctaaagattcccacaatcatttttctccagatttcccaagcaatggcaagaataccgaacaacctcttgtccttgttgaagatacacatatacatacaacaacattcacttgcacacaatatacgtgtggtattatgaaatgcacaacacatattcgaggataatgataaatctgcgaactcactaaattgttattgaaatgcatccgcccacataattttactcttatataagccgtttatttgttttttttttgtttgggcacatggaattaaccagagtgccaacgacaggcacatggacgaccatcttgcgatcgaggacggacagccctgatcgagaagacatgccacatcttgattcgattccactggagtaagtggccgggcacatcaaaagggccgtaacaaatacgtatcgatttctgtacgtactggagtacttccttttggcgaaacaagatcccgatcaatataccctccatctttccgtagcaaaagaaaggtaccgaaatgtatgtgcatcagtaccatttcacacaaaattctcttgctgatgaacaacgtacaccacatcctcccagagtccaaactgtggccgcgatcgcataatatctggtgctttggtgcagctcatttttgtccggtgaggattctctactataatgtataactactattatagtcactggttgtgagtcatactctcttattgttcgatctacacgttagtgtctgtagtgatagttgtagtgacagtgatattatgatagaggatgtgaacccacttgtgtcgtacgcagtcgtctctgcatgcatccatcgatccttaataatcaacggacgcttttgacgccatgcatggcttttgagggattcgatcgcctaaataattggggttcgtatagatctcgatactgccacagattttcctcatttggttctaatcaagaattttttttgtgatgaaaaacagtgagaacaagttgattcgatatgagaatccaactgcagccgaaatatgccaacctaatggcaaaggatatgtgcagcgcaaggttatgggctctgacctataagcgcgtgcacagacgaggtatcggattatatttgtcaatccaacctttgcttttggaagttgataaaaaatgccaaccaaaaacttttgcaatgttctttgtttatactctagctttgatgctccaggtgcaagtgcatgaattcggccatgttcttttctgattctggattctagattttcatttgcacgcttctaaagctactaaacgatacgtttcatataaaatactagagtatgcaaatttttcatgggatactttttaaagcaactttttcaactctatagcagttaatttattcatctgtatatatcctcaaatggttaccataaaaatcaaataatccatcgatttcagttatcacaaacaagggccttagcagcagaatttactagtgtcacaatcaaaatgtcaaacaagccccaagtcctcgcgcatctcttccaccctttctctgtggaagaatgcaaaaggatttggcaagtatatgtaagaataaagcaggggtctctctcactcgcttgaagccaaccttcagaaagcagtagtattttagagggaattcatgtgatacgatgacgaaatttctcacacacgtaagtgacaattcaaaattagttcaagttgttcttgaaagggaaacaattcgttgccgttccaaatattacggccatggtgagctgacctgtcagttttctcgcttgatagcaacgcaacaatatatatgcatgtcaacgacggagtacaaaataatcacgtactcctactaactcttcctctaaagattgtttctcatcttatatttcgaaccttcctccgtttggtcatggagtcacctttcaagtgaccgagtcatgtgaccaagcaatgtgacatttccattcacctagctagagtcaatttcatggctcatataagatctccattttatacccacgaactcttataacactacatttatcccttaatatttgatgctgattagttcaaaacataaaaaaaatataggaaaaatagtttaagataaaattaccatatcaaataagggaatatttcctacaacagcaatggcattttttggacgttgctatttgacaaaattttgagaggagcgtaaaattaaggaaaaattggttatatagcatcgaaagttcacgttttttattttatagcaccgaaagataccggttcactttaatagcacccaaagttcaccctgttcccatttttagcacttccgtcaattctcaatcgttttccgtccgtcttgatccagccacacacacaatataatgtttctacccctcacaagtacaagtagaatgcatgttaatgaggggtagaaacgtcatatcgtgtgcgtagctaggtcaataacgatcaagacggacggaaaaattgacggaagtgctaaaaatgggaacagggtaaactttggttgctattaaagtgaaccggtatctttcggtgctataaaaccaaaaacgtgaactttcgatgctatataaccaattttgcctaaaattaatgatatggtctgctccttccatttaaaagtcttaagcatattttttatattttttaataaatgagatggttatatttatattcgagactgaaatgtagagattatcttttcataatgtcacaatgctaaattaaagcgcaaaattaatgttatgatctgctccctccatttaaaagtcttaagcatattttttatattttttaataaatgagatggtcatatttatattcaagacttaaatgtagagattatcttttcatattgtcgcagtgctaaattaaattattgatccgaacccaagtagttatcttaatatatatttatatgttgtatatattagtgtagctttttttaatttgttacatgtgcattgagttgattttttcatggttttgattatagaaaatgagaaaattgtaatattgtgacctaaactttttggatagagggagtatgaccggtgaaatctccaaaactactgcagggtaggagtactcgtagtacttctaaccagcctgaccacattcaaacgcacagtagtacagtacttggaggacattcaagtcacagtacacaaatgtttccagcacaataaaactacttggaacagtactgtgggcagcagctctttgcaggccgcaggcgagtacagatggaccctcatcgaaacgaaacgaaacccatgccaagaacctgcgtgctctttgatgagccagtcattcctcgaggcatcttttcatcagatcagaattcagagcctcgcgagaaagaaaggctggcccaatcctgcagctgcacagatcccagcagctgcagctgtagctgtagtagtagctgtagtcgatcgacagtgtccgagccaatccatcgccgcaaacaagccaaggggaagaaatatatatagccctggccacgtactacgtactagcctctgccgatctgccatgggcgctagtatagccatgtgaccgtgcgagagtgcaagtgatgggtacagacgttgttagcaccaatctgggaggcttatctccaaacccccaaattctctccattccattgccgtccgtcgtgtggctgccgcacgctggaggggcagcggcaatcgctagatttacgagggtcccacggcgcagtggcacgacgacgcagcaccgtccgggattttcaacggcacccgaacctgggcgtatcaatcgctttgtctcccggaaaagagaacgacatgggatcgtattaccccaagcgtcgccgatgatcgccaaaagtcaaaaaaacgtatcaccgtccaccgaccgaaccgaggtcgctaccacgtactaccagtagtagtagtagtagtacgcggactcgcgaccagccagccgctcgggttgtctcctctttttttttttttcttgccgggatgggagcgtgcaccggtggctgcactcaccgtcaccggccagtagtctaggcgccacacgaagcggcggcctgcgtcgccgaaaggcgggggaaaaccccgaaaatacaggagaattctgcgtttcccgcgggcgcgagagcccgcgaccccgcgcacggtgagacagggaccacgaccccgcgcgaactcccccttcaggtggacgaccaacccagcccagccagccgcgcgccggtttgtggctttgccgaatccaacgcttgcacacaccaccgcggcgccgtatgccgggtcccccacttgcattccacccggtcgtcgcgtcgcgtgatcgcgtcacgtcccggcgcgccaggatacgggtgcttggctccgcctccggcttattatttaagcacgcgacgccgcggccatgtctagtctcctcggctgctactactactgccgttgtgcgcacaatgccaagcgacccactactgccctgcgtctgcgtgtgccgcgtatacgcacaagccaaagagaatttttaggcgggtagaaacaaaaatcagacccagtttcgcgcaaaaaaaaaaacaaagagaagcccgggggtaagagagagagagagaatttgggagatgtgagacggaagcaacaagcacatgagcgttttgtgattaggaacggacaaaacaaggtcataaggcggcctaatcaggattggaggagaggtctagtctccctttctagtttcccctacatgaccagcgttgccaccaggattgccacgctcgtgcgggccgcggcggcggcgagccggccattgcggctccaccgccggcccggcggcgaggatacgaggatggtggtgatcgtcggcgccacgggcaccgggaagaccaagctgtccatcgacgccgccaaggtgatcggcggcgaggttgtcaacgccgacaagattcagctctatgacggcctcgacgtgaccaccaacaaggtgagcctcgccgaccgccgtggcgtgccgcaccacctcctcggagccatccgccccgaggccggcgagctcccgccgtcgtccttccggtccctcgccgccgccacggccgcgtcgatcgcggcgaggcggctcgtgccggtcatcgccggtgggtcgaactccctcatccacgccctcctcgccgaccacttcgacgcctccgctggcgatcccttctcccccgccgccgccttccgccactaccgcccggcgctccggttcccgtgctgcctgctctgggtccacgtcgatgaggcgctcctcgacgagtacctcgaccgccgcgtggacgacatggtggacgctggcatggtcgaggagctccgggagtacttcgccacgacaaccgccgcggagcgcgccgcgcactccgggctgggcaaggccatcggcgtccccgagctcggcgactacttcgccgggcgcaagaccttctccgaggcgatcgacgacatcaaagccaacacccgcgtcctcgccgccgcgcaggtgtccaagatccgccgcatgtccgacgcctggggctggcccatccaccgcctcgacgcctccgacacagtccgcgccaggctcacgcgggcgggctccgccgccgagtccgcctcctgggagcgcgacgtgcgcggcccaggcctcgccaccatccgcagcttcctcgccgatcagtcaccgccaccgcgcagcgagggcaccaacgactacctgtacgccatggagacggaaccagagccgccgccgccgccgacgttgccgccgcggctgctccggttgccgcggatgcagtactgcgacatggtggggtgagctcgccgccgccgccgccgccgcacggcgccgcagtcacttcattgaaggcttttgggggttcgagggtttaggccgccaattttccagtgtcccggcggcgcccttctctgacactgctcggtgggcccagaaaaagtagccagtgacatagaaagaagagacaaaggtaattaacgtagagagagagaagctaagctatgcaactgatgagaagtgttcttcttcattgcagcagaatttgtgtactctttcttggagaggtggtgattcatcacatcgctctcctcctaaccgcggcactgtatgtatgtagtgagtagtactaatcatctaattatccaccgtgttcagaattttgagacagataatgagtacagtctagtatatgatttttcatcagtgtttgttgcagtgcaacgggtgacctgctctatttccggagctgaattttttttggtttggttttgtttgttttgtttgtttaattaatcctcctcctgctgctgctgctagtagtagtagtttgaggtggctaatgccatggtggatgcttgacatgttccatccattttccagctggttgttgttgggatgattggatgggtaatgccacgcttagtgtgtgattactgatcgagggggagaaggattgtgttgggcgtgtgggttggtgcctggtgttcttgctgttgccagctaggaacaaacaaattcgtccccgtctcctactcttttttctttctttctttctttctttctttctttctttctgttttttttcttttacccctcctctccagttttcccgtacggtcaaagagctggaattcagtggcattacgattttcactctcttttggattgttttctttcttgtttggattctacagcagcagtctaccgcatcagattttcagcatcgttttatactgtcgcggacttcaggcattggatactcgcttccagaagtttctggtcatttttttctttttctttttcaaaaaaaattgcacttcacatggtcggttggtacgcgtatgtgtacgttgtatgcagagttgtacattgttttatgcgtatgtataccttgtaggcgacacgtccgacataagccaggctttttatacacagtcatcgatcacctgccctcaaatcgccatgattagcagcaatgcaagtactgtgttttgctcgaagcggttctactgtaatataatgtcgcagtactataccactgctctatggtactgtactccctatttcagtatactccagtccagtacttttgcctgtatcatcgctgcagtatacgaatgccaagtctcctggataatcgcaagtaagtagattcttggggacggctcggcccaaatagaatgcagcatcgcaaccctgcagaagcccagcaactgcagtcaagctgtcatacggctatttcactactcctttcatttcatcctaaaatatactccctccgtttcacaatgtaagttattctagcattttccacattcatattgatgttagattcattaacatcaatatgaatatgaaaaatgctagaataacttacattgtgaaacggaggaagtaaggaattataccctttaaatttatatgaaaatataagtaattttgtaatcccaagacagtactttattcctcacttatcatcttttatatagtttatttttcacttatcaccttttgtattgatgggtttcccgtctaatcacttttttactactttgttcttccaaccatttgtatcgtgatttgttcttttactattatcttaatttttgtaaaaacaaatagtagaatcccttatattcacggacggaaggagtacttccttactagtcagaagggattgaaccggactactagttgtggttaacaacagaatgatagacctgcgtttgggctccgtcatcattagctttttgcatttttacttctgcttattgaaatataattggccaatttagtttgaaaaagaaaaaagaactgacgagcaaatgcaccgttatttgagccaatagactgacagagtatcagacagtttaagtgtgctgggccgcgtcagccttggccaacaatttcatatcctctgatcgtctcatccaatagtaggaaaggatgttcacaagagtgttcaagctacgctctaactttaccacatgaaggattcagatatcagaactcgtcactgtttcttgacatgatcaaatttcgtactgtgcaatatcacttccaggctttgcctccggcctattttgcaggattgctgtactggatgagacagtcaaggtatgggccagactaacgaaagggcctctcagtctcatccccagcctttcatgtactgcaatgtggaacatcaactgtaattacagaacacttgttgtacatctgagggaatgttttgtgctgttcttcccaatccaattgcaggagttagatatttggaagcttaagatagtcaatggatttctaaaaattacaatgtgtctgaaagattggtcaggctatccccttggagtgtgatcttgatgtcgtgtgctgcatgccacacgttcagagaaacattccccatgttggattttttgaaggttctcacatcaccaaatgaggcattcagaaagtacagtaaagtcacatctcgaggatgacaaaagacgttcgaaggataattgggtagggagttggcacaaatgtacactatctcatcaacgcagttctgcactagtttgaacaaacacactctcttgtgcgattacaacaccagcgacatgtccatgaaaaagaagagaacggacacgtccaaaaggcactcaacaatattgctttcgccaaaattcatatgaattaatccagcagatattttaaacatgatcagtatataggtatgctaataattactagtttcagttagtcagtagccacaagaagcaaatctggactatggagaactggaacggctggaagggcgcactgatcatgcatcaagccactcaagagtgaagaacatcatctagctctagccaaacggcactacctgtcaggaacaaagcctggagatactgatggttcagccaaaaaagataagcattttacctgaaaaataactcataaacctaacatggaatttctgaaatttgatgtccacaggaccacagcagaagtaaaatgactacttgtaccaccattctgcgtctgcaagagtaaaacattgacactacaggctggatggagacccgcatcagacatataatgcaaaccactggaaccaaatcaaccaattatgtgcaacatgtaaaattgtaaatcgtgaacatgaagcactattaagttttaactcttgatttacaaaataaaaaatcaatcataggaaatgatcagacagacaaaattgaagtcccagactcacctgcagcctaaaaacaccagggcatactgtcaatcaaataatccaataacaccagctccgaacacaaccgtgcataacttaaaaacctgattaccgactcaccatggatgtcatcagaatactaaattagtgcataattagattgctaagtgagtatggaaaaaggacgcaatgcaacaatcaagcagtctttcagctcctgcatagtgcacacaggtacacaactggtgttccaaatgtcaagaacgataagcagaagttcaaattattaatgcacttagcaaatcgttctaataagcagtgtcaggatatgactagtgaacacttcgtctcctccaaaagtgcaaaacagagatcagacgaaaaacagaagtatcagcattcgagaagcaagaatgatgtgcaccagcttttgcaaacaacagaatattgcaaaatgaacaaatatattgaacaaaggtatatgtaaaaatgaacaactaattctggaagaggtaattaatgccagctaacacctttcttaattgaaaattggcaatgattttgccgttctgttaaaaaaaattaatgcaagctatacttacaagcaggagattataacaaagcgcacccttgataactagtttgatttcctacctgaatttcactagctgagatttctttttctcttttcaaaccactttgttgcaccccaagtacactttcattttcttcggtatcaatgtccaactcaagacatgatatatgccctgcagagaaaccaaagctgcatctttttccctctatctatgcaatgcagaaagtagagcttaatacaaggaaatatcatcctcactaacactacaaaaccacatagtgatatcacagccaacaacttgcagagttgaagcgatttgcaccgaaagaaatatttcacagactgaaaccatgtacataacatgacagctaaccaaacatcacaccacatatgccacagggcacaaacatcgcatacgattccacctttcttctaattagaaaacctattcacaatcaaccataaaatctatatccatcctctgatctagaagaaccaacataattattggatggacatgttagccgtcagaagaaaaaaaagcaaaacatgggaacatctgaaaagttgctctcatttgcagacttcaccgcgctggcgccaatcacctctgcaagaggaaaacacacatgaagaaaagaaccaaattttttgggcgaaggaacacatcaaacgtatcgagcgatatctcacctcctcgacgatcttgtacgaatccaggttcacgtccgccagcgataatccgggatacagccgctgcaattcgaaccaaaaccgaacaaaaattgagcaccccccgatcgagacccaaaaattaggaatcatgaagcgcacgcggaggctccaaaatccttacatcaagctcgagccgcacggcgcgcgggcgcttcttgggccggcgcggcggcgccgtgccgcggatggcgatgaagtcggcgacgatctcctccctggtgagcgcaacggagaagcccctcttcttggcgaccaccggcaacggcgcaggcgggtgcagcagcgcctgccctcctcccgccgccgccgccgccttcttccccgcggcctccgatctcgacgcgtcgggcgccacggtggcggagcggcgtgtgcggaggttccaaggccgcgacggccgagaggcgccgccagcggaggtctcctgccccttctccggcgacggggtgtgcggctgcttcggaggcgaggcggaggcgggagcggagtccccgttcttggagcagcggaggaggcgatgggtgccccaaccgaaggtggtcgggaaggagaagctgtggaggcgagtgcgggtggcggagccggccgggggagccgccgagggggaggatttcgcctgcgccgtgtggtggtcggaggcggcggcggaggcggaggcggccatgaggaccatgagaagagggaggtgaggtgaggtgggtgcgaggagggaagaggaagaggaagccggaagaaagagagaaggcgagggtgatgttgcgggtcaggttttaaaaaagagagagggagagacgagacgagacgagccgagccgtgggcgtgtgggcgtgtggcgtatgcgttttttttttgggtttttccccgtctccgcgctcggcgcctcgtgtgattctgacggatggatccgtggatgggtaagcggtggcggaggcggtttttgggtgcagcggcggggccgcgattttggtggtgatgcgcgccgcagccgctgcgtgtgcgggagcgcgtcgtgtgatcgccttggggcggcgcgagcagggggcggacggcgcgcggccccgtcggcgtcgtcagaggttcggtggttttcgggttgctcctgctgtcaacgaggtacgattgcgttgcaacagacggttatctgacttattgcgcggattatcttacgtggctagcttctttgtttttattagggacgttcggctggcttgctgtacgtgacgtatatgtttttcttttgaatagcgcttagtgtttcttcttctcttctataaaatacttactgttaatagtttggtatagtgttttctatattgtataaaaaaataataaatcatggtaaaacaggttttcccgcgttttctttttcaaaacaaagtactaccttcatcccaaaataagtgcagttttgcactatttgtgtctcatgtttgaccattcgttttatttgaaatttttctacgattaatatttttattgttattagatgataaaacacgaatattactttatgtgtgactaacttattttaattttctcataaaatttttaaataagacagacggtcaaacgttgaacacggattcctacggctgcacttattttgggacggagagggtagttcacattacaaatacaacttacgagctataatgcctttatttgggtgagatcaccattcccgtaaaatcttaagcaaaatatggtgttctaaacattagttgaggagaactatggcaatttaaagtggagatcaaaatgagttcacggcaagaagctaacaaattaagaaagtacagcgcaccatagttgtcaaggcagacttaggccatgggcaatcaattgggtcacggtctggggccccaaacctgtggtaaacatataatggacaattatagatttttatcgtgtaaaacagatgtgcagcccaacatacataatgggccagccctagccttagtccatgttggtttcgctccctaatggttatgggctatgaatcaaatgttgcattgtggtgttattacaaccattttatgttattagctaaaagaatgtagttcttgttgtaatggagctactactatcgatgtgggtgttgctataatacactcatcgtctcgatgctatgagtcgctatgcgcaacactcgtgatcgtgtcattggcatcacgagacatagggccttttcactttgttgcccaaattaaccatttcaaattttggtaatgccaaattttaccacattttggcattaccaaatttttggtagaactagctttgtttggtttgatgtatttgccaaattttgtatagttctaagagaggaagcttctagaactgcagaaaaattggtaaagtagtaatggttgaagtatgtttaaagtagtaagaaggctaaaagtggcaacaaattaaacaagcccttaagtttttggttctatagtctagattgctttttgaaaaaaaaaatcaagtcaattaaaaaatatgccatgcaaaaaattaacaacaccacacagttttggtgacgacaatatcaacaagcaccttttgtaatttaggtgttgtataagtttttgtaaagaattctttaatttgcttatgttacttttatggaggattgaaagataaggatagaagtcagacgtataaattaaagcttgtaaggatgctagtttaggtaacgccacgctagagatatattggaagcaaataaaagcacacgtcatgtatctaaatgtatcctagagatgtcatccttttttgttctttttcttgtctcgttgaattcaaaggtaagtgttcatcatttccgacctttacaaaagcctaccaagcggacaacacagatgaccgatggggcatatgactatgtatgaagaacgtgaacctttgacaagttttgcctcttttttttttgaaaaatgaagtaatgttttagtgatgccagtttctactgttgtcgagatggtactcattgttacactatatatatactccatttcatagttacaagttctaatggcttgttctgtgaggttagaactcccataaagtcttaagcaaagtgtggcgttctatactagcaaatgtttctttagaacatggtaattcgaggtggagaaataagttcatgagaaccaggctatgttgattaagaaaccgtagtcaatcatggtttgtggccatgaaccaaatgcttcatcacaatgttaagagcaatattcttagccattttatacaagcagtagctaaatcaaagttgttcatgttgtaatagagttacaaccgaaaagatatggatgttgatataacatactcaccattctctggctatgagttgctatgtgtaacacatgattgtgcctatgacatcatatcttaagttttgattgtacaatttaaattgttttttctttaaaatgcaatgcatgaaagatgtggcaccgggcagttttggtggccccaatgttgactcgcactttttgtaattatgtgttacatggtttcgtaaagagtgctttaatatttgcttattttactcttacggacgtctagaagataaggatggaagccagacacgtcaattaaagctcgtagggatttagctcagttaacgccatagataaattggaagcaaataaaagtacacgtcatgtatccaaatatatcctggagatgccattcttttaattccttttcttatcttttagaactcaactcgaaacgtaagtgtttgtcgttccagcctttaaaaaaggctatcacgctgacgatacaggcgaccgacgaggcacgtgacacgcctacgaacatcataaacctgatacggatgcatacgtagacacatttcgtctgatttaatcttatgacaagaaaggtaaatacatgttcatactactcacatgtctcttacatactacaagagcaaatatctccgatcttttttctttaacaaagatgaacataaaaactggtaaacaaaaggagagagagaaaaaaaaaggcaaaataaaccggtgtgggcaaccccttcctcggccaccggatcacaatccgacggtccacacgggccatgtggctcgagaaacggggcaaatcggcgaccagaatccgcgggggcaaccgaaccgaactcccgcacggaggcggcgcggcgcaggagcacggcggagcggagggagtcggagtcgcgtccaaaaccaaaaggaaaccacggcattttcctcgctcccttctcttcttcctttctcttcccccacccttctctactctctcttcttcttcttcattccaatcgaagaagagaagcgaagagaagagggttaatccgcgctatatatagccgcctcatgcaatcgcaaacctaagctgctctgctccgcggcacacaacacgcattctggttaatcccctctctttgtctgcgcgtgtggttttcttgccaatggagtcctcgccggcggcgacggtgaccccggctgccgcagcaatgtcggaggcgccggcggtggcggcgccgaggccgagggaccctgggttgttcggaagcttcgacctccccgccgcctgggggtgccgcaggcccatggctttctgcagggaccttgacgccgccgccttggtcggctccgaacccaacgccgccgccgccgccgctgctgctggagacgccgtggagcccaagcgtaacgcctcccgatcgccgcccaaaggaggcgacgctcctgtggcggcggcggcggcgcaggaagctccgcggaagcagtggaacctgcggtatcggaagggcgggcgggacggcggcgaggacgcgctgcagaacaagaagctctggaacatggaagccgccggcggcggcggcggcggcggcgccagggcgagccgcgggttctcggtggagctgacgcgccaggagatcgacgccgacttcttcgcgatcaccggccggaaggcgccgcgcaagccggcgaagcggcccaggagcgtccagcgacaagtcgacgtgcgtgtgcagccatagatggagcacgatttcttcatccgccacccacgaattctctccttcttcttacttcttctttcgattgctgatcacttccctgctttctcttctccgcagtcgatttgccctgggaactcgctctgggaggtgagccgcgatcgctacaaggtgaacgaggtacgcacaaaagtccaaatctttcatctctttcgccactggttctgggagatttcgagttggtgaattcgattctgattcctgaactgctgcagaaggggggattctgagttgctccaagaaggaggagatggattttccgagaagcaagatcaaccattggcttatcgtagttatagacagagagagattcagactgtcagtcagaattgtttcagtgcatccatgcttatgctgttgatgatgaatcttgtgtagttttttacctgactgttggggttttgcttctcgctttcgtgaagcctctgcaaactcttctttcttttatgcctagttcggaaacagttaacagaaagaatttcaaactcttgatttctggatgtgagacatggatacatgataggttcttcgttaattctgggtggtatgaaatctttggcattggcttcaatccggtaattctgtgttgcatctcgaattgcagttgcagttcctagtagcttaggagtagaacttaaccaggtttatttatcagttctctagtttttgccagaaacacatatcgatttcttccatgtcggtcttccctgtcttttcaggtattgtacatgtctttcttgatttttttttatggattggcttcctgctttttatcagtatttggttacttgaccattcacttcagactgaactatgtttttgaagaaagcagaggattcatgctcagaaactgaagcagaatcacttgaaatgaatgttggattcatgcgaactcaggaccatttgactgttcaaacagtactccagattcatgctgagacttcagaggaaacatttacccaatcaggaaaaaaaacgctgaggtttcagaatgtgtaaacagttccaaggagaggggaaatgacatgagtaagtccaaacctcatgatttgccaatcattattctggtgtactcgaatgttttgctacctttggtattgattgctgaaagtgaccccttaaactatgacattacagatcctgggttttacaacccttttcctttgtcaactcttttctgtagttcacttttatcatttgtgcttgatgtcatagtagcacattgatcttgtttggatgagctcaactgaaaaggagtcaacgtgtcccttggacatttattttttgttgcaacgatggccttgataagctagttgtgggggccaatatatgacatgcgtatgcaatattgtgaatgtgtatatcttatgatggtactcgtgatcctaagtcatgatagtacagaagagattggctaaaatttatgagtgcagacaaaatttaatccttgatcgactctaattagttcactttggactttcggatggttttttaagggagtgaaagaggggcagtttaggcatagtccttcaaacaatttgaatgtaactctccttttttttttctatgctagaaatgtgttttatagctgtctagtgtagtctttctatagatgatattcctacgtcaacagataccctaattgttgcatatgctcttatgaattatctacaatggattcacaattcactctgttcctaaatgttgtttatgagatgctgcttgctaatattctattacatgctcgctacagcggatgaagcttccactagcacaagtgcacaaccgcacccatgatacacagctcttcaactgttcatgtctgggaaacatgtgctcctcctcctcatttcctgaatatttcttctcatattttttccaagagaatatgcgggagagttgcgttatcttggacaaacagatctatttcatttattcagaattaaatcaagcagacacttgctatccctcctttaattgatttcaacggtcctcattcagaaaaagatttagacaatttattgcctgcccatcataattaagctgagatcctgcttccaaacagttctttttcctctcttcatttattctacttttttgctgttttgctgccgatgagatcggaatgaacgattctcctcatgctgctctgcattcatccaaacttccaaagtaacagtattaaagtaattttactaattctttgtttcatattacatgttattttgactttaattaagatagataaagtttatagaaaattttagcaacatctacaacaccagtttagttttatagaaaccaatatttgatacatttcaataatatgatatgtttgttttgtattaaaaattttgttgtaattttttataaacttgatgaaacttaaaaatatttgaatagtaaaaaagtcaaagtgacttagagcaaccatactgttgcaaaaaagtagccttaaggtctttaaggtgaaccataacaattatggtattgaatatagtctaggccacaacaagaaataaccttggtggattagttcttttattatagtgtgctatctttatacattgtgaaaattgaaataacaagagtccagttgtgtgagttctattttatatgactagttggtccatatatattggtgatgtactaacaacgatggtcaattgctatagggtccaccttaatgctatgttgtggcaataaatattgaccttgcccttataatatgaaacggatgtagtagcgctagagaccatttggttaagtttctcatacaccagaaaccaatattcacaattggaaaacccgacacctgggtcggtgcttgcgaactaaatgaatttccaaaaccgcggaccggggaacgtaccgggtgtacgatttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtttgtcacaccctgaagttctcctcctaagcctaaaattgaattaataagagaccctaagaaaataccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcgagcatgcaatattttaaatcccagggaaattcttttcctccttttctttttttttccttttcccttcttttcctcttcttgggccgtcggcccagtccaccccgccgcgcgcgccctcctccttgtgggccggcccaagccgcccctccctctctccccgggacgccgacaggtgggccccacctgtcgggcccgtctccttcctccagccggcgccaccgcgcccgctaccgccgccgcgcccacgcctccgcctcctccgggccacgtcagccacgcccgcgcgtgcgccgcgtcccccgcgcccactcccctctctctcgcgcccgcgcccgcgcccaagatggccgggattcgattttcgaatcccgcctctctctcctcccccactccccacgttggccggcgaaatctcgcccctaccggccacgtccggggctcccctcccctatttaggcttccccgtcgccccctctcgctttttccccatttcgccgaactccctcgtgctccccatcgctcccgcgccgtgcaaccacccgccgccgccgtttccgttactccggcggccgctagggttgccgccgcaccgcgccgtcgccgccgtcgggttcgcgagggtaagctccaccccggccgcccctttcccgttgagtttcgtcgccggaattcgcatcccctcgcgctccggtaagttcaacctctaccgccgccttcggccatgaatgccggtcgccgtggttcatctccctctctctaatctctctctctcttccttccttagggcaccccgaagcccgtccgccggttgccgtcgtcctcccgtggcttgccgtcgccgttcgccgtcgtcttcctccgcgccggccaccctcggtgaggcttcctctcccatctattcccctccctctccttcctagccgccgcttagcgccgccgccttcgcgtcgcctttgcgccgtcgcctccgccgccggttgctgtcgccggcaacgcgttcgcgcgcgcgcgccgtcgccatcgccgtggccggtgggccggccttgagccaagccgagccgggtcgccgccgcccatccgatcaaccccgagggtgatctgggccgtcggtcccgtggaccggcggtggaccacccgcgtggtcccggtccacggtgaaccgtttccccccttgagtcgctgccgagtgggcccgcttgccggcgcccctttcctccctctcccgagccgctgaccggtgggccccgcatgtcggcgccgcgccttctcccccccgtgctgacatcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgtaatgtttaccttgtatgtcgctagattccggttcctccgacgctccggtgtacttcgaaatagtcgccgaggttcctccagcagcagagcaaggcaagtcatgcttgtcacttgaacatgttgatcctatatcgcaaatgctctattgttttccttcaaatattgcattgttttataatgtttctatggggtgtttacctattgtcatagccatgctattgttgtaccatgtctctttgtcagcttggggttataacatgactagagattggactagggattgcttagccatgcttagttcaactagtgcacaatggggagaatcctattaatgtttagactgttggttctaatggtaatgttggattagtgccaccgctttggtgttggttaattaaaataaatcacatggtgggctgtgggtgcatggttttgctggtcgcaccaatggcagttaaggaccggttcgcgggatgccctggaagaacttatcgtacttaccacaagccagcgtgggcaacggctgggcttgtagcgtagctttcctctagccgacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtggcatgtcggcgcacggaaacgtttcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatggtttagttggatggttgggcctgttgcaacgtgggatagcgttggacagtggatagttaatattaattaattattaccactgtttaaatctttcaacttctgcttttaaatgctcgctttatgcaaatgaaccactctagctcttctttgataattccctgcatcatacccctattccggtatgatttgctgagtacagtgggtagtactcggtcttgctctacttttcccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttctttttttccgctgcatttatgtaagacttttatgatgtttataagacgtggatctgaatgtcaacattgtcgtttgtgtaccccggccggtcctggacggggattttaatgcacattctgtttggaattctattcgggaatttctgggcgtgacatgtcggggaggacccctgggcttcctggcacagtatggtctgggacctaatctggtgttggtctgggactcctctcgttggcatatggtgaacctatgtcggctttcgaaatgccttgtcatgaaagccttaaggtctctagtcgtggccgttctgcatggactggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaaacattgcacatactccgaccggacgagacgcactgtctcatccgtgtcgtttgagaagcactcccttagttgtttcagaaaagagtttaaataaaatcaatcgcaaaaacaacagcctttctttgaagcctgcattaaacacttatttcccatggcttgctgagtactcctgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtgtggtccaagtcttggcttccgtttcccttttgtaatgcagttgtgagctcgggatctgtccgcagtccaacatgactgtactcctactctataataaagagacctctgttgctgtgatattctgtcttcctgtgataccagcactgtttcctgggactggtatcgattaacaggttaatttggagcgtcacgggctagttccgctcgggactagttcggggcgtgacaacaatactgctacgatacggtaacggtaaccacgtggtaactcaccaaattcaaacattttttttcaaaaacaaactcaattttttgataaatcttgttcagtttaatgtgagaaaaaaaaagaaaatgagagaaaagagaacattttgaccagagatgacgcggtggccttgcccgggatatactatccccgttgaccgttcctccttcccgtgcacgtgttagtatttcaccaacgaacatgcaattcgccgatcgcccaaacaagccaaagctttggaaggttgacgcttccacaattcaccaccatcgcgacgacaactcgcacccccatcccataaaacctctcgtacgcgacgcttttcttcccttcaactcctcgtttcaggcgatcgatcgatcgatcaaccggccgtgcggctgtgctgtgcttgcagattggtagtagtaaaacatctgaaggaattcgcatttgaccggagtacgatctacctgaggttagaacaatcctctcttcatactgagctactactagctggcatggttcaatttaagatactgatagtacaccacgtactcttcgaaaattactcgtgctactgttcaatcgggcaagtacgagtatagggagtatggttggttaactgatcaattcaatgatcaaaacatcactttcctttttttaaaagaaaatgaaaaaaaagactgcttctgattatgaatatgaacataatctatattttcttattaaaaaaaatgaacatagtctatatttggttttgtatttattttttatgaggccgagagtgtacagacccatcgtttctcttaataaacgaaacaacatttcgcttaataaacgaaacaacatatttgcaaaagaatagtaatttgtaaataaaacttttatatacgtattcgtagcgatctaaaagtaaaagctggaaaataaattttgatgaaaaaaaattcaaatttaaggttaataatttaaattttggttgacaatcataggcctgtaatctcattgcagtgtgactagcagtgacatgacaagcgtgcaaagggtgccaaaaagcttgtgtgacttgtgggcagcaacaagcaacaggactagagcatccaggagggtcggagtgcagctagcgcagtgcagtgttgtggctgctgccgctgtcactggccggtggggtcccgcaccgtttgccgcgccggggaaagagtagaccgagtccaggagcacagggccggacggcgtgaaaccacaccatcaaaactgacacgccgggcccacaccgaaaatccgatcgtacgaggacccgtgccgtgctgcatggacggacggtccggtcggtccctgacgcggtgggccccacccccaccccccctctcgccctcacggacatggctaacgccagtttccatccccgtttggtgggctggagattggcctcctcgcccgcgtggaccacacgtatcgcccctccacgtcgatgacttgtgggaccctggtgatctggggccccacccgtcggtgggagtaaaagggtaaagcgggtttcggatggcgtaaacctcgggcgccccgagtccgtggcatggaaatgacgagaatgccactcgggcaccacacgccacttcggcgctgcgagcgacggtaacaaaacgcgagcgcgaccccacctcctgtggcctcaaaaccttctctgccttttctctctctctctctctctgccgctcgtcgactcggccgccgccgccgcctctccgagcagcgccgccgcggctggtgaagacaagcagggccatggcggcgacggcagatccgcgggcgaagccgcccgcggcgacgtcgacgcaccacctcgagccgtgggggcagccgccgccgccgccgccaactcccgcgcaccgcttgccgccgacggtgctcccggtggtagcgttaccggcgggtggggacgccgccacgcgcgatcgtcgacgctcgtcgtctcaccgtaggggcgg

SEQ ID NO: 62042 - DNA, 698 bp, Oryza sativa
cctgcagcccggaaccggtaatccttggtaacacccaagaggaagtgttcggtgctgaccataaccccctacataaacaccccttggaactggaacgccaaagtaggacccagctgatcttggcctccctgaaaagattgtgcatgtattcagacaaatgcttacagaaatagaactattatcaccgcatgagcacttccaagaactgtttaaggtaccaaaatggtatattagtagtcatcgtatcaccattaggggtggcatactgtaatttgtagttttttgtttgcaaaacaaaacaagcacatgccaaacaccaacatcatcagtacttctgttcaaatgaatgctcagtatcattttagctcacctgtggtgttattttaagtcccaaacccacttgagaaggtatatagttgactgtacctatgttcacttgattatcaatttttcttctttccatagttgtcttattctaggaggacgagtgcgggtaactaaattctagagcaaacacaatgtagaaccgatcaaataagtttgcagaaggcaacacaatcataccacagataccactgcagtaacttgctagcaagcaaatcctcacggtggtatcaaaatgtgctcataatctactcgaataagttagtgcaaatcagtgtcaaggcagggagatcaataccgagaggaactgcagg

SEQ ID NO: 62043 - DNA, 516 bp, Oryza sativa
ttaaatttagagcctctggcgtggtttaattctcaacttttttttcaaacttttagacttttttatcaaataaaattttttttacacacataaacttttaactttttcatcacatcgttctaatttcaatcaaaattctaattttttgtgtgaactaaacacaccctctcggagtctcggagtttttgttgtgaacgcaagcggcgaaggcaaatctcgcagactgaccgctcaagctccgagccagcgaccaccaccagtagtagtactgttgcttgtctcgcccaggggtgatggaaataaaaggattaaacaagaggtcccggacaaggatgcttttcgacgcgtaattaaaggcctgatgagatgagaaagaaagaaaagaattgaaggcagccaggcaaaggacgtaaccacaatccacaagcgagcgaagcgaaatttcttcagatttcatatcatatcctgtctactgtagtagtatatcctacgtgcagtgcagcgtaggcccattct

SEQ ID NO: 62044 - DNA, 765 bp, Oryza sativa
tttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactggaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggt

SEQ ID NO: 62045 - DNA, 2204 bp, Oryza sativa
atactctatacatgtgtccaaatattcgatgtgagatggtgaaaaattttgccaggggatctaaacaggcccataattgtaggaaactgcaaactaattaaggtcactaaaggaacacaactaatgtctggccaggaaaaagggatgcaattaatgaaattaattgatgtctaaaaactctcaccatgctttgctgaataatactgtatagatttccatgtattacatgaaagtgaaactatctatgtgcaagaaacttctttacggaatattcagagcatcatctattattattatgtaacccctgctaacaaatttgacttcacaactactccctccgtttcacaatataagtcattctagcatttcccacattcatattgatgtctatatatatatatatatatatatatatataattttctatagatgctctttctatctgcattcttgatctttgggcaagtcattgcctgtacaagtgctgttgtgaatgttggcgcctgtaaaaggcccaatttttacacaacaaagggctcatgactgttggttcctgaaaaaaaagaccttttttaacaccaaaaggttgaatttttatgctctatcatgcttttatgtctgtttgcaaggaaacaattatagtaactgtttagattggtaggtttgacactgtttgatgctaaaacatattacgtgtgccgttcatatgcagggaatggggttttgagaagcttgtcttccgcaattcaattaccaaagttaggcgagatcgcaaatatgcgatccaggcccgaaacgcatactctgccggcgtacacatgtcacagaatgtctacgggaggacaacccataagacagaaagcctgatcagatactaccactatcacaattcgatcaatgtcatgggagagccttgtcgggaatttgtgccggtgccggtcaatggtagtaagttgatgttcgaggggatcccttacgtatacgatgataacatgaagcgtttggctgggcagatcaagcggtttgagaaggaagcaattggatctgctcatacataggcacatagcaactgaactactgaagactgccggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgccgaagcccagatccggcaagcccaggccggatctggccacctcgccgccactccgacgacgacgaccctgcggggctgcagga

SEQ ID NO: 62046 - DNA, 1794 bp, Oryza sativa
cacatcgaatgtttggacacacgcatgaagtattaaatatgtaaaaaaaaccaattacatagtttgcgtgtaaattgcgagacgaatctttgaagcctaattgcgtcatgatttgacaatgtggtgctacagtaaatatttgctaatgacgaattaattagtcttaatagattcgtctcgcaatttcctgacggaatttgtaatttttttgtggagtgtaatttgttttgttattagaccacgtttaatacttcaaatgtatatccgtatatcttgtgtgactcctaaacctaaaatttttccccatctaagagcaaggataatactgggatataaacaagctatatgcttacgtggaagagaaagataaataaaagtggagagtgttggctctcatgcaagagctaactacacacaagctctagaaatatgcattaaatttatagtgagagaaagagagaggacgaagaaaataaagataaccttagagcaagttcaatagcagagccaactactagctccagttcatctatagccaatgtaataactcattcatacaatagttacatactatactattaatacctggtcccacctatcatacacacactgcgtcttggagtccgggctacagctggctacaaatatgtagcccgctgggtttctctctccttatttaacttcttaaaatatatttacagctggcttatagcctgctattgtacctgctttaatatagccaacctactatacatgttaattttaacattgactaatagtaagtagtgagctatactattaaactggctctaaacaaggcctccacctgattgatatccctttgtcatcatttccaagagagaatttcttccacaaattaaacacatatagggacatagctgaaaatgccgtttggcaagagaaaaaaaaaatattttgtaacggtagtggtgggctttcacacgagcacggtagaccagcgagcaaagacccactccaccacacttccatattaccaccaccccccaccttctcgctttcctcttcctctccacttccatttccaagaatcgaacggaggcgtctcgctatcgccatcgccatcgccatgggcaggaaggaatcgtcgacgacgacgacgacgacggcggcggcggcggcggcggcgacgaggagcatgaggctgccgccgcagcaccaggcgctggaggtgaagatcccgagcttcttccggtgccccatctccctcgacgtgatgcgctccccggtcagcctctgcaccggcgtcacctacgaccgcgcctccatccagcgatggctcgactccggcaacaccacctgccccgccaccatgctccccctcccttccaccgacctcgtccccaacctcaccctccgcagcctcatctcccactggtcctcctcctcccccgccacctccggcgatgcctctgtcacttcttcccccgcgggccttgtccgccaggtcgcgtcgcccgacgccgacccttccgcggcgctgcgccagctcgcggcgtacctctcggacgacgacgtcgacgagttcgagaagaacgcgctggtgggcgccggtggcgccgccgaggccgtggcctcggtgctccggaggaagggcgagcgggaggtcggcgtggaagggtgcgaggcggcggtgcgggtgctcgccgcggtcgtcgcgatggatggagtcgaggacgcgaacaagaggcgggtcgccgccgggctcgccgcggccgccgcggcgtcggcggcgtccctggcgcgcgtgatgcg

SEQ ID NO: 62047 - DNA, 727 bp, Oryza sativa
ggaagcttttcaatctctagtagaaagcttagtctccaaaagaaagttttcagtaaccagatgaaagttccaggtgaaagttttcagttccagatgaaagttgtccaatcaaaggtttttagtagcatctttttttttttttgcaatgagaagttgaaagtttcccttttcgggatgcagaacaagaagggctacaaattccagggaaaggattaggggagactatgcacgaaaagctataaacaaatgtgccatgcccatgcgtgactgtgactggggagttcaagaaatgagatgcaagctgcacgagttggggacacaagaactggattgaggccttctgggtgctctcgtcttactattcttccagtgatgattttttttttaaaaaaaagtcctgcgtggctgcatcctgtccgtaactgatcatgacttttggcgcaggcgcgaattagacaggtcctaaaaggacagcatgtgttcatctaattattaaagatttacacaaatagggtgaatcccgttaaattgtacagtattgaactaaaatataaactgaattaataaattagagctcttattaaaaactgcactattagaacaattacctcacggccagtaccaccaggctgtggtaaagcagacaatggtacttgaagctggccagttcggactttgtatttttcatactcgagaagtgcctaagttaatgagaaacaaaaattaa

SEQ ID NO: 62048 - DNA, 1265 bp, Oryza sativa
ttgatcatatagaaaactttatatgatcttcatatttaatttgatgcataataccttactcttttaacatctcatgggtagatgttaaatgcttttaagcatgattgcatgagaacatagaaagaagcattggttatcattttatgtaatttactattccaaataactttacaaacttaggaatccggttaaaatgggcatttatgagttgagattatgaatgttgtgattatgaatgttgatgaagtttgtgatgctggtgtggggagtttggaaagtttttgggtggtttaaccggattataattacccccttataccatgggaaatgatatagttgcgtccatccacacaaccaagtaatttgacttagcctagtatattgtcccattatatgaaagactattgggtggctctatgagcggttttggggtgaacttacgtaaggagtttgggcggcagtgtttcacaacagtgggattcatgaaagtgtgacgatatagataccttgcctaggcctagcaagagttgaccactatgatgaaccaagaccccactgtgcagtaactagtagtaagtgggactctcgaacggctatgttgtcctcagccttgcaaactgttgacatcgtgcgggtaaaactggacagtctctgcagaggtgaattaaatcattcgaatgtgccgtactcccggttctggagttgtgccattagggtgattcctactcctgaagtataagtagttttaaaaattaaattgttgaggataaagatgatttatggttttcattactcctttactttattattgtttatttattcatatctattcatctttaattatttataatatgtcttgctgagtacatatgtactcacccttgcataatttgacatatagaggaaacgtgctaataaggagatcagaaggaagcgagatctacgacaagaacgagtttttctaggctagtctacactcgagtttttgcctgtggagttctttgaagttctttggaatttattaattgtagttctagtagttgaagaagtttagcagtttagtactttggattttcttgtatttcaaataaggatattttagtttggatcttttcaccctttaacagttgtataattagcttgtatgaacaaacctgtgtaaataatcgaaagctgttctgtatatcaatctatgcgtgatcgaaatcctgaacgatcacgagtgaatttttggggcaccaagcctaaattgggtgttgccacac

SEQ ID NO: 62049 - DNA, 4358 bp, Oryza sativa
tagtatttgatacagtaacccacaccaatggctatatataattttattttctccgtcctaaaatactatatagccattggtatatgcatagcttgtccagatttatactattgtatacgtcctaaaattctaatcaaacttcactgtattttgtattttgagacagatgtagtattatatatgggacttagactgaacacatcatttctattccatgacttccctatttttgtgtgttttagatatattggttcaattgataaatcctaaaacaaaaggtttgatctcttaaatgtagattttataatttgaactatttgaactcacaagccaaaatggtttgggagtagctgaactataaattatatttattcatagagttctttatgttattgatttctttatgccctccttgaatataaaaaaagaaccatttattcaaagtaaaccaaacctgcattttcaagtcaataaaccaagatggttagagattagttcaaccataaatcagttctattttatagtcggtatagcatggacttctttatatatgcactctttgcattaaaaagaatcaccgaaggaaaaacgtaattgattcctcaaaggccaagtataaattaggtttcaccaaactgttttgggtggggttttcgccactccacggtttagcggttattgcagtaaccacgtggttaccgtgaggtataccatggtttttaaaaactgagaaggttaccgcacgtaataaccacaataaccgtatgataaccgcaatcttgtaaatctcttctcacactctctaaggctcacttattcgatttggtgccagatcctgaaccccatgatataactttttttttttgtaaatttggacctgtttcgatcaattttcttgagaaaatattttgatcaacttttggtcaacttttactattttaagcttgaattctgaaaaaaaacattcgaaatttcacggttctcgaccccaccgggcatgacagacgtgtgcaatctgaagcatccgattttgggtacccagcgctccagcaggtgcatgccccgaacgggtcctcatttctcctgctctcgggtgcacgaagtcacgcaccacaaacaatagcggaatcacaatttccttggtcacacatccaagctagttcaaccagatttattttaaaagaaaaaaaaggccacacgagctggcccctccctgcaataaaacaatatagctataaatcgctttgaattatgccggagaatgcaatcattgaccaggggcgtgcaagttgcgtgtgtgcgcgaccacgaaacttaatcaaagctcacaaaaccaaaaataactaatcagcacccacaatgaacggcacaatgcctaccactaccctctcccgcctagtcatcactcggccggtcagtccatgtccatcgctcgcaaagcaaatcgctcaccaatccaccccgttcaagagatgcaagcgggctaacccgcaaacctgttttataaacaaaattagtgtataatctacggtttatctactaatttaatttataaatggatttatggatagatccatttatatagctgaacatgacgtgaaaacccacgagttaccacctatttgattaatatgtgggctcgtgggtcggtccgcttgcatccctaccgatcccccacgcacgcacgcacgcacgcacggatcggagcacggtgtcgcggtggaagaaacggatgagacgggcacacgcgacctaaccacggcgccgcggcgtggtggtggtggagacgtggagtggcgcgcacgagagcgacgcgcccacgcctcctcggtcacactactactcactcgggcgcccgcgcgcgcgcgcgcgcgtgaccgagactgactcgcgtcccggccgtcccgtcgcacggtgcacggtagcacggccgcccgcccgtgatgccgaggaaaaaacccccacccaatccgcgctcgcgcgcgtgacggcgacgagttcgcggccagaaaacgacccgcggattcgggcggcgccgcggcggtgtacgtctggtttttgcgaggacctagcacggcgcgcgacgacgccgatcgaccgagcaggcgacgcaggcagcagcgacgccgcgtgacgttgagaaaagttctcgcgttgtgtgagctgtaatctctgcgtggtgctagctatgtgtgtttgcaaagggaagacgacgatatccaagctcgcgagtttggaattgccgctcgaatctctctgttccttatttgacccgaaaactttcgtgtcgatcgggtttttgccttgcaagtttgcctgccgtgctagagtagaggaggagatagccttcgcgtcgcgatgcccgctgcgatacgtatgctggtagtggtggtgtgttgtcgggtcagttggtgccaaggtacagcgtatgttactactagtacatcggtagacttgtggtctagttgagtgagtcgtactagtattgtattggcattgcgacgctttgagatacagttgtacacgtctccgtccaacagtcccctggttttcttcttcttcttcttcttctggacatcggtaacagcaaaataggcctgaaattcaagctctgttgtagactttgaggcctttgaaatgcggcaattttacaagatttccatatgaatcaatttagtttctcatgcgtgctgggagaagaggatgaaaaagagaaggaccccgcttttatgacagtaaagatgaaatgcagaaaaaaggatgatccgtatgaaaattatgtcgttggatgggatattttttttctttcctcttctcactagccaatgtgcgtaacggcatggttgctagagagagaagaaaaatcccagcatcctaaacttcgtgatacgaatatgatcctcagttgcatgtgcatgttgcaatcttagagatcctgaatccggagttaggccagcagatcaaactgaattctagatggatatgatccgcttagacttcctaactcggactgcttgtttggctcggtcgccgtgtctcttgcggctacacctgttcgcaactagaaggattgaccaaaaactttcagacataggtggtgattgaatcttctgaagatgaagattaagattaagtattcacgtaaaataaggtggtaataatatatgattaattgagttttaattattgcaaacttgaaaaatggattaatatgatattttagaacaacttttatatagaaaattttcgcacgaaacacaccgtacatcgtttagcagtttaaaaagtgtgccacgaatatttaaaacttcatccacttttttaagtggaaacgaacggagactattaccaaacaagttggaatttgtcgaccatctgtttgtttgggcaattctggtttctgaagtcaagttcttctgccacgcatggctctggcccagcgtggcctgctccataaacgggccttgagttgggcctttcctaacatccggcccatttccccctgcgcggcaacatcagtcatcagctgggaaaacgagaagacgacgcagtcctcatctgagtcatctctagcaaagattttacttcaagagactaaaatcaattagactggcatacgtatttaattgaagcttaagaaatactccctccattccaaattaatctacatagtctttttttaaggttattcctaaatgatctacatatttgtgttcatttattaggtctattcgttatttgtgcattggaataaatggacattgataaatccatgcacacaagcatttataacccacatggaatatcttgatttgctattggctaggaaatagtggggatggtgcatacattgagtaaatatagtatgagagagttattagctttttttggtcttggtgtatctttgaaatatgtagatcaatttaaaatggagggagtactagtatactataattaattaagagtgttaatgaggtacactaaagtcatttctcttcccttcgcttgtagtactaatttgcctgtgccatgttataaatgaaatctctctgtgagaccgagcgattagtaaaatatgtttggattatgccaaaatctatctattatattattaaaggaatagaaaaaagagactccacgttcgctcaaatggtctagaaattctcacattaatcggagaaaaagaaaaggcagagtccatatagaaatacaatttagaaatagctgaaattcggaattaaaaaataaggaatattagaagagtagactagattccatatagaaatacaattaggaaatagctaaaatttggaatttaaaaataaggaaaattagaagtagagtatagagtccatata

SEQ ID NO: 62050 - DNA, 2205 bp, Oryza sativa
ttcttgatctaatttttccataaactctgaaacactatgtcttctattatctattatatttctatcatatgcttctgtttctaagtcatctgtggttctgggtttgtaatttataaatctaatgctggtatttcctttactattttgataacttatataattttcaggctgactcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcttcgtatctctttgtttgaaaaccaaaacttattttatctataaattcttttataggcatcattagatctggggctatatatgttatcaacatattctcattcatatcaccttctaaaaatcctaatgctgctttatctattgtgtccaccttttattataaaactttagctcctaatttctttcttatcatacctttgattcctattatatacatacattggtgaatatatttataccctaaatactttaatccattttcaaattccttggctacaatttttaactcaattgcctgtattaaaacacttaactatacttctttagatattcctgataacccatttttattctcaaaaaatcccatgcaatatatttgttgaggtcttattgccctcatagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagatagatccatttttctgaattaatagcttgagacgaggtaattatgcctgttgaagccaaaactatctcttttcctttactagaatttattatttctaataattttttgatatagtcactgttttgtaatatcttattctgccttatcttatattcctctagctcttttagcactgaatttaatttattactgacaagcaaatattgttcttcagattgctttcgttctttaaacaaatcttcaaaccttcgctctaaatcttcctgctttttatcccaatttatataaaaattatatatcagatcaacaattaaaattaattgactattgttagagtgtcaactatggtcttcaatgtgatttaacaccttatattcagattatctttgatagtaattacctttccaatattagcttctgaatttgatttctctatgatgactggctctgataccactttatgatgactggctctgataccactttgagtttactggttactggttatatgtatatatatacatacatatatatacatatacatatatacatatgcatatatatatacatatacatatgtacatatacatatgtatatacatatgcgtgtatatatatacatatacatatatatatatatatccatatatatatatatatatagacacactatgatttatttttacatatcaaatctaagtatatccaatcaaaatttctatggatgaaaattttatcttcccaaaaaataaaacgcgttttgttatatctcatgataataaagacacccaatcaagaaggaaaatgacttcgcatacaaggcagtgcaaatatgcttatatccagattatcatcattgtgttaatcaaatcatggaccttctcatcatgcaaaacgatgcccttcgtctccttagtggtgctccaaatagggtctcaccatgcttgctaactcacataagcatcattattgtgtttatgtttctttgagtaaaatcatgagcactttaaattagtcgttcaaaaaaatgagcactttaaatatttattttactgaaaagaaatggacgtagtgttagtgcacttttagttgatgaggagagctgcaccctcaacactttagtccaaccattttttgtccccaagcgaacaacccggctagcatggtcacaccgatctgttctgatgcgctctttgaccggaaagtccaaaagatcatccaacccaactctggtcaccaccaaagttcctttaattttaaattcatgcatatgta

SEQ ID NO: 62051 - DNA, 13267 bp, Oryza sativa
catgtttgaccgttcgtcttattcaaaaacttttgtgagatatgtaaaattatatgcctacataaaaatatatttaacaatgaatcaaatgataggaaaagaattaataattacttaaattttttgaataagacaaacggtcaaacatgtgataaaaagtcaatggcgtcaaacatttcgaaacggagggagtatattataggacggatggagtatgctggtatttcatgtttgaccgttcgtcttattcaaaaacttttgtgagatatgtaaaattatatgcctacataaaaatatatttaccaataaatcaaatgataggaaaaaaattaataattacttaaattttttgaataagataaacggtcaaacatgtgataaaaagtcaacggtgttaaacatttcaaaacagagaagatatattataggccggatggagtatgctggtatgtcgtgcgctgaactggaatagtagcgatagtataggccgccgcggagagcgtggaataatgatgttttcagtgtacgtctgctctgacacacaacgatctagaatccatgtatttttgtgtaaaatacaataaaggtgcagagtacattatttattttgcaatcacatagtatcatcttttaagtgtaggaggccaattatgccctacacgtttttgttagtttaagttatttgttcaagtttaaaggcctatttagggaagcttttggcagctcaagaagaatcttctagaagctgtagctactataagccccccccccccccaaacaatctaaattttcactcagattttgaaaagctgtagttgtagataccagaaaatgaagtagaaatcaggagctaggtttcccaacttcatcagattctcatcagctatttcttatgattttaagctctctaaacatagcctaagtttattttaactggttggtacatattaacttattacgttatcaagatctcaaatttgaatctaattaacttacgcaattacttttcgctatgaaaataagaatgtccagacttataagtaaaagtttttatattttatcatggagttagtacttacaacttattttcatttcatgccctgtcggtgaagtataagtgaattaattactcgtgctaatttattgtcaatttatttatttattttcttaaattggttggtgcagctaattaactaaattagttttttgtgtagcttcaattaggaaatgcatagtatggagtcacatcattttctacatgcccacatgtggccaacgatacgcctttgacccgtctcacgtcttaacgcacgcgagcatttcttagtggactaaatttttgctaatcaatatacaaataacgtcacttgcattgttgtcatctcgtccactattctgcatttaccatgtgttgctgacagtagactagcagttccattccaacttatattattaattctgacgggatagtatacatgcatctaacctaacctgtggccgcgattaattatcgtgacggggcagtcgtcgcacgactgcaacacgtctcgaaccgtctatcgatctatgcttgacaaactcgttcatctccaaattaattcgttgcaaaaaaaaaaacacattgctactcatgtgcgtaatcttgaagaagtgaaaaaaccataagatatacattcatgcgtatgtattcattcgtacaaattgaatatgcaaaccgttcaacacgtatttgcgcgtagctaaggcctggtactacgtacaaatccatgaggactgtcaggttgattttcacagtgtaaagaaaaaaaaaccatagctttttgccttattatacactccctccgttttaggttataagacgttttaactttggtcaaagttaaactactctaagcttaactaattttgtagaaaaaaagtagtaatatttttaaccaagagtaatatattatgaaaaaatatttaattatagatttaatgaaactgtatatgttggtgttgtaaatattactacttttttctatatagttagttaaacttagagtaccaaaatcaaaacgttttataacagtaaacggagagagtatatatttccacagttggttttatcccgcaacaataaaaaaaattcaaaagatttatatagctaatgaggtaagaattaggatagataaggggattaagcaaaagctcgggggtatacatacattagaagtgcgtacgaccgtacgtacgtgtatgtagtaggtttcacaagccaaattaagccacgatttgattaggcaaagcaaaaaaaaggttcaatatattctccgcatggaaaaaaagagaaaaaattgtaaaaaccagtcataaatcacttaaaatttgacattccatccatataccattttttgtaaatatcgacctacctatttagttttattgtaaaaaccacctcagtacgcatatgcttaaacgaatcaacatgttttcataaagagcgagccattagtgtggtatttatcaaaattcaattcttccgaagtattgtcttgacacttttttggagattccaaaaatagaattgttgatgagggtttaaatgttgtcgcactgagtttcgctatatacgtacacacaaaagttcaatcaaatgcgaaaaaataagtctaatacaaacacttagataatattgactccactaacttagtatgtagtaactctaactctacgataacgggctgattgattaagcacatgtgtactgtgatggtttttgcaacaaaactaagtatggaatgaatatttgcaacaaaatgacttacgagataaaatatcaatcttcaaatgatttgtcgggtgatttttgcacttttcaaatgaaatgaaaaaggcagtgtaaacgtatgccactgtatttgagcacgtgccacatgcatgaacccaacatatcgtctacgccagtgggtaacaatccatatgtttttggcttgtgcgcgcgtccctttcgtttctgccccagacgcacgcacgcatgcattcctccaggtgatgcaactactttttaaaaaaaaaatcttttcttttcttttcttttcttttctcttctctttttttttcttctggccggccacatgagaaaaagaacagcatgcgcactagggatgaaaacggtacgaaaatttccgagaattccagctaccgtttccggtttgtaccgaccgtttcaatcggtatcggtaattgtccgtatcggaaatggaaacgatattctctttcggaaatgggacggggtttttttcgaccattttgtcgggtaccatatttgatcggtaatttccgttaaatttccgataaaattctgaagaagaagcctaagcggctgggtgcctgggcctggctagcaggagcagcccatttggccgggaagaaaaaccctagggcatgggcatcagccggcttgtcgcttctcatcctatccctgtatcgcgactctcgcacagctcttcgccacctctacctccgccgaccgctgccgccgtaaccacgccgccacgccgctgccaccgcaaccacgccgccacgccgctgcttgctagtcctagccatcgtaccctcacgcctcgccacgtcccttgccggagaagcacgatggcacctgttggaagaaaacgccacatccatctggatccatccgacggcaacaacggagcaatattgagtttgccaccgttgccaggtccaccaggtatagccgtataggtgtatagcttgaatgcttgagcatgattagccttgatatgtttgagcacgattttctgttgatgcgcaagcaccattttcccatgatatgagagccttgatctgtcaactcattaattatcatacaacggtgttatgtggcagcatgatgatgcaagggtaaaattataaggtcatctttatgcatagttaaatgtgggatgatgccacggttcgatgtttccgatatgaatttttgacttccgaccgatatcggtagatttctgttccgacggttccgtttccaatataccgacattatcgatatcgttaccgtttccgagtacaccgttccgattccgttttcgagaaaataaaatgaaaatgaaaatggtagagggtttttccgaccgttttcatccctaatgcgcacgaggtaattaggtagaggtatctggatatttgacacaacgatcgatgtggcaaaggccaaaggggaaagctaattttgacattttatttaccaagtttttctcacggcgttgtgggatccgaatgtccgatccagggctataggccgttcggtcagagctagcgtgtgtgccggcgcgagtcagcaacagcggcggcgtttaattttgccggtgctgcgtgcatgcgaccgaccgatcgatcgagacaacgtatatgtaattaaagtctacgaacagatcgatctgatcgtgttatttatatacctgggcttcgaccgtataatctggcatgcatatgcatgtcaaagttcgttcggcgtaacgtgcagggttcatcagatcggggtccaaggccaggagatcttgtggtgatcatcgtgtctatctaacttaattaattaatttggtcgtcattccggttgatcgacaattcgacagtctagctaggagaaaacagcttttgacaggaataatttatgctgcatttgatttgattttatttgaacatgtacccctcagtcccattataaatgcactcataaattttcgtacccaacgtttgatcatccgtcttatttaaaaaaattataaatttttttttaaaagttaagtcaaacataaattactattaatattctaccatcttataacaatgaaaatactaatcataaaaaatattttaaataagacggattgttaaagttagagactaaaacctaccgcggtgcttattatgagatggagagagtagtatctctgcgtaggggccccacatggaagtcggctgctgcttgcgtttgacaaaattaattggaatcgctacgcgttctcgctagcttgggttctgcttggtgtgagatgtacgtgcatgcatggcggcgggccggcggcggtggtggtggccggtcgccgtggtcggtgatgagagggcgctcagggttgactccaattaaccgaatcgtgctgctacttacgaaagctagcttcctagtactaagttttagcttgtcctttgcgtgtttagccagtttccactcttcttttctttgaactcgggacctatatattatccacaaatcaacgtgtattaataactgctagtacttcttccatccctaaatatttgacgccgttgactttttcaaacatgtttaaccgttcgtcttatttcaaaattttaagtaattattaattcttttcctattatttgattcattcattgtgaaatatacttttatgtatatatatagttttacatattttacaaaagtttttgaataagatgaacggtcaaatatgttttaaaagagtatttgcgtacgtttactgccaccaccaattgatatcccctcgtaagataggacttgatacagtagtcaaatagagctctcatcgatcagaaaaaaggggaaaaagaagtccactagagctctagatatatactccctctatccaaaatataattatttttaaactttgacacggtcttcgagatgttattttgaccaacaatatctatgttttaaataaaaagagttagatattatgatagtttgtttaatgataaatttagaaacatcaattttacatgattgattttttttattattttgctatcaatagtcaaaatttaaaatatttgatttggcattattgtaaaaatatttatattttgtaacagatggagtagccatatactccttgtacgtatatacaataatcagacttccattatatacatgctgtagttgctatatctctgaggttttggaattatatatgaatctctgcaccatatgatcgagacaactctatccgttccaaagaaaaccaacctagatatagatttaacacaacaacaataaatttgaacataatcgttgttttaggtggtgtcaactcctcatatagacatttttttagacagaatgagtagctaagctactccctccgtctcaaaaaaagtgaatctaagactggatgtgacatattatagtacagtaaatctggacagatatatgtcagattcgatatactagaatatgttacatatattatatagtattaggttagttttttataggacgtagagagtatagtttgaacaaatcaacagtacctcaactgtgatcggcagtacaagagagggagagatacggaatcgcatggatccagcactaaccagaaagttgcacaaaattcagaacacacaagagattaccgcagcaaggccaaatgggcaatccattccgtccgccctgcgttttgtcgggtcatttgcccgttccacgcggagtagccgccgtggcgccggctgccggggcgctggccattggccacttacatccgacccgggccacccggcctgccgccatttgtcagctagcccaccaaaaaagcaagccgtgccgcctgcatgcgccggcccggcgtgggaaaaaacaaaggccgcaaatccgcgtgaaacagtccattttgactccctcgactgtaactccaatccgatttatatcactagaccacaaaaccggatatctttatatcactgaaccacaaaaccggatatcttgaccccacagctattaaaattggtgcaatataactttctcggtaattttagaggacggttttattgatgtggtgctttgacttagtttgacggactgactgaacttgtgggacccacatgtcagtgccgcctcatcttttccttctctttctttctctctctcttcctggcacgggcgacataggtgggtggcgctgagccggtccatacctcccttgactgtacggtgtgtgcagtcgtcagggcgcacgaagagggctccctatggtggcgtcgaagtcaggtgtggacaagacaatgtagcgctgtgatggcgaggtaggcggtggccacagcgggaagggaatgagaacgggagtgagtcgggcgccgtagtgacacccacctccttggcttgatggtcgtatcctcctcgttagttgccatggctcgcacctctctcccgaggacctcacctccacgcttctcctcctcggcgcgctcggtgtcctcctccgccgcctagctctgtgaggccgttcaccgcgctatgcaccccactcccctgctataccgacaagaaaacattttgggaggaaagagtatgacatgtggaccaaactttatttttattttctttgatgactagtgacggagcgtggggcttctcaccgggagaccgcgcaggcccccctttgccggttcggccgggggccctgggtgaggttctaagctcttgatctgtggaaagttcgcgagagtaaaaacacacaagacacgggcgatgtatacaggttcggcccgctgagaagcgtaataccctactcctgtgttttggtggatctgtgtatgaagaagctacaaagtgcgagccagcccccgatcgttctgggatcctttttccttccccccctttctctaagtgggcaaggtcctccttttatatctcaaggggataccacatgcaccatctctccctctctttcttacttgacttctcttcattaatggacggagatttgtatggctgccgtccgaatgaccttctgatgggacggcccacacctacctccacttccgccggaagcaggcgcgacgtgggaacatggctatctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcgaggcgtgcgtcagaccgcctgtcgccacctaacccacgatctgatcggtctgtgactggtcactgaccggataaacgagcgcgctgcactgcgctacatgcagcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcgaccgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctccccgagggaagcggtcgggcgtgacgccacctctaaggcctggtgacaggtggggccggttcctacaggtgccgtcgaactacatcacccagagggcggtgtgaggcagctgcgatgggctcgagctggcctcgggggcggagacgagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacccgatgcgcctggaaataatggcgcaacttcctcgcagccatcagaatagcgtaaagcatcttctgggcctgagggtatcgggtcttggcgtcccggagggcctcactaacaaagtagacgggccactgcacctttcggtggggccgatcctcttcgctaggggccacatccctggggcgctctttgtctaagcggcctcacggggtgcactcgtcttctgtgccgacgacctcggggtcggaggacgacaggggcggccttcccacagtggcctcggggccatcctgggggtcgggggcgcctggcaccgtcggacaagcaggcggagggccagctccggccgtcgggggccttgggccgcctttcggctcgggggcctctcctccctgctctctctctcttcgggtagaatcccggcggtcgcaaatcgcgcgcatcagcaagggaaaaccgaccaacaataatgagcggcccctcggctcgcgtttgccttcaactccgacgaggagtgcggtgacgacggtgcggacgacagcgacggcgaggccggctacccgggcgcgtcggagtgagcccccaggcctccgccaatcttaatagcttttccttcttcttccgaggccttcgggcccccttcttgttataggctgatttaatctgcaatcaaataaagaggaaatttttgtgtcaattctatttgttgtgtgtatgagacgaggatgcctgtgccgcggtccttttgtgccttggcttgaacaagggctcgtgcccaggtcctagtcctcaaatggctcgggtcggggctagtgcctggggagatccacatgtcgagactggccaggccgggagcatggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacggaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccatattggtgagagcttgctcaatccagcacgcgtttggacgcggcgtaggacgaggtcgtcaacgcagagtgatcgggcccggacgtggcgctgatggtagcgccgcaggctctgctggtagcgcacggctcgaaggaccgcgcgccaccttcgctcttccaagtagccgaggtcagggagcgtcggcttccttctttttgttgctcgcaggcctcccctttcgggtggccagcgaaacgccttcgacggcgaggacatgaccctcgtcgtcggaatgggccgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccctcttgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaggagtggaccgacgcgggtggcaagttcattagccaaccccgcgcctgtcccttcagggctatgggaaagaaattcgccatgaccctgtcatcacccccggcggcttcgatcccggtcgtgtagacctggagaaactcggcggggttgacgctcccatcatatttttcggcgatggtgggccggaaccttgggggccaacagacgttccgaaggctcgccacaaaggctctacagccgacaccaccaaccgggggcacggagggctgatccccgcgtccgtgttgaggtgacactccggacgaggaggcgccctccgttgcgtggggagcacgccgaccattacgccggcgctcgatatcgatgcgggcatctggccccccacgctgatcttcccgggtcggaggcgctgacgagggagtggcagccgaatggcgagcaacagccgccgctcgtcgcgccctccgccttgacgacacggagccggtggtagcagcgccagaggtcttggtggcggaggaccgaccaccagcacctaggcgccgctgtgccgtcatgaccaagttggccacgtcgtccagccatcgttgggctggagactccgggtcagggacgacaggcgggtgacgcaggagcgcgcccgcagcttggagcgcgccctggggcgtgctgccgtcgccgtaaacgaggaggcgacgctccccatctcggcgcccttctccatcacccgtggatgtcgaagtcgcggatccttcgaccctctcgagcacctcctccctcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcgcacacgaaagagtgcgagagctcagaagatcactcgcagaaccccctacctggcgcgccagatgacggagcttgggggtcctcatcgggagaccgcgcaggcccccctttgccggttcggccgggggccctgggtgaggttctaagctcttgatctgtggaaagttcgcgagagtgaaggcgatgtatacaggttcgggccgctgagaagcgtaataccctactcctgtgttttggtggatctgtgtatgaagaagctacaaagtgcgagccagcccccgatcgttctgggatccttcatcagattattatatctaagtatcatgttgacatcataataatattaactattcaattgaaacattgctactccctctgtcttacaatgtaagttattctagcattttccaccttcatatttatgttaatgaatctagaaatatattcattaatatcaatatgaatgtgggaaatgttagtatgacttacattgtgaaatgaatgaagtactattttgtaagaatatttctacgaaaaatgctacaggatggtgccccgtattctcgttcagacggaatgatgcctctgagttatcgtcggatacttattaggtatcgatcgataccctatttagacaggttgatatctctaaggtatcgtgtgatacctaatacttataatatctctgagatgtaatctgatatctgataagtatcaaccaatacattaaaagtatcatttcgttcaaacgaggtgccgttctacagcattcctatgtaaaacaaaacaataccctccgttttagtgaaaaaagaaaacccacgcgtcgcattgacttttccctcccgtttcttgcctttgccgaggtgagctccacacacacacacacactctctctctctctctctctctctctctctctctgccccactctgcctgcctcatgttgaaccattccccttcccattcccgacccggctcgctgtcccccctcctcggcgtcctcctcccctcccgcgccgccgcagagcgcccgccgccgctgaactccatcagctaccccgagcccgcgggggcctgccgggtggcgatggaattcccgtcgtcgacgtcgccgtcgccgtcgccgtcgtccgggcagcatcagcagcagccgacgacgccgcggcggcagcttcagggcccgcgccccccgcggctcaacgtgcggatggagtcgcacgccatcaagaagccgtcgtccggggcggacgcggcggcggcgcaggcgcaggcgaggcgggagcagcagcagccgccgccgcgggcgccggtgatcatctacgacgccgtcccgaagattatccacgccgagcccaacgagttcatggcgctcgtgcagcggctcaccggcccggggtcggggtcgccggcgccgccgcatcaaggggaggcccaggcgcacgactaccccatgatggacgaggccgccgcgcagcagatcttcccgccggagctgctgctctcgccgtcggccgcgatgtacccggcggcgaggctggcgaccat

SEQ ID NO: 62052 - DNA, 3468 bp, Oryza sativa
  unsure (1)..(3468): unsure at all n locations
aaggtgggcgccagcagctagaacgccatcatcgttcccgtcgggagcaggttcgctaggctcgccgtcggcgccagcgcctgcgagaatagcgatggccttgcagctccggccggacgacgaccaccgccgtcgccggtagcagcgctctctccttctccagcttgcttacctaccgctggcctttgcctgacgacagcgggagacaccatgatcgatcgaccggattgttcttggataggcagctagctagctcgcgctcgccccgatctcaacccaccgcacgcgtttttggcgaagcagaaaacgagggaaagagagggcaatccgggcatttagaaaaatatctcacctttttttttacccagaaataataaaataataagactagtgtcttacagccaattacacaatttttttagtgtacatcagccatatcacgttttcgcggtatctcctagctaattacacgttttaggtgtctcctgtgataaattttgcctaatcaaaaacaggacaagaggaaatgagcacagaccaaccaagaggacagaaacttaaatatcaaacttatccctaatcaatatgctagtagtaaaatagtgatatgtttttaagaactagtaactgtttagatcatttctattcctattagtattaaagcaccgtaccgtttctcgggttaatattagtatatgttcgaaggtataattggggacttggctgtgttcggatgcctgagtttccaacactaacagtacgcacgaaaaacagagtggttcattagcgtgtgattaattaagtattagataattcattttttaaaaatgaatcaatatgattttttaagcaacttacgtatagaaactttttttaaaaaaaatgcaccgtttaacagtttgaaaaacatgcgcgagaaaaatgagaggagagtgttagaaacttagagttctgaacacagccttagagcaggtacaatagcaggctataagccagctgcaaatatattttaaggagataaatgaggagagagaaggccagcgggctacagatttgtagccagctgtagcacggactaaaagacgcggtgtgtgtatgataagtgagatcatgtattaatagtgtagtatgtaactattgtacggatgagctattagattggctatagatgaattagagctagtagatggctatactattaaacttgctcttactagttactcgtgacagtttacaccaaatttaagatagggtaaagtttcaaaagtttgagtaaattgagagtaccatggaaggaccttttggatttagggcagtcccagcccatggtgtctataagtagtgtctatggtgccatgtcaataatacatcacaatagaaactacagtgtatattccatggtttcttaaagtgggccattaagaaatgtttcatctctcttctctatcaatcatatttattcttcatgtattatgaagacattattttctcccaatgcaaaacttggtagtgtctagtgcataggttctcgtgttggagctgtgtagacccagtttcttcctctctctccactctctctctctcttaattaatatagtgccacataagttaaaagtcttatatgacaatgtagttaatatcatatacaccattctaagcgaagagttaggactgcccatagcaagcacaatcccaaggaacacgttggaggaccgacaaggacgtggtaataaagatatttgaatatcgacctttttccgttcacatcttcactgaacttttcagttgcaatattacagctaataatttgatatgaccaacaaatcgccgtcaattgcacaacgacgtctggaaatggatcgatgtgtaccgcaggttgaataatatatactgcacggaacataattgacttggaacaacgttacagccttacaagcttacagctagtcatgcacgattttttttttacagataattgtggttatgaacaatgtttttttttaaaaaaaaggtactaaattcacactatattttctcggggcagaggccggtttatctgcatgtgggtcccagccactgaaagcaatttatttttgaaagggaaaagaccaaaacacaggtccccaaagccacaatgtacatatatgctccttcgcggacaaacaaacaaccacatatatataatataagattaatactcctatcgagggatgatcatcgttgttagagtaatgaaaaatcgtatagatctctctgttatttgtggactggatggtgggtagtctttatttttttttctttttgatgaaaaacatagtaaaaatataggtgtccacaacgcatccacactcaccactatgaatacacacacgcacattctacccctatgaacacatccaaagaattggatcgatatattttgagattagcgaagtcaccatgacgactcgctgtcgacgggtacgtcacgtaccgttgaaagaataattagccataaatgcgaacactcatgttaaatccaggatttgaatttggataaactggttttaccacaagaacctaactaaattagctacgctcactcttcaaaattttcttaaactatcatgattttctgcacatgagaagagataaatttacatgagattccatgaaaaaaagaatagcagtgacatataatatgcacccgcaggcacggatggcactgtttgatcggcataaatgattttggtggccttgtgctatctaaatgattttagtactcgatgtatcatgcatcatccagctaattcggaggctggaaattattagcagcaccacacgcagcgcgtcgtcccaacttccggcggatcagagaagatacatgtggaatatgaataatatttaggtataggatcatgttctttgtgaaatgctgcccccttgcccatgagaatcacaaggtattttctgttgcctgtatnntnnggatatataaagggtagaagaagtttaatagtatagcaattagtatttttttttaggaaaaggaggagttttgcttttttatatagggaggaaagagacgaattagaggtttggaaaaaaaggttaaaaaggatctctagaggaccctctttagagaatggcaggtcggagacaagaatttttaggtaatgtaaagcaactaatgtgaggatacgaggactaatgtgaggatacgaggactactcatgtaagttgtgagctccgtcataggcttttcacatgttggattatggactcaacgacttgcaacactgtgctgtacgccccattgaaaatcctagcatttctttgtagccaaatgccccaagctgtgtagatgaagaggccatcaaagtttcttctttgatctttcgccatctctctcctgcaggccgtccaccatccaagcatgtctccattgtaagtggtggctaatggcatatgaaggcccgcttcctgcca

SEQ ID NO: 62053 - DNA, 16012 bp, Oryza sativa
  unsure (1)..(16012): unsure at all n locations
gggggtgacaggaaggaatcgggagatcacctgcgcgcgacatgacaggatcgcagggacagctgcaggttttgatgatgatggcgatgacgatgaggatacgatcaggaccgaacttttcaggggggtggggacgggaattaaactgggcgatcggatcatgaccgtatcagcctgggtttgtgtcgacggtgttgttaagtggcggtggggagatacggttggatttggtcatttggaggctgggagaggagaggggaggattgtgcatgttgaggctggcaggatcgtcgcagggatattttggttccattcacttggctatcattgatggtgattagtctatcaattggatcatgattccatcgctcaccaggcacttaagatggcacgcgacctatacgtttgcaacttgaaggaacacaagtatgggtaattatagatttatagtcccatttgtcattgcattaggaaacaaccctgacagtcaagatcagactatgtacacggtgtaccctctctcgggacaaagtacgcaggggccatgcctagagccctagagcatatgcataaggtattctactaccttttggacctcttcatgttggaccaaggaggatttcttttgagggccagtttaacatcagagatacacagagttagcccactatgtaggagtttttcctacattaattttccttacaaaaatttccatgttttttaaaacgatgcattcaaaatagtgcgagatctcgtattgatatagcagaagaaaattataaaattacaaccttgtaagataatagctcctagcctcctaacacatccttgatccttgctatttttagaacatgaaaagtacattccattaggacgatgatatagactgtgttattctcccagtttttccaactcacctctttcgttttccacgcggacgcttttcaaactactagataatgtgttttttgccaaaaatatatatatatgaaagttgttttataaaaatcatattaacctttttttaaaaaaataatacttaattaattatgcaataatacgtatttcattttgcatgtcgggaggacctaacccctcctaccaaacaagctaagtggctagctaccacacgagttacaaagttattaaaccaggacaaatgatttgtcgcgttccatggaagctcccaaatccgacaaaagaacgggcaacacgactggacattgttggagtctaacatcattataactagatagcacaaaaagtttatctactgtaaaaattacaacattaacaccattattttgcctcagaatcattcaaaccttaaactagattgagaacaatatatattaaatagttggcagtgttcggcagcgcatggaagagagtagatttgtctcgttttttcacgcgcacgcttgccgaacaattaaactgtgtgtttttttaaaaaaaatctatgaaaaagttgctatgaaaatcaaattaatttatttctcaagtttaaaataattaatacttaattaatcatacgacagtgactcacctcatgtcgtatattcagatttcctctcctcttgtacgcacccaagcttgcaagttgcaatgcccatttccgctagcaaaaccactgttctctctgcagcagcagatgcctcaaatcttgtactaactttttcaacctttcggctacagccatcaacaggttcccagtctcatcacgaatgtagaacacaccccatttctcgtagttgaatcaaaagttccggggagacaggggagattgattctcgttttccacgtgcacgcttttcaaactactaaacggtgtattttttgcaaaaaatttctataggaaagttgctttaaaaaatcatattaatctatttttgaaatttaaaatagttaatactcaattaatcatgagctaatggctcacctcgttttacgtatctccccaatctcctcaatccccttctcctcaaacacacccttaatatttactttcagaatatatatatatatatatatatatatatatatatatatatatatatatatatatatatatatatatatatatatatatgcttactccacgatagacgttctgtactggcctgccttgtttgcaagccgaatcacccatcctgccattcatcattcattcaattttttgttagaaatattcgggatgcaaaatcttttgcacaaatataccatcggtctcacacaatcattacgcgaaaatgacgtggaaatgacgttgcgaccggtatcgcgcaatgaaagcgcacggtctcgcacggtagcagtgcgagaccgcgcggtctcgcccaagcaaacagcgatagcgctgaagcaatcaacgctatcgctcaagcaaagagcgataccgtgccttgccaatttaattagtggttaattatccttattagtgattaattaataattaattaattaatcattaattagaataattaatcactaattattattagttaaatgttaattaagtaattaaccactaatcaaatggatcctattggacaatgtcgctgattgcttctgcgagaccgaacggtctcgctcttccattccgtgagaccgcacggtctcgcgccgttgccgtgcgatatcacccgcgacgtcatccccacgtcattttcgcgcaacggaagtgcgacactgatggtatatttctgcacaagtttttgcaccccgaatattcctgagaaaaaaattaaataaacagtatattttcaaatttaattcactggaagctctctcactgaccatctttttttttccttgcagtaattagcttgtgcaccttaccttctgatgcagctcgatcgcacgcacctgcaggtgcagcgaagctagctgccactaaagagcccgcggtgagtaaaggagccagagagagaactgcatttgttggttaaggtctcgcacgcagagaccggtggtagtgtcgtcacactgccgtttttacacactcatcatacatactatttgctccattctgaaacaactactgcagctagcttggatcggcaattggtggtttcacgtcgccttcttcctacttcccagtgtcaagagattaaatcctctctgatcaaattgttacatgtacgtggttgttcttccaatcaacaatgtgaactcgctaacaccattctagtagaacccgtttccatggccccttctagcttgggatgatcacagcgtggtattgcctgctgcgtgtgcttcacttccccgaatggcgaatacccgatcgatatatcatccacccactcacaactcgcgacaccgaaatggaaaacgggaaagcgttggttgatgatctcgcttctgccccgtggccacatgcgaacataaccagttaaccgccaattaaagcttccgatcgattcacatccttatatatttagtacaactttacaagttaagcatttgagcacagcgcattatttgcagacgccttaccttaacttgcattcggcaacttccatctctttgcaatggtgctttggccaagcaagccggccagttatatatggcaggttggagcagtcacgtctgcgtttccgtttttccttctacattagtgtgcttacgtttaatccatggacagcccggtcttgtattcttgtgcaaatgcactgcctaattggccagaccatgcatgcactagtaatactgaccttaattaacttcaaagatttagtagctagctagatgaccatcctggcatatgagtatgtgcagcaacacgttgtgctggcagccgtttcatttcatttcacatgtgcctatatcactatccccttgaagcccagaaatccattgcgtgccaactcaaatcctaggcagtctcatcctcccatgaagaagcaagctgcagctgcacgatgcaacgccctttttgttgacagatttgagagtgagttcctgttaatccttgaataattcgttttttctgctccaattcccctcccggcccatgtatgatgttttttttacttcatttttttttgtgcctgcagagataatgatgtatcccctggttgcgtcgttggaatacattttttgtttcgggggctggactgcatcatgcgtggtgttcttccacttgatcgtgtcattttacggcacagaaatgacggaaaacctggtaattaacnacatgtgctcctccaagttgtattttgcactgttcgttttagtctgaatctgatgtgtttgtaatatatgctcgtgtagtgttcttgcgatgggatgacggccgaggaggccgccgccatgccggcgtcgaggcgtgcatgctgttgagctgcgcggcgcagatgcccgcggcggcggcggccatggcactgccgacggcgacggcgacgtgggggcggcggtcacggcgcgcgcgcgccgtccgccgcgcgtcggcgtcggtggcactggcggtggccggcctcaccctgtggctgtggtgcgtctacctccggttcctgccggggctccggtgcttccgctgttcggggtgctcaagaaggttgccgtccccccaaaagccctgggattcgccacgccggtgttcgccttcgtcgcgctgggctcgcacgccgtcgtccgcggagacgaagccgagtgggacgagtgacgtctactgatcgatcgatcgatcagtgagtgtttggtgcgtgtggtttcttgggagatcatgttagtggggactaattaattaatgcggtgatgtggagctgattagtttcatgccgattttggtttttggagttcggtctttctcagcaagagtgtttactgatcgccaaccagctgtctagcgtgaaagacatacatgaatgaagtatagttaacttggtaccaaactactagagtactagtccagccataactagaaacgctctggattcgaaacctcaccccttctaattatttgatattaggtcattctctaatattcacgtttttactagtccagccatagaaaccccaaatctcttgcctgtggtaacagctcacagctcaattccatttccatcctactccatcatcagtgtcaggtaggagtagagcaaaactttgtagccagagcagcggggcgctgccatgtacaatcgtagagcggacgtgcaaagcgggctgatttcaatgggctgcggcgcaggggaatggcctgacaaatatttttccagcccagaacgcatggtcaccaagcgatccaatcccttcggcttgtaaggcacggtgcggtcgactgtaggggatcccaataagcattgggccgcatagatagaccatacgtgccaggttgacagagtttcagcccacactggctgaccaaatggtagcgatccaatctgcctccgggccctgtcacactaacgggccaacttggttaggcgggccgcgtgttgaagaaacggcccatttttgtggtcctgtcacggcgaagttacgggcctatattcaatacgggccgaaatggcaggcccacataagcgcacgaaacacaaaaaacatcacgacaaaacaccccgattccacccaccccaccacgaaacctcgcccttcgtctccgcctccgtcgcctccatctcgccgcgatccctctccccggcgatggccgccgccctccgctcctcctgcgccgccgcgcgccgtctgctccggatctccccggccgcgctgtccaccctcaccgccgcctcctcccgccccgccgcggtggcgcccctcgcgcgcccgatcgccgccgccgccgtctcaggtcctcctcccatctgactcttcttgttcttgctgtttcgctaccttgtagtcgatgatgatgatacctccttcagttcgtgtttggggtggattgggctgacgatgcgtgtttagggttctgtgcgtgctgcttgcttgtgcaggctgattccagatttgtgtttgccgtgtggtagaatctgattgttttgggggatttcaactccgagagattggatttgagatgctatcgtgtgtggtgataataatttgccaggaagttattggttgtaaagatacaaggttcgggggtggcgggggtgccaattgttggtcgctgcgttgtagttaaagcatcaataggaaaaatgttaacactctgtgtataaaggtttacatttccaagctgatcctgaacttcacttcagatgtgttgtcctgaagtgttgttcctgctcgtgttgcatctttgatcacataataacaggcaatattgtttaaaatgatgttgctgcaaaccaagaataactggttcaaaacagtgagatttttcacttgattctgaagtaaataagcttattattctctaacctttttgtcaaagaatacgttgacgggaaaaaaaaccactgtttgtcctttatatgccataagtgtataagaatgggagaagcatggtaagaggatggttgacaaagagaaatatatttggaagagtcattgatgtcatcttgccttttgtggtcttcattttgctgcaatgtaacactgttgccttagttcaaaattgtacataccccaatatcaaattttctgtgctcaatgttgtttaacttatacttgttttaaattcaggtggcaacaatgccttttcatggaacttgaggcgcttgttcagctcaaatgaaaagcatctgccggcgatatctgacccagaagttgaatctgcgtttaaggatttgatggctgctagctggactggacttccagattctcttgtaattgaagcaaagaaagctgcatccaaagctacggatgataaggctgggaaagaggctttgctaaatgtatttcgtgcagctgaggcatgtgaagaatttggtggagttctagtcaccctaagaatggctctagatgatctttgtggtataactggtgaggtcagtacctaatcacatatatccctcattgatgtattgctttctgccaatttgggggatcagtcatcagtgtctctttcttatgcttattacttgttgtaccactccttgctcttgcagaatgtgggccccttgcctggttatatagaagatgctgttaaatctgcatataagcgttacatgaaatatctggaatcatttggcccggaggaaaattatctacgtaagaaagtggagaatgagttggggactaaaatgatacacctgaaaatgcggtgcagtggtgtagggtccgagtggggaaaggtacactcttatgttacctatccctgttgtatattttacctttgtgacagcttctgtggtagatttgcatttgacaagtccatggattgtgggtcctgatgtatgctttagtgcggatttatgctatcatttttaatggtttcttatgattgtattcaagatgttgtgtagatgttattttcagcgtagaagcagagttagtatgtgcagtttctgctatcacaaatgtgttatttgtgtttaagaatatattcctttctatggctaaggatcatttaatatcagactgcatcttgggtcatcacttgtcattggagtaggttgtactatgtcaggacagtcctttattattattttgcttgatacaaagggagaaatgagattctacatccatctttttacttgacgattagaacattgtcacagcctccagggctcatgtttgatcatatcttttctaattgaatatgtatataaaaatcattaaaactaaaactacattaaagtgtttttcacgacaaatctactacagtcattttcacatcaaatcttaatgtttttgcaaatatccgtgatttaggattttgaggtttgaccacatacatcctaaaaaatcatgtatttgagaacggaaggagtagcttagagtgaatataaacacctcaacctcatccaaaaaaaccaagtgaatgaactaggaccatcatcttgtctatctattcatttggtttgaagaagggaaattgcacaggtaagttgagatttgagaacaattgcagcgcattctcattttaccaagtcttgtgctagatatacttcaaataaatgtaaatgtaaaatggaagctaaatcagtttatcctgcacagctatacactgtgtaaggctcggtaataaaaggtacatgcttgttattttgttgtttgcttgcacagagacctgtagtacttccaattgagcactggcatacacccctggtaccatgtaacatgttaactttcaagaagggggtatgcttatcttattttatctgtaattagtcaaaaaaaaaggagctgttcatttaccattgtcaccacttacttcaaaccttataagggcttataggggtgtttgcttccagccaatttggaacatatgatttagaccgagtttgaattgttttcaaattaaaatagacgagttcatgcttgacgttgtaacatgtgtggaataatattttcatgtcagtgtatagctgatatgctcgttcctccttgcttcgactggagttagaaggacaaatctatatccaacacctgaagctcatgatttatttatttcacttgcagatcaccctgattggcacctcaggcatctcaggatcctatgtcgagctaagggcatgaggaaagtctgcagatcataaccatggcagaacatcgttttctgagggaaggatgcatatcagaacaaggtgttccgtttctcttttcttcttactgtgtagctaccttgccaataacaaggagatcatcaaacagatgtgcacttaaagtaattcagtgtgctccagaccttcctgctgtaataagaacgtgtttctggggttcacgtcgatttgtttttgctccagtcatggtggtgcgtgaagcatgtagattcagttgattccttgcatgagccgtgaattgtttgttcaagctcctactctgtatggctctattgaactcagaagtagcttaatcggtgttcagattccttgcatgagccctgatatgagctctattgagtacttcctccattttataatgtaagactttcttatattatgaaatggatggagtactaatgtttggctttgttaaacattagcacttgaatcgtcgttctgaatacagtacgacatcacggagtatggccgtgtttagtttcccctctattcccgacttaccatcatatcatatcacatcaaaaacttttctacacgtataaactttcaactttttttttaaaactctcaactttttttaaactttaaatttttttcatgaactaaacataccctatgttgatatgcgggacgtttgtctatccttgacttcagaagttataattagctagaatcggtggtccagaacttaggagtgatgtgatatgggtgtgtgaagtcgtcatccgaaggcaatgatgctatcgaccgcaattggacgacgaaaatgcctcggatgcccaaacatcttcctctcgctcgtcggctgacaatggcgctgctgctgggaacggggacacacctgccagttcgactaatcaatcatccgtcaccatgcgttagggctaatcatccagtcatccgtcacaccgttcgctcgagtacttcccagtgtcttgctgtcttgaagcattacagctaaatctgtggcttccaaggcgggggccccgttgccggcggtgcggcggcgactggcagtaacaagcagccatgggccatgcatggcgaagcgcgcgtatgagaaacgacgacgacgaagacgaacgggggggcacagcagcacacagcactacgcgtctacgcgcgtgccggtttgaagtatgcagtggcagcctgcagagacgtcggccgcacgcgcacgctcatacacacgtacggtgtcaaacccccaggctgctactgccggtgctcgtggacgcgcgcgccgctgtgcgtgcgcctgttcgttcgtagcagcagcatgcagtcggccagcgcgcgggcgtgcggacttcgcaacgttgcgtgcgactcggccccggttgcgtgtccatccacttgtgccagtcctgtagtactcctgttggcgtagaggaatcctgtccgaatctactacagcatgtactgtactacttcctccgttttacattaaagtcgtttattttttttattagccaaacttttaagtttgcttaagttcagaaaaaaataacaatatttttaatacaaaataatcatattatcaaaatatatttaatgttaaatttaataaacctaatgtgacgttgtggatgttgctatctttttctataaacttagttaaacttaaagaattttaactaaaaaaaataaaacaacttgtaacataaaaacatagagggagcttttatttgatttgtttggctggtagtttttttgagcggccagtagttaagaattggtgcagcttgtagcgaatttgcgatgcagcagctgcagcttgtattgctgacgaacagagccaatttaccctctccgattcgacctgcgcgtatcacagtgcattcacgctagcgttgcatataaatgcaatgcgggctggccggcgtggtcgcgtatgcacgtagctttcttcctcttcttgagttcttggtcgtcgcttcaagcatgatgcaggcaggccagctgcagcgtcaccctctagtgtaaattttgcagcagctcatcacaagttcacaacttacgcacagcacggttgcattgcacgccttgaccgatcgagaggtcaaaattgggtaaaagtcgagcatactgttctcgcacaggacgacaggcaggctggcattgtagcattctactacatttctattgatctttcagacgacggacgcgagacgaataaggcagggttcacaattccaatgaaaaccagtcgaattccgtaaaattttgacactttgacatggctcggaattaagtttcgattggaatttcgaaggttaaacaataaatttggtcaaaatttatcgaaaaccaatcgaaatttatcaaaaatcgtgatactgatggggctcaaaatttagtggtcaatcgttattgtaaaccctgaacggaggctagcagcagcagctgcacaggttatctttattggccgtgaatgtggtgcattggcctctttcgtctgcacctctctgaaacgtcgtccgcattccctgttcagatcgaatgacgagtggtagtaactgcgaaaagggcggcgaaaagatcacactattcgtgcgctcttgcgtcgtccttgccaatgtcctagaaagcttccaggtcactgtgtgggcgtctctgccagttaatgagctgagctcacgttctgcagccaccaacaagaggctttttttttaatcgcttgtgatgatctgagaggtcgtactgcacgattgtgttttagttatgatccgaaatgcaatttgaagatcgaaaaggaccgatgtctgacatgaacctctgcaatcaggcgttgtgatgaaagggttggtttcaatcacgagttgttcagatgatgtctcgcatgagcctttgcaatcactgtactaagacgttctaattaaaccactaatctcctcgcatgcattgcttggatgcagtctagtttcctgcctcctaggctcctggctttatctttctgaactagtcgatatcaaaccgtgtttgttagttcagacgagcacatcacaatttccaagcgattttccaagcgatcagcttattagcattctctccaggggaggaaaaaatatatattttatactgtacgaaaaagcagcatgtccaaatagcgtcatgtcatcacgccttcatccttctcgtccacacctgcttgttctttccatcgatagatctctactacttgaccaaatatcacaggcaaaaagtgtcaaccaactaccctctgcagaaggctagtaataagcatacgcactgtttaattagcgacaacatatgacgtgatattagttagttaattaattagcatcgactgacaaaggttagcgagatcgcatccaactacctggcgcaagtttaatgcgtatccaacacaccaaactttgagcttgtgaggataaatgattcagttgcaaaccgctattactgtcgatctcaacggccatttaaatcaaacgtttctaaatataagtatcttttacactattgagactactacttaattatcccatcaatcatatttcatttaaatttctttctaacctaccactaaccgtgaaagagcatgtagtctaatagttacagtgacctgagtagcatcaaaaatcctgagttcaagtctccatagtagggaatttcatatagggttattcgagagctaagttccatatgttcgataagctaagttcctaacttttaaaaaaaacttatcgctaaccaatctcacactccatgggcatcaaaagtatatattttctcctcgatcttaatctctactagacaatatataaatgtaacagttggaatggagagagtacatgggggcacacatatttaaatgtcttcatggagagattgttttagaaaacacatatagtttcgagaaatatttaaagcgacttacatcatgcaacaacgttttatctatatataatgagggataaaaatgatagggatacgctgccctctaaggagaaaatctttaatttatatggtcaaagaagtaggatcagctgttgggcaaggtgctcccaacttcaacgtttttcgtcaaagctggccctgcaattctgccccaactaagctgcaggaaagtcatcagcggccgaccaatttcagacatcctctccttttctctcgagagaaagaatgccatagcagtatgcatcatcatatcattggccagctgtaataaacaaatgaaatcaggtgtacaaataaaagaaaaagagcatcaccaactctgcatccccgagtaagaaaatggcagagaagctcccccccaagtgatcaaagtcgttgttaatcaccaaaacctgctcccttttctttgatctccaaaatatgtaaccacttcctacatggcacatgcaggctgcagctcatatatatatatataatcaatactactaattacaccacataaaaaatgtatctatataatgatctctatactatatactccaaatctatagctctccttctccttcttcttcttcttcttcttcatggagtctgcagctggctgtcgaggccgatggagttgtgctgcctcgacgggccggacggagggatgggccctctcggcaagaacccgaggaaatggttggaagctcccctctccaatggcctggccttgaaggtctgcatgcccctcgaagccttgcatctcggcaccatcagcagcagcagcagcagaagaagaagcacaagcaaggacgaccagcgaaactgtagatgatgatgagccttcttcttcctgcagcttctctgccagtagcaacccatgcagatcgagcagctagcaagatgaggatcggagactggagttcttgggagagttggtatgatgtgaaagtttgagatgtgatgagggttttggtgagtgcaaaatgcaggtgagaggggagaggagctgagggagctgagagatggtgatatataagctataagctgctagcgaaagtgttgagaacgtatatatgcgtagtatggacagcattgagaggagaggagagaagaagccgccattaaatttatataggagcatatgctggacatattcacagctcgcagattaaagggaagaagaaattaaaatgaaaatccacatgcatgacgttgttgctggctgctatgtatgtctgcgaaatgcttgtgtggaaccattcttctggtgcaaactgaagatatatatgtgtcatgtacaccaataattaagctcgatcacataaatattttttttgattatttgttggaaaaagaagaacaaagtggtgcatgatgttaggaggtttttaatgttgaatctaaatcgatacaatcgtgcatattggtgctcaaagtttaaaactgtattctaagacgacatctaaatataatacattaatacagctacaatcagataagattaggtcaaactgtcgaaatttataaaaaaaaattcaagtgcttagcttataaacaaagaatatggattttgatttgtcaagacgtaggtgtatggttttatccgccaaccctgatgtcatacttgggccatgttctaaagagctaattgaacttaactgcttcttgtttttcgttagaacgttttctaaaccgttaaacagtgtcttttatgtaaactttctatatatatggtgctttaaaaaattatttaaaaatcatttctttaaataattcataatatactaatcacgtttcttgttttagttgtagctaatcatccaaaacctatgggccgaaaataacacgcccctagtttgtgtttaaggatcaatttagtccctgatattctatattgtccaaacaagttaataaagtttattgggtgattttaatatagtccttagacccactaaaaagccacgtgcacacacatcatctatgcattcaaatcaataatcaaatatccattctacccttaagtttttcatatgaaaaaaataaaaattattgagaaaaaaagtggcatttggccattggctgccaaaagatgtagcatgcaatggcaactaaaacaatgtggcattttcctttgttttatgattgctttctacttgtttttccctttgtttttcttttctttggttatagaaaatgtaaggttaaaatggacatttaaatgttgactttacatgcacgaattatgtggcatgtccacgtggcgttttaagtgggtccaaagactatattaagacacatgataatatttaaggacttgtttggaactttagacattataaaacatcaatgactaattcgagtcctgagcaaaagttgaaggattgaactagctattcacccaaagacaaatgttacctttcattattgtaagggattgaccccccaaaattgtgcgaataaatttcatgagaaaattataaagaaaaatcaaataagaataatttggctccaattgggattgaaataggttctatttattgctcctagattacaggttgtacatatgtgaggatgataattatctcaggatgcacctatagaagattgatcaagttggtgaagaggttggaaataaatgtgcacatctacctctagctagccatggcctatgaagatatagttttgagactttgatcaggcacaacagtggtgatgaacatggtcggtgtggggttgtgcatggtgggtctgaggatgttgagtgcattaataagagaggtacttgcacctgtctagagagaataaattcttttggagtgagaaaataagggtttcttttcttctttttttttttttgagaggagatcaagggagattcagaagaaaaggaggcaatgtgctagtagcagcgaaagaaagctcatggccgcaaggaaaaaaaaaggtgtctgtctcctctcatcatccgtaggtgagtgaaaccactgcatgccccacttggggaattcaatacccgacttgggcacttgctgatttgcataaccgttcgtgcatgtacctacaaacatcagtgattagctagcaggatcagcagctgcggctcggtgcttagctgcttgttgtgtaggagtatatcttctgaattttgcaactaggggtgtgtggccatctctgatgtctccctgcatgtggcccttgtgcagttgtgcttgtgtgcccacagtacttagcagaaagatacttgccatgccgtcagatactgatatgttttcgtactatatacaatgtacattgtattgtatccggaagctctcagacgaaacaaattaaatgcagatatttgaccagtcttgcgtagagaataatacagtacatgcctctttgatgactggcgattggcgaacaactgtttctgaggaacagcactg

SEQ ID NO: 62054 - DNA, 7051 bp, Oryza sativa
  unsure (1)..(7051): unsure at all n locations
cagcggcggcggcggcagcggtggcaacaccagcaacggcggcgccgcccgcccgccgccgtcctactacgccgacccattcgtccccagcccacgtcacctcctcgccacgcccaccgtgccgtcgccggcgacctgcgccgagctcttcagcaacctgccggatctctagcccgccgccggccgccgcatccgtccaaggcagcttcagtggcagaagcttagctccatttcctcttttcttttttttcccctccattttttttctctctctggtaggctcaaggtggtgggcccgatcactgatgacaaattgattagtgctccgtttcatccatgcgctttgttaattattcttgggcaaaccacttagcaatgagaaggagcaaagaggaaaagaattgagaagaagaagaaaaccccaaaagaaacaataggcagtggcaaaagtagtagcagtagcagatgagagtgtaagactatagaacaaaccggctggcccagccatgtctcttttactcctagttttcttttgattcagttacatctcttgtgtaaggttagggaaagattgcttgcttaatgcatcatttgtttattctttactgctggtgtgcctctgattggatttggattctgcatgctgacttggtgcactagactaataaaaaccggtactgtatgagtaaagtaaaattgtacttaaagtactgtggataataaagtaagtcataaataaaataaacaataatttcaaaaatttttgaataaaatgagtggttaaacgttacaagcaaaaacttaaaatctcttatattatggaacggagggagtatcactactagtgtgatgtttgtgtgtggactgaccgtgtcagtggtagcaaatggagttttcgtgccggcggaaaattggagaggagagtagttgttgttggggccggggggcggagaaaaaaaacggtggtggatagggatttgcgggtgtgaacggggaggggattggaaggctccgtttttttgtcgctggcgtcgcacgtgntcccnnnnnncngngggggggggggaagattcggtgcacccgttcacggccgggaaaagaggcttcgcagccacggacgcccggaaggagggcagaatgggggcctgtgtcgtgccgttctcctcgctcttttgccatgtggctgttcctgaggccgtcggtatcttacggggaccaaagatcctttacactgaaatgcacggtatcattaacatatggttaatgggtccagggtttcacatgtaaatgataaagtcaagtgactccgattatatagaataatgatctattttttggtactacggatgtgtttattgctgaccgtgctgagtttgatggatagattgttagttataaagtattataaagttgataaaaaaaatcaagtctataatatacgagacatagtgagatgttcggctgctgggttgtgactgcgctcactgcgagcagctgcagctagcacgaacaatgccgtactcactgtgagcagccgcagccacagcagccggcctaccgaacactcctagtattaaaaaaaatatggtaaaaccgcaattgttgagttaaacaaacgtatatgcctaataccatcgcacaaacaaacagacgacacaccaaacggggcaatgcttatttcaagactataaattttagctaaggatttctttttctttacaaccgtagtctgtatattttatacgatctgtatatcctcatctctttattatatcataaattttcaacgtgaatatgacatatgctaaatattagcatttgtcgatctggcgagaagatcatggaggaaatattaattcacactatctaataacgttctattttattttttttttattttcggcaaggaatattcagtaatatatcgatgtatttcagatagctctttcgaggcaccatatgagttttccagttaagcatgtggatttttccttttttagaaatcggtactgctcaatagatatacgacttacttcctccataaaaaaaaggaaaatgctaaatactgggataccgtcgtgctacagctactcgcgccagctgaggacggcagcgacgcgtggggcttggccgccgtcgctgaggtgctgtgttgacgagcagcgcgagctcggcgtcggagcttatggaggtgggttgtcgcgacggccggggatgcagctgtcgccggagtggatagacgtggagcaaggaggacacggacgccggcgacgagctccaacgtggcgtggacaggggaagatgcggccgtcggcaacgagctccggcatggggtgtggatgatggaggatgtggctcccgcgacgagctccggcgtagggtggaggatgccgccagcggcgactagctccggcgtgaggcgtggatgacggagtacgcgcccgtcgccgatgagctccgacgtggcacggacagggaaggatgcggccgtcggtgacgagctccggcgtgaggcgtggatggagaatgcggccatcggcgactagcttcggcatgaggcgtggatgacgtaggacgcggccgccggcgatgagcttcgacatggcgtggagcgtggaggactccaccgccggcgacaagctctggcgtgagacgtggatagtgggaccaccagcgacgacactttggtgcccggctcctgataccttataagtattacctaatacgtggtaggaatcgcctgataccttacaggtttcacctgatacttcgcaagtatcacctgatacataatagaaatcgcttgatatctgacaggtttcacctgatacttcgcaagtattacctgataagtagtaggaatcgtctgatacctaacatgtttcacctgatacttcgcaagcatcacatgatacatgatagtaatcgcatgataccttataggtatcagctgatacctcgcaagtatcgcctgataaaggtgaagtatcagaacatgatacctcagaggtagcaggatctaatatttaaccggtatcatccggtcccaacgggattctgttgtattagcagcctcctaaaaaaacaaagctagtttggtacggagggaatagctcattccgacgatgaaatagtgaactcgctcctaaacagcagcaggcaaacgtacagcaaaatgagtcaacatatatactcctactttttctggaactaaagagtcaatcaacatatatatactcaacactaggtcactagcactagtagcaaccattaaccatgcatagacttggaagacaaacgcttgatcgaggccacggtgatagtcatgtactccctctgtttgacaatgtaagtcattctaacatttctcatatttatattgatgttaatgaatctagacacatatatctatctagattcattaatatcaatataaatgtggaaaatgctaaaatgacttacattgtgaaacggagaaagtacatgtacaaacaggggcggagctagtattgttagggaggtgcccagaaacccggttcgaaaatttttttacctatagtttatctattttgaccatatatataccccgtcagtttaaatatagacacccgtatcaagctaaatttgatttaaaccagagtaaagcaagcgagtgaaaccccttttattttattctagctccgtccctgtatacaaaacatagctcactgcactccatttcaagaaatagcgccgtccttagctatcaccattcgccttaggcttaagatggtggtggtagtgttgtggaagcagcctgagcagtaacttcttgtccgcctggttggacatttcaccgctggattattccatctcgggtagcagattttgagcagctcgttcttcttctcctcgacttggctagtcgtacgttgttgtcgttgttgttgttgcaggtaattctctcatgttgccggccggattcgtatgatgagacggcgtgcgcggcgtgtgatggtttggtgctccgccggccgcggaggtgaatgagcggaggagcggcgtcgtacgtcgacctggcgccgccggtgccgggggaataagctagcctcggcagcagcaacacccgccattcttcctccttgaggatagtagccgccgccgccgccgccgtccgtagcacgcgacgtacggccgccggctccgacgacactcttcgccgcgtgtcgaaaagccgccgccatgcggttgatttcgctctctgcgtacccaggtgtgggcgtttcgtgatctcttctctattttcgcctgccctttttttgtcgatcctcaaacataccaggagtttaggtggacatatgcatggtgacaccatttagctatccgatttgcactattaatagagaatcaattacaaactaattttattatggccgtttcagttccaacaatataagtttgttgtgctcttgctttgttcccgagtacggcttgtggatcatgaatgagtccatatagaacgggaattaccaagtgtcctatactaactacgtagacataactcctttctttccgtaccaatatgataaaattagtggcatataaatttataagtaaaatacaccaacagctcctaaatttgttatattgtgtcatataggttcttatactttgaaaaatccaaatccatagatcctagaccttattaaagtgtgtcatctcagtctaaaattgtcatgacccattagaaatcctacttgacgctaatatggttgtcacctcctcctaatttttttagaaataatattattttaatgaaaaattataaaagtagaagctgatcggccgccctgtcaaatatccacagtttgacagggggacatatcaaacaaccataattcgacagggtacctgtcgaactgcggttgttcgacagggcataaaaaataccctatcgaactgtccctgttcgacaggagataaaaaatgatagaaaaaaagagatcaatcactatgcgcaatatacactactgtgcacctctgtgcatgcagacctatcgaactttggatgttcaataggccccctgccatgctctttatagtccttttctttttttttaagtgaacaacaaccctgtcgaacaactgtagtttgacatgatgttaaacttgcaattttagccgaccagtttctacttttgcaatttcccattaaaataatattatttctaaaaaaattccctcctctctaccctagcagcaacaacctacacagctccactgagaggcaccgctggcaacagtggcagagacaaggggacggccggtggctggctctctgtaacaatttttaatacacagttatctaattaattagttaattaacctaagtaatgatgtattagttgattctgccgctggctgatagagagggaaagaaatgaggtgacaggagggaggaggtggcagccgcgctagagctaatagtagcccactactgtctccaaatcatttatagccaatgtaatagtcaattcatataatagtgttactatactattaatacatggttccacctgtcatacacacattacatcttgaagtctgtgctgcagctggctacagatctgtaaaccgctgctcttctctcttttttttatctctttaaaatatgtttatagctggcttatagcctgctattatacctgctcttagcgtgacttatattatgatcccgaatgagccatgacaattttgaactgagacaacacattgtaataagtcctagtttagggaccacttgtgtgtttcactctagatttaggtccggttggcacaactacagatcacataggccctgttcggcaggtatggctgccgcagccgctgcggctgcggtagttcaaaatcgttgtaagctgcagcaatttcgaaatgttgcaaccgtagccgcagctgaaaaaatggcagccgaacacacccatattcactgtaaatttgaaatttcaatgtttaattaaagaggtttaaaattttaaattttatctaaaatattaaagtggtttaaaattttaaattttagctaaaataggaaatgttatgaaaataatcgcaaatatagatttatagatttatggagttatgaatatccagctctaagaaatattggatctgtagctgtgccaacaagagacttaacctatgcccaacacaccatgcaagctgtatctagatccacccataaaataatgtattgctacctatgagaattttcttgccaaataacaagataattgaagaaagggagtagctatacaatattagacaattgattatacaatattagacaattgattggtagaaaaatttaaatgtgacaatagtataattaaaatataattatattataaatttacaactatattataattacgttataacttacatatagcttgtatagaaaaaattgcatgtggccagttggttgttataacttagaccttgtttagttcccaaaacaaaaacttttcacccatcacatcgaatgtttggatacatgcatggagtattaagcctaattgcgccatgatttgataatgttgtgctacattaaacatttactaatgacagattaattagacttaataaatttatctcgcagtttcctggtagaatctgtagtttgttttgttattagactacgtttaatacttcaaatgtgtgttcgtatatctgatataacaaacaaacctaaaaattttccccaactaaacaagatattacatctatgcatccttcccaccacacttggcacaaaatttgttctccctaccccgccggaggtcgtggtcacggtgcattggaccatggagccgttcgttgtgcatgtcttgtcacattttccacatgcgttccctcggcttccccttaccatcaaagcgcgtgtattaggggacctaccaaatagcagcactcggttgatatttgtcaagctcccaaaaatagctcccttttatcatccactttggcgtttcagctataaccaccacaaaggtaccaatccttgcttttt

SEQ ID NO: 62055 - DNA, 3064 bp, Oryza sativa
aacatatgtttatggtacatgaaaccatgttgatagacattggacagaaattgtattttcagacaagcaatttgagtatgattaattgcgtatgctagcaatatagtaagatacaagagaaaaacttacatctgactctgaccatgccatatccaggatatcatctgtatggccttggaattcatgtaatggagtctctgaaatgcggaaacccttctttggcactactgcaagggcatgattcttccctcttcctagttccgttttgatgattgtaattttatcatcatagttctgagggttgtctcccccatgcaacttcgaagatgcttccacttccataatctgccatatccgtacaatgcagtcctcaccaccagttgccaaataccagcctgacgggctgaatttcatgactttaattaaacccttgtgagcttggatttcttgacccagatggacagcagaaaattccatagtttttttctttcgatgttgaacttttgttctggatggtatgcctattgtgcagttttttacattgacgtcgtgcttgcaaattccaccaaaactcctgtttttcatgaagctcttccacaagctcttgacaccctttttcttattaaacacattctttttctcttccatagaactgctatacaccttgcgcaacaacttttgaacagattgagaaaggcctggtacgccatcaaactccagaagagacaccaccttatgtgatgccacatccttaagcatgctagtcaattcgccgtatccatcattctgaactgtgtatctctcgccactgtcaatatctcctatgcaacaggaggcatcagaaactgattcattctcaggaacagatgaattcacggaagaaatgtcactggtagtactctcctccaaccccaagtcagcgaaaggaccaacagttgtgatttctccctgtggttgagaaaaatccactctggtagcaagaaattcatcaaaccccattcccttcaggaacctttgccgcctttcttcaacactcattggctcgtttccccaaatatcatactcaaatctccttgatgctaatccttcgtcacttgtgctgcaatcatctgacaatgaaggctcccttgttgaagtaacatcatcaaatgcatcaaagaagatatcatccctgtctgattcggaacttggcatatctaaccgaaatacttctagcccaagaaaaagaatcaacacagaggggggttctctcaccctctgtgaagttagcacgcggtgctcaaaatgtcatctgcaattggcaacacaggtaatcagcctcgtgatatatatatagcaaacaacaacattacctcctaatgtacaacaatatggactacatggacataaaagataattgcaaatttaaccatttacagagcacaactaatacaaaatgcaaacagtgaaacagaagaagcatctaattaccaagaaaaacaaacaagaacaaagcacaggatgctccttgcctctccccacgccaactgttccctgaaccaataactcaccaaccacgcacgcaaaacccaacctcggggatcccacccaacatgaggagcaggaacaggaacaggagagcccaaccccaaccccaagaacccacacgggggcgcagatcccaagtaaccgagacaaagcaacagctaaaaacagcgcagaaaggctaaaaagggacaaaagtaaaagagagttctttgattctttcgactagggggcggctggcaccgtaaaaactgctgctaccgcgcagtgccggtgcttggctggctggcagcacgggcccacctgtcagcgacgtgcgcagccgccgcgcgccggctatcctacctctacgccgatggccacgcaggctcagggcgtaggcgagtagttggccattaaaaccgcgtcctttattaaggtgttcaaagagagagaggaaaaaaaaaaggtttttttttctgtccaacaacgaaattctgtggcagaaatgcaggcctaaaacaaaaggaagaaattttgactcttcgctttccttgtttttccccttcaataaaatgatttaggagtacactgaacctgcaatcagacggattaaagtttcgcacttttcaaaatcatttagcattaattgagtgctataaatctggcggctgtagcaaaatgaaaacatgaacagaaaagggattgctgatttgctggggttgaaagaacattaaagattctcgactatgcgcgccattaaaaggaacaaaaatccgatcatcgtggcgataaagcgatccgagagagttaaaagctcacccgttttcgtaccgacagaaatgaaaatttgaaactttccctctattaaaacgaccggaattttcggtggtgggcgagtgctttgttctcgggggaactccacaaatcctcggctaaatttgcgcagcagaatacaaaaaattcatgcctagaaaaatccaaattcccataaaaagaaccgagaaaaaaatgatgaaaacaatccgcgaattcctaatcggctattcgtgtctcccctcgaactgttccattaaaacaggaaaccaaaccagagagaccaaatcactgcgccattccaaacgctaaaaccacacgaatcgatcctaaacggaaacaaacttagtactactagaaaagattaagaaaacccgaatcccatcgtcaccttgttcgtcgtcgtcgtcggtggttcactccacggaggcggcaggaagaacaaccgccgccgccgttcgtctccacccgcgccgcagcgccatgcccaaccaggtgtagaggaggaggaggggacacagagggggggggggggaaatggtggggagagagtgggatctctcgctcctgcgcgagcgagcgagagagagagagggcttgggatttgggattctgcttggacgcgtccacctcgcctcgcctctcctctcctagtggccttcgttttcttggcgtttcgttgtaaaccggagagagctttgtatccctaatgctgatgatatgctaatatgctaatcccaaccaa

SEQ ID NO: 62056 - DNA, 678 bp, Oryza sativa
attcctgcagcccatacaagaatcaatagtaggactagccgcgagtaactttacttggtaggactaggtaatatagattagtgcagcaattaatctagtgcatacatgcttgatgccaaaattaccagtgcgaactcccaatgataagctcagatactattaggatttaggactaggatatagcctgacgcccatgggtgcttgcaagggttcacaccttcacatggcaatatggcataaacatggccacgtacgtaggcgatcaaaaaaaggtgtataaaaatcgaaatcttcagacaaactgcaggcatgtttgtccaagttcacgttttttgctctgacaaacctgaatgggcattcttcgttcatctcctctgcatatagtactgttctttttcctgtgacatgtggcagagtgacaggtggctgcaataacacgtctctcgctgactcgctccaaacctactctgatcctgattttatcgatgtaacctcgtgcctcctgtaaggatcggcctgcaggaaatgttggttagtggctcaaggaatgggactattggtgcgctcttccaccggtttgcttgggagtatattcatgatctgcacgttgcgaacttgcagtgcatttcttcagttgcttttagtgtagcaccttttctttcgacagtgtcgcgtatc

SEQ ID NO: 62057 - DNA, 660 bp, Oryza sativa
tcctgcagccccttgcaacacgtcggatctcaattagtatctgcactaaccatattgatctaacaaaacatgattatagtgtaagatcaatgtgtgttttgattcttattctgtgatgaacaattgacatatgtgattatcggttttgatatttggagattatcgtcgaagtggttttggagataatcaattttcaggagatgaatagggtttactgatttgtcgggaccggtcagaccgggcggttgttgccggtcagacaggagctatgtgagcggtcagaccggcttgcccgcggtctgaccggccgacgctgtgtcggtttcggtttcgggttgtttctttggatatccgtgattgtttcatggttatggcttatagatggatactatacgtatataatactgttgtttgctacgaatgagttaagttggagatagcttggtctcgaaatatggtttctttgtttgtttcatgtataggtgactcgatgcctcgggagagtatttgcggtgatggaccgggagtcggcttagtggtaagacgatatccgtggtggttagatatcatacgagatactaagactagagttgatgcacgtggttggtgaagattccatatggcatacgatggaggtattgtgtgcgtatgggatgcgga

SEQ ID NO: 62058 - DNA, 675 bp, Oryza sativa
gagtcacgtcgcattacttggtgacctcgtcgactagctggatcggcgtccgatgggtcgatctctagcggggagcgatgaatttagggcgaattcagggaagggggatttgggtttaaggtgtttggttgcttggtggagaggtgggttgtcatggtcgccgtcagcctcatgttcaccgcctccttcttcatgtatggcgggtccaggcagtcacaaacgtgtggctggtagctaggcacactggggctgtggatggcacctgggtccatcaccacggtgtaggtcatcgacgccggtagtagcagcaaggtgacgtctaatgcggccacccagtccatcgcaacaacgggacacaatagggcttgctgcttgggaggacgaggcgcttggacagcttgaggccatccaccaccgccaccctgaagtctaacacaacttgtagccttcacatgctcttcggtctctgtctcctactacctctgtttcaggttataagaagttttaactttggttaaagtcaaactgtttcaaatttgactaagtttgtagaaaaaataataacattttcaacccaaaacatttttttatgaaaatatatttaattattgatttaatgaaactaatttggtattataaatattactatatgtgtctataaacttagtcaaattt

SEQ ID NO: 62059 - DNA, 676 bp, Oryza sativa
attcctgcagcccatgtcaagtgggatcctatcatggcgcggtgtgggccgcgcgcgtaacgacggtgggagaggcttgcgttcttcccagttcggaccgttccgttcattattggctcgatagcgcccggcccaaccgaaccgatggcgccgtgcacgcccccccgcctactcatccatccatcccgcgtcgctctctccggcgaaaacctgccctgcgtcgcgcggcgggtggttggatggagcccgcaccgcaccgcgcgtacgtcaccccgcacgcacgcgcgcgatcccggaggatgagacggatggccgcacgcgatgcaccagcggcgcgcgggtcgcggttgcgcgtcctgttgctgctgcctgccatgtgccatgtgcttgcgcccccgcacggcaaagcggcatttccgtcgagtctcgtcgatccgtcatccgtcggctcaggagtcgctgcccgcgggctgttctcgtggtccgtcggcctagaggcatgcaggaggccattcgatcgagcgtgcggcgaggaagctaggtcgcgatcgatcgatcgaccgctcgctgttcacggcgatggaggaacaggatccgactgtactgccgatgtgtgccgatcgacgggataagatgtttgtgtactgcgcgctacattggacgggatcttcaactc

SEQ ID NO: 62060 - DNA, 793 bp, Oryza sativa
aagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacatggaggagccccattgccggcaacgagaggagggtgggaggagaaagggaaggagagatttgtacacagctgcagccaggtgagacccaccatggtacgttgcgccgcgccggcttccgcgcggcggcaacatgccgtggcggtggccgcagatgcctcgactgcaaagcatgtcggcgcggggtgcagcggccagctgcagccgtggtcgtcttaccgcgcgcggtccgcggtgcttgccgtgccaagacgtggagctatgccagtatgcctctcgtgcgtgctatgttatgagcaaacaccacgtagcatcaatataatccctccattttatattataaaactttctagtattatccatatttatataaatatttataaatctagacatacatatatatatatacatatatacatatacatatatatatacatatatatatatatacatatacatatacatatatattcattaacatctatatgaatgtgggcaatgttaaaaagtcttataatatgaaaaaggggaagtatgtcgcaaacaccacatagcatcaatatatgtcgcagag

SEQ ID NO: 62061 - DNA, 656 bp, Oryza sativa
cccctgatgctccaaataaaggggggagagatactatgacagtatggcactagcttagtatcccggatttggagaggcttgaccaccagatattggtgtggggatgctctggcatctgatctccaggactccgagaggacaaaggttgcaaagctatgagcaagttccaaagctctgggccttctctctccccccacaaattatgcgaaagtgtgaaacgtccctctcctctttatttcccattaagggaccgagaccctatttccagatttgtacttcgagaatgcaagatgcatgatagtacaagtaccatagcagatggtgagaatcttgcagctagtgtcaattttgggcttggcatctcatggccagcagctttccagattttgcagctctgccctgctggttaaacggaacctcactgccactgccttgctacagctttgcctgttggttaaacggaacctcacctagacacagtcttaagtattgctatatatactacagtattcaatcacacatataattccaagcaatgaaacgccaaaaacatgactgaagatgtcagagattcagaggccattataaaagctgcaggtgaaacaaacagagggagggcagaaggctcctgcctcctggtggctggttccttctgg

SEQ ID NO: 62062 - DNA, 1719 bp, Oryza sativa
taaatgtagaaaaaaaaatcactcacacagattgcgtgtaaattgcgagacgaatcttttaaacctaattgcgccataatttgacagagtggtgctatagtaaacatttgctaatgactgattaattaggtttaataaattcgcctcgcggtttacaggtggaatatgcattttgttttattattagactacgtttaatacttcaaatgtgtgtctatatattcgatgtggcacataaagccaaaacttttttttttactaactaaacagggcctcagtgcaggacatgggggcaaaaagttggaggaagggaggtgacccgcgtccgcaccaattccatggggtgcggagaagaggcacggaacgccggcagtttcgggagaggtgcctgcaggttaaaggtgagccccacaggtgggctcttcctgttggcgacacgaaagaaggagggacgtcaattcgacttagaggaaaagggaggaggctagcgggcttgaggcccactagggagggacgaagccggccgggagaagagagaaggggacgggcccaagggaggcgaagtggacttagtccaaatggcccaaatagaaagaaggagatttttatttgtttttcaatttaattaattgattaagtgatgtttgtgcttttaaaaatacttcttgacctccaaaaatccacgggaaattctagagactattttagggcatggagaatattacaaaaatatttccagccatgattttaaaagtaaattttatttccctcattaaattcacctgttaaattgcttttaattttaatttaatttctagaaaataaattattaaatgatttttaatcccgaacgaaaattggggtgtgatgctatggcagcagcagcccattcaattccctggtaatccctctcaaaatatttagaggcaagctaggaattgagcaggcaattgaattgattagactttaagatcaccaggttattattcagcagcccttatctatcataacatgaactgcgaaacaatgaggactgaatctaaaggtcgactataaactgtgcatatctacatttgtgaaaagtaaatttcaagatttcacaacactgagccacgtcatgtattaattcatagccattggattaagaagcaaagaaaaggtggaatggatattaaccgtccgatgtaaaaggaggaagtcggtcaaacaattccacatcattttatcatctggagtcctccacagataacagattagcgggagagaaaaaagaatgaggaacagctacagcaatggaaaggaaaaggagggctgtggaagtgtagaggtacaatgggggaatggggatgtaatgacctttttgcattttagtcctataataaaatataatctacaaactaaccccataagttacaaaatgcatatatgtcaatgttattaaataattaggcatattctagagatataaattaatacctaagacatttagtacaacatattattataagaaatttggtagaatgcgcagatacatacgcataatatagaaaaaaatgataacatgatatatatgcatataggaaaatttataattttgttttttacgataaattccataggtttaatgtagccagagtaaataatttattatcattattcgattcatttatcatggatcaaaataaatttctctgtgtcatatctagacttcctatcaaa

SEQ ID NO: 62063 - DNA, 1362 bp, Oryza sativa
  unsure (1)..(1362): unsure at all n locations
cgattggttatgctgctcaactgtagtgtaagattactcaaattcggatggaagatggtaaatcaaatgattcgaaatggaaattgggtgactagtagcgcttaggtcgatcttaatcttgtaagttcagtttaacccagaactgtaatgagttgcggaaggattttgtgcaatttaaatctattcaatcagtgaatctcgcttgccatagtgtactattcagtggcagtggcacggatgatttagatggtgcaattagaggtggttttggcatgacatttcttttctttgtccctgttgcggctagagcagctagaatacgtncnaatattgttcagctttagagaatagtttccgtttcatattgtaagactttcgagcgttgtgtagaatcatatagatgttaatgaatccagacacatatagatacctagattcattaacatctatatgaatgtgggaaatgctagaaagtcttacattgtgaaacgggggaagtagcaaagaagatgaccaggactcttaattaattcggagtctggtattatagagttattgtttcagtaggatatgaagaatgcagcatttagagttattttgttgtctggttcttatcttatcatccctataatagtactaccacgagatggtctgtattcaaatttatcaggttgattccagcagctaagtaaaagcaaacttcatagggcaattgcgcctttgcatttgcatcacatattcacatggcaacccttaaaatgtatgtatgtctgtacttatatgttgcggtgggtanacttaggaagtagtcagctgctctatacttccatattgcatatgtgaattaaaagatctgtcatgtcataagtaatcggttttgtttgttctttggttatattagcatcacgggtgtgcatccaattaatattgattactgccttcaactgtaacatatgttcatggctgaattgctgcaatcaaacatcatctattttacaagtgacaggagatgttacaacgaattctgtttacttgatgtgcttctcatctacacagcccagaattatatttgaatttaacttctttgcaagtctcttctttatgtatttgattttctagtttcttatgtaacatatactgataccaaactttcttgacatcataggaagcagatggaatccggccttttacaatgcctcttatgaagcttgcttgcactgcactggaacgagttccattgacacgaaaaaaaataattgataatttgatgaagaaattccaccaagatttggtattctgccgttcacctgatgataatgagctgactgtaggagtttatcgtaagttgtttcctcttgactg

SEQ ID NO: 62064 - DNA, 4084 bp, Oryza sativa
agaaaattggagtcattcctgcaataatcctacaaaatcctatctcataaacaatctaattaaatctctcttttttatatacaatgttcttgtcaacttttattgtttaatgaaaagaagatttttattttgattaaacatgctaccaagaaggcgtagttcaaaaagcgtcgcccgctcccgcgtcgtcctccctcatgggcgacacgggaggcggaaaccgccggcgccgcctgctcccccccccccctcctccttccgccgcatcgccgctgcccaagcggccatcggcaaagccgcgcggccgcaaggacggcggcggcggggcttcgtcatcttcgtctccctctcccgtcggcggtggagggccgcgcagtagacagtgaagaccgcccagatccgggccgccgcggccggatctggtggggaggccaccggcggagggtcggcgtgaggtggcggcggcagccggcagttggtggtggtggtggcagggattgaaggtggtggggcggcggctgcagttggtggtggatccaccaaattaaatgaaaattgatggctagatgttttgcttttttcttagaatttgtaagatttattaaagcggcacgtggcaatctaggagcgtttgtaggagtctcacgtggtggctttagagtgtttatagggagtttaatggacttttagtatataatagatagattcattatcaacacatttgcataaggatgtttatttagaaagaatttagcatacaaactgtgtatatactcatacagctggtggtctgatctgatgatgggagcagcaacaaataaatctataggtagacgaagctaggagcatcagatcaccttgtcaattggctgatcatttgtctccctgaccaaagatgtcacatcttcactgaaatttgcatcgacaataatgaatagtgtttggtactccctccgtcttaaaatataagcgttcatagctaaaaatacttatattttagaacggatggagtatatattatacgaccatggatggatgcatcatacgtagcactcgtagagcttgatgtccatctgcagcctgaagtaggtgaagccctcgaaagcgtcggtgcggagggtggcgacgccgcgcgacatgaagaagtcgccggtgccgcccacgacggagatgtccctcgtcttctcggcgatgatgtcggcgcccatgaggttgagcgtgccgcggcgccccgtggagttgaacacgatggagaaggcgagccacgcgttgaacgcctccttgctgttgtagaggtagagcccctgcgccctcaccgccgtctcctccagcgacggcggcagcgccctcccctccgtcaccgggtcgttgaacaccaccacctcgccgaagaaggtgccgccggtcgacggcacggcgttggccagcgccgtcggcttggtggccgccgccgccgtggagttggaggtgctgttgctgtagtcgtagaggatgtcgtggaggtacagcctcatctccatgcacggctcgtcgtagctcctgacgaacctcctcctgctgctccggccatggacggcgacgctcgccgaggtgaggctgagcaggaagatggtggcgacgacgatcgtcagagacgccatggaccaagtagccgtccggcgcccttgcactgttatccaagcttagctagctagctgcagctgcctgtgattaggagctcgagatttgcacttctatttatagagatgagaaatggtcagggtcttcagctatagctgtttgagagggttctagctatttgctttcatgtacaatttagccggtatagctccatttagcccgctatagcagttttagaagctaaccgctaaatatcttagcccgctatttaaaatattgaaaatggtaggctgcatgcatgccaattatctggcaaaatgtctttgcaagctggagttgtttggatcaagagggatagtgagactaccatcatttcacctacaactatttattaaagaaaaaaatagtttgtgaatacattttttatatatgcatgtttaacaatttgaaagccggtgtcaaaaataaactactacgacaaactctaaaatcaacttcaaaattaaattttaatatttaaattttagggtggctgagaggcaaaccttagacttagaggggctgaggcacaactataatattgtcattcccttcgcttttcttggggtttgttgcttgaatattgctttgattccaatgatgatctgatgctgatgctcatacaggttaattactgtacgtacattcatgaacatagaggctgcaaaaggctagcttcaatggagggttaccaaaatatatatattataagaagagttggtgaattacatgaaagataagaaatgttacaaagaagatggatcacctaaaggaagaaaacaacaaaggaattatgctagccaagtgcttgattggttaatttctgcaaaacgccgccacacacgtgcttccacaaaagtccatgcagtcgaaatcattagtgaaatcaggccttaatttcttccttgttgtggaccaatcaatctgatttgcttcatcagggggaggggtctaatggattttattggggagcacgctaataagttcaacagtaccaattactattaacagtaatattgaccctgaaatttctaatttccgatattaatcggtatttcaaccgataatatttggtcactatgttcagtccaacccactaatggtttatttgacctcaccaccctacactttagcccactcatggtttctgaaatcaaaatccatatttgagttcattcctctgctcttcagttcatgcagcaaattgttttctttagcagatcatttcgctcgtatcagacggctttcaacaggtataaatttgcgtctgctcacatgaacgacgaacaaaatgcagaacatggcctgaaaaaaaaagagatcaaaggggatcggagtcctccgacccccactccaagtgcaaagctgcgaaaatccatctgaaaaagaatcatcaaactggaagagcgaagtgttgattcatgtttcgtagcagcagatgattttctctcgcttgtcggtctgtaggatttaaggaatcaaaatttcaaaccatggcatgatgacaagacaagtgtaaattacagatagtgtttgatggtttcagaactgtctagtactgttcagttattggggatggttcaatttcttttaataatggaaattatttacatctcagccatctgagaaaacaaaaattatcgtgtgatgggacaggtccccaactcctctaaaaaagatggctagctgaattaaaagtttaaaaaaatcacataaatattaaggaggatttttttaggtgctacgctatctaaaatgaagtacaaagattacaaaagtatagcatcattgtgcatagtattcccttctcctgtgaggcaggttcaattccaactaccaattacaaattgacaatgaaattaaaattctgaaacttgtagtttttggtacttatcagcatttcactttaaatatttggccattatgttctgagattttcagttaaaacctctactgattcatgcgaactcttccccctacctttaggctttagtcctctcatggttcctgaaatcagaatcgatatttgagttcattcctgtattcctcactcctcgcagttcgtttttttttttccgaataagaactcctagcagttcggcagttcgttgcttagcctcatctggaagactggaatgaccgcaaaataggttttctgttttaacagatcgtacggctttgaacaggtttaatttgcgtctgatcaaaataatgaacgaagaaaaaaaattcagaacgttaactgaaaagaaggagaccaaaggatgtcggtctgtcggagtttgaaactccaacccctttcccatcacaaactccgtctcctcgctcgctccggtcgctccactcctagctagtggtggaaaaaaaaaaagcttaggctcatgagctcagctcgggcttggctcaaccttggttggcttagctc

SEQ ID NO: 62065 - DNA, 1183 bp, Oryza sativa
attcatcatattggctagctcggtgcaatgacctggttaaatgcacaattactcaggaagaatttaatgttatactacctgcagaataatcttttcaggagcttgataggcctctaagaaatgacacacgttcacaaaagcccattgcttgctggaattatcttcacgtttgagatggttccaaccgaactttatgagttcctttcgatggtgaacaagatcgctctgtagatacttcagaagtaatgttgcaagctgaaggagttctatcctcaagggttcatcatattcagcactgacctaaaaatatatacatataaaaaagcattgctgtcatggggaagtaacaaagagaaggctgacaggtattaaggtagagtggttcacttcccacctcttccggaggatcaagaagcttgtcaacaatagttttaataatagatggatcaacaacttcccaactttgcccattttggaaagaatgagctagcattggaaggataagtatctgcatagcaacgactaaatgatcttgtccataatgctttgactggaatatgttcagaaagtgattaagaataattttcttcaaatttggtgcatagccttcagcaacctatatggaaaatgtaaaaatggtaagaaacagaaagaactggagagcgacacaagtaactgtcatgaattagaaaaagaaatggtgtcacctctataacataaaattccttaagaaaactataatcaatgcggctacggtacaagaatattgatagcatatcaaatagcgcaccaacttccgtacgatcatgccttagataatttaggaagcattttatgagccgcttgctttccatcacctgttcagaaagtaagattgttaagatccaaaggtctagacacttgattagtgcagtatggaaagatgcaaggatgctaagaaactttaataaagcaatttattgagatgtaaagcacagataacatgtacgcatcatgtcagcaaaacctaaatcattgaattcaaagaaatcaagcgcataagagaaaataagcacccatactaccggacagtgtttgcccattgaacagaacatcataaaatccagaatgataatcctactagcatggcagagataacagtatataacagatagtagcagtagtaaacaaagatgccaaaatt

SEQ ID NO: 62066 - DNA, 661 bp, Oryza sativa
cccctttttttaataagaggttctggacgctcgatttttagatggtgttttttttcttctgaagataaaaataaaaataaaaattaagttttatatgcaaaataaggtggtattaacgtatgattgagttttaattattacaaacttgaaaactagatttatatgatattttaaaacaactttcatatataaaatttttgtacgaagtatacggtttaactttcatataaaaagcgtgccacgaaaatcttttcaacttttgcttagagaaaagaacgggacccaatgatcttgcaagattcttcctgctgcctttccaaatcttcgccaccacacagagtcagagagatgcacagcacaggtagttgccgctgccacagtgctacctccacacatgccacggtgccaccctgcaaggtcgttttcatattttcagacctccacatggttgatgcccggttgaatagaccttagcggtatttctttacatgatttttacatgaaagattaatgatccgaagcttcttttctgacccgaaaaacaatttgagcaagtttaatagtatagcacactactaactccaaatcatatatagtcaatataagagcaggtacaataacaaactattagccagctacaaacatattttaatgagataaa

SEQ ID NO: 62067 - DNA, 680 bp, Oryza sativa
tcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaaaaatcctttaaattcaaccattccaagggaggcctaatactattgttctatttaatgctagcatctagcactctg

SEQ ID NO: 62068 - DNA, 1118 bp, Oryza sativa
ggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagactatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtat

SEQ ID NO: 62069 - DNA, 654 bp, Oryza sativa
agtttgctccaccaccagtacaccacacccccaatgcgcgatcacgtccgcgtgaggcacggacgccgccacaatcccgcacgcgacgacatcggagcgttccgcgccaaggcgatcgagaccgcgatcagcagctgacgcgacggcacgggtgggtggacggatgatggtggcctccggcctcgggctcgcgcgcgcgcggccacagtggccaacgccgctccgggacgcggcatccgccggcatcgtcacgtggccgcgcggcccacggccacggccggcccgtatcaaaaattcgatgtgacatatctcggccccccgtcccctccacccaattcgcctcgccaccgcgcggggccgtcgcccacgtgtggcgcgtgacccattccccgcggcgttacgtgcgctctctctctctctcttcctcctgcagtagcctgtgcggtgcagccaacagtagacgaatcccctgaaaaagaaaaaaactgtaggcgaatcccagggtcgacacctgtcccatatccttggcgtgacacttcacgcatggctttttctgatgccatttcatcattagttagggttcccaaggtttacttatgaataaagattagtaagtactagtactactcctgaacaaacaattatttatgtagt

SEQ ID NO: 62070 - DNA, 504 bp, Oryza sativa
cttcctcccctctctctcttcctcatctctattcaggcctccatggcacgtgcctgtgtagggagaagggcggtagtcggcagagaggagctagacggtggcggcggcatcaccgagctctatcggtgacgaagacggggaagctcaggttgatgcttaggttgtcatttttgctgtcgtgagggcctcaggcctcggcgtcgtgaagataggagagaacataatgggaagatatgggaaaggagagagagaggctaggtgtcatcacctttggcgacacaatgaggggaagcgtgaacttggcgagaagagtggcgaggctagggagcatggcgtcgccccaccaccacgggcctcatctgttcccgtgtcggtccacccgacctctgaatctgtgatttctactttcgaattagtgtagttaggaattagttgttgatattcactaaaaaaattcgaatgacttccgctgtcttataagatacatatgtgacctcgattttc

SEQ ID NO: 62071 - DNA, 1185 bp, Oryza sativa
tttgggctgcactactgtgccatgcaaattacttcgagattctttacaaggggcttaatctcgctttgtcttggcaggttgtggtggtgatggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggaccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccg

SEQ ID NO: 62072 - DNA, 729 bp, Oryza sativa
tagacttgctaatgaaagtagcacatagaatgtttgcttatattgccttcatgcatgcaataagtgtgttatttgcaggaaatgtgaaaaaccatggatgttattttgcatcaaaccaaacatactactgtgtgtctctaccttaccaaatattagcaatgccaaaattttgcatgacaagaattcgttagggttgatttgggcgataaaccaaacagccttattgtcacatttatgctttgaaaaccattaggtcatgtgatcacagtaaggatcaaggttttagttgattgagtttacgaaacattacaagagctcttcttttcttggaattacttcagtaataacataattcatttcaattccaatcatgtttcaaaattctgttgcacctgcataccccttttggtgttgttatcagccattaatgataccaatgacctatcaactcgagggcatatgctcacagaaatataaacctggaaaagtcaattatggcttgatgaagtctaatgagtaagctatgcttacagtaatatttcaggcagtttccattaaggcccacgtgtagcgtgtcacctctgggttaagaggcgcgatgctttcagattcctccatttgcaattcggtttgcaaatgtggtaactggtaaggtagtaacatgtgctcctattaaattgtgtcccctcatccgggctgcaggaattcaattcgagttcaatgcactgg

SEQ ID NO: 62073 - DNA, 1047 bp, Oryza sativa
  unsure (1)..(1047): unsure at all n locations
ttttttttttacataagacaaggcaaaatttggatcagacctgaatgttttcctgaacaatatagtctccaaagatacagtgcatggaattattgccagcttggttacctgatgcatttgatagagtgagatagcttagacaaagcagtagactaattacacaagcacagttaggtctgtagacaaagaacatgaattggctgaaactagagactgttgaattgtgtcattccatccccaataaaatcagggcaacatattgtgtgcatgttgattttcagattgggcatgaatcaaggtcaactactaaatttccagcaagaatttaagttttaaagtttccaacaggtgtcgtttgctgaagatgaatatgttcatctcaaaataggaaaaataaacaaatgcaagattggcctgatttctgaagagtaaaccaacctgataaaagccaatagagttgaatccaaggctcagattaagcaacccaatagatatgccatttagtattccaaatccaatgattgtcttggggtctaaatctttgttctcgaaaagcttcatctgaagagccacatgaagggaacaaaatgtcaccaggagatgccagcttgtcagcgtagtagctgaaagaaattaggagagtgctgtgatttttgcatggttatatagcttaggaaacagttagttttctcaggtggtattgttcgtcatattgtactcataaagtagtatagaatttgtgtgccttattaatgaaccgtgtccatcaggcaacttgtgtttcctgaattttcgaaggatgtcatttttgttcaacaaatacatgaataggatagcagtaacgttgtgcaatttccaattgtcccatggagccatgaatttgactcacatatgcagcagagcagagatgttcagaaaatggtcatcaagtctgcactgaggcaattcanagaacacctagagtgcatacttatctagtcatttgcgttgctctaagctcgtattgccgcaatccaatgtatgcggacagagtgctagatgctagca

SEQ ID NO: 62074 - DNA, 644 bp, Oryza sativa
attttgggcctaattttgcctaggcctatgcgtttagcctaggggcgtttcctgccacgtcgacggcgaaggtagggtgatctttgtggcagaagagaaggaccttgtttcagatgatgccctgtgggccttgtataagcagtggtgcaaggctttcaaccaggagcgtgaccatgccgagatggttcagcgcttcgaaaccttcaagagacgtgtgcagtgtgctccttgtggacagagctaacaaggaagctatcagagatggtctgtcccgcagacttggaataatcaagttcactgaggcctctcacattgcaagctatgggtcccgtacccttagcctaaaaagttggcccaaaaacactcaccccagagtgtaagcacccatatatgtgtggcttaagccctgtttgattcagtttaggattattataatctaacttattaggagtaagcttaaacaaacaagtagattattatagcagattattataatctataagtcagattattataatctgataagctgctctagaggagcttttttcagattattgagtggcttaagacccactacctctacatacttgagaaaaattacccacctatatcattaactgaacagatagctgagggcattatag

SEQ ID NO: 62075 - DNA, 4649 bp, Oryza sativa
tgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgatcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagta

SEQ ID NO: 62076 - DNA, 961 bp, Oryza sativa
gtgctcggcgatctcagaaaggtgctcgttattgtagattagagtgtggtcctaactccggccctgaggcgggtactcgcttcgcgcgcgcgtgcatcatgctgcagagggcagagcccctctgccccgtggacgagacaaacacaaggatgcaaaaacgttgatcaaaaccatattattattttttttagtttttcacacgcctgcttaattaacccatatgcattgcgagtgcgacacacagcgacagtcttagccaacaagtgcaatataaatacttgaactaactcattctagcgccggcaatataatactgcaaccggtagatgagatgagatgaggatggcccgcgttttgcccagcacggaatcgcgcttgcgcgcacggccggagggcgagagggcaccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccctgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttacgccaacaatggatgggctcagctcaaagaaaaaaaaaactacgaaagggctaacccttcacaagttgtgtctgtatcgtggatggaatgatgatacgttgatcctgtttgaaactgaagcagataaagattttttagagaaaa

SEQ ID NO: 62077 - DNA, 1604 bp, Oryza sativa
ccatacaccataaaccgacaatattaatatctaggcaatgcatgcatatatgtacgtatagattgcaaccaaatcatttttagagaaagcataggttctatatgcttaggtgcttgccttgctgctgcgtggaaacacactcaacctcagagtcttgctccacgtactccgaattctccgaatctatcgataagaggcaagtatgcaaataagattcgaataaacatgcatatgcaacatgctctgcagaacacggggtaaacacagtggacatgtcacattttcaacaagaacttgggtgaaagaatgaccctatttgctgccatgattctggagatataaaagtgacaagccacaaatgctgaaaatggtcctatgccaaaactgaatataaactataggtcatttggtgatacccacatattctagcaaattttcatgggtgaaacttgctccatacaaaagagtataatttactggtgataggaatagtattcggattatttaatttggagtttgaacaagatagtaggtatatatgaaacctagagagtgagaaaaagaaaactgctgtctgcagcccttgtgcccaagatttgattcgaaagtttacttcgcaaatgctcagtgattgaggaaaatgaagaaggcatgatttagctcagctattggttttgtaaatacaacttttacaaggtgttggttagttctcggagggattaagtcgcaacatgaaatttctagctggcctaagaacttatgatgctgaaagacagcaacttgcttccaatggcaactcataaaggtccaaaggttgctgttacactccatgcatgcatatactttagaatgcagatggtgaggtactttggttgtgaaggttggagcacaaacagccatagaacaagaacaaatcaatgaagaaaaaaaaaatggtgatagcaacctgagtaaaccgagggagataggggttgtaatcgtcggagtggagagagacgagttgcagctgttctttgctctaaaatcttgcatcaatgacctgtggagagaggtagggaggctcaacacaatggcactcacaagagggacacaatggatgggaaggaaactcaccaagtggaggaaaaacatggttgttttgctgctgcaaccagcagcaagctccacctattttcttcccgatctccctcacgaatccatgcatgtgcaagatatttggatggatgggaggcttggatacttgagattgttgtggtgtgacatgcagggatggatctcaagtgtttggaggagatttgatgggaagaagtgagctgggagctcagcttgcaagaaagaaaagaacaggcacgggagaaagaaaagaggaagaagatgaaagggtttagcttgtcttatggatctgatgtgggtggatgacctggaggtgggttggggtttggtggagagcctaggtctgtgacaggtggggccaagtcgagctgggtccatgggacagataaaggaaggttagaaccataagtacacattgaaaatagtgaattttcaggaattttccttctctccttcttgggtaactagtttgtcctagctacaagagagtc

SEQ ID NO: 62078 - DNA, 5193 bp, Oryza sativa
  unsure (1)..(5193): unsure at all n locations
agagcctaggtctgtgacaggtggggccaagtcgagctgggtccatgggacagataaaggaaggttagaaccataagtacacattgaaaatagtgaattttcaggaattttccttctctccttcttgggtaactagtttgtcctagctacaagagagtcaaaaatgtgtgttctggcgtggagatagattgagttacgtagtttccatttttcaaagtttcactcaaaaattcaaaatattttaattatggcaaaaaggtgaaaaggggtatgctgagaaataaattgaattttaatgaggttaaaactgactgtaaaaattctagaaaaattatattaactcattataaataatgtactatttgaataaattataaaacctatatccttcagttcaactttaggcacatttagaagttgcttcattttgccaattaggtttctaattaatttagcttgactaccttgactgctttacttgaggtagtaaaaagaatgataaaattatgaaaccttcatggtggtcatcttaggttgtctaagagacaagacgagcttcaaggaattttatgttgcttagatttagtacagagtctatgttcatttaacatgtaccaatcagcaaaacaaaagaaatcattcaagctaataaattggacttcactacaaacaggtacacaatcacacaatcacagccactagttactcaaattacaaaccaaatgctatgcgtgattgggtagattatctaataagagaaatattaatgactagactatgaagttatatttccgattggtcatttaatatagttaaatacaaagaggttttgacttggcttaaaagttaaaagggagaaaaagaaaggtggatcttcgtggattatctggtattgagttggcttagtctcttatattctcgttccattcgtgcaaggaaattattggtgagtaggtctttagttgtgttggtgaattttattagcgtcgtagtgctctctgaaaaattggatgagacttcattaacccagcaacttatagatttcgccaccaaggttatagagttatttgttttctgaaaaaaaatgttttccctataacggtaactaaagattcacatcgtcccaaacgaaggtctggtaaaaggtttaaatttctagccattttaaacataagaatcatctggagaattttttttaagaaagtttttgaaactcctataattttatcagaaacacaatatatgacatgttaaacaactaattaaaatttcaggttgttacaggttatggaaggaggaccccaagggaatgttcacggacaatatccagaccaacggcgcgtccatcacttgggaggagggtctcatgcctgaggtgaagtattggtttgtgctgttcgatactgctaggttgttagtagggtttaaactttagaacaatcacgtcaggtaaaaatacatgttgtttcgtagaattttacaatgtgaattattcttaaattggtgaatttgttatgtaggaaggaagaagcagggaggctgaaatttctattttaatctaataatggagttgaacatgtgatttgatctttatgctaatttattttgcaaacaatctgggtgtggttactgactgcatgctattttttcccaggttttcctgttggaatttgcttattttataagttttcttccttaaaattccatttgttctgtgattgttctcaagtggcaaatgaggaagttgttgatttagtatattaaacattggtggaggaatattgatcaagtgcaaaattgatcaaaagttgcctgttgatctggcgacgaagatcagttgcaaaactaatactctttcaaaatagacatgatagcaaaggttgtatttttcttaagttctttgcagcataaatattccatactggtgtactgtggttctacacggtgattttcttaattttatttaattttcattttgtatggaaacaaaaatgaggcttggtgtcttctccgtttcaatgatctattctcgccaacatggattccatgtgcattgttgtactctggttggatgctctacacttctgaagtgttgtgtttatttttcattttcaagttgagtggaaattacaatgaaaatttatttattctatctctgaaacgaaaatggacagtcttggatacatattaagtatgcattgctaaatattaggttgaagcaagatgtaataaagaacgtgcattgcacgtgcatgattactagtatcaatcaaatgtcttaataaaccctcactgctttgcgacttattaaagaagtccacaaaacaagcataaaaattttaaactgtaaggtaccttttaaaatgcactgtagtaattcactaaagaattaacggtattgggtatttaatcacgtgcaaatttgccaaaacaaaaattacctaagacccaaaggaacgtgacaacggtagctcggtaagaattttgacgtgggaccaaaaccatctgaaagtagactccataagctttccagcaagtactcatgggcctcgaaattccttctagatcagcggctaggtccgtttgaagttgatgctgttaggaggcttgattccaaatccaaaacgtgtacaacttgatctcttgtcttctatgggccaaaagtgacatggtgagttagaagtagacttggagaaggtcttggtttggtccccaatcaactttatcatccatgcattcgttatgctcggcctcttttacttcgtacaagcaagaacctctgcaaacgaaaacacacaaaacttattgtgtagtaacgtttgttcaaatatataacaagtaaatctaatgtagaacatatgcacctttggttgattaatacataaagtagtcatggttatatccgagctagttgtgtactcatcagctggtatggacccgaagtggtcacacagcatggcacgtgcgctggcactggatacacggacgtggccaagaggggacgttcctggcctgggcattaatagaatacttatatcaataagctgcaacttgttttcagaagccgatctccaaagaactctagggttaagcgtgcttggcttggagcaatttgggatgggtgaccgaccgggaaattgttcccgggtgcgcacgagtgaggacaaagtgtgcagaaaagacttgtgttggtctgtgaggacagtctatgacctataaaagctatcagatgtaagcaggcttcccgggtgcgcacgaatgaggacaaagtgtgcagaaaagacttttgttggtctgtgagggcagtctatgacctataaaagctatcagatgtaagcaggcccggcctgggagaggtgggtctacaagatcctagagaacatcaatgttaagctagatggtttcgcttctgctttacaaagccagctgagcttcaataaaatgatagaaacacaactagctcaattggcttctttagtccctgcaactaaaactgggaggattctgggccaacccgactcctccattgaaaatgtcaaggcgatcacgacgaggggaggtaagtccactcgtgatccgccgtatcctaaccctacaggaactaatgggattgccagagaagcgccatctagtgactcggctgacaaagaggttcagccagaaaaagccgtgccgcaggaatacttcgacacatgattgctgccgttttcctcaacggagtaggaaaccgtcagtggacgagcagttcgctcgctttgttgaagtaatccagaagattcacatcaacgtgccattgttggatgctatgcaagtgccaacatatgctagttatctcaatgatatcctcaacaacaagagaccgctcccaacaacagaggtggttaagctgacggagcagtgcagcaacgtcatactccacaagctccccgaaaagaagaaggatccggggtgtcctacgatctcctacgaccaaaccctgtgtgatcttggagccagtgtcagcgtcatgccgaaggacgtctttgacaagctcaacttcacggtgttggcaccaacaccatggtgttggcaccaacacggatgcgcctacaactgctgactcgtcagtccgttacccagcggagatagcggaggatgtgccagtcaagatatgggatttcttcatcctggttgactttgtggtgctggatatggacacgggaaaagagacgccgctcatcctggggcgttcgttccttagcaccgcaggagctaacattgacgtgggaacgggaagtatccgtttccatatcaacgagaaggaggaaaagtttgagtttcagccaaggactgaacaatgctccacggtcagaataaagtacgggccaaacccgcagaatattcaagtggtcgaagtggagccacccaatacggatagcctagtaagggctcctttgattcaaaggattggcataggacttttgtaggatttacaatcctatggattttttcctatgtatgtctttgattcataggaaatgaaaggaaacattccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaagagagagagagagaaagatgggaacgagaacaccgaggaccacatattagcagccaagaaagccaactgtgatagagatagacaacagcttgagccggccgctgggggtgcaaggcggaggcgaggctcgccggctcagtcgcgtatgcggcttctgctggggacgccggcccaacaactagcagcacgcagcaaccaagcacagcatccatctggcgcgcaggttgggctccgctaggcggaggcgtgcggcaggtcccccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataagganggtgtattcnttttttctttctttttttttggg

SEQ ID NO: 62079 - DNA, 1419 bp, Oryza sativa
ttgctcaaagctattttgtaaatacgatcctcgagctatgcaatattattaatcaaggccgtgaacccacacgaacctgccttaacccaaggcctacgatgattcagaccaaactggcaacccgaccctgggtcccagctcgtcccaagccaacccaggccaaccattccacattttagttgttaagcaggttttaagaattaaaatactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatttccatccgtgtacttttgtttataaccagactgagccacaaactaagccttacccactagacatgtggaagtacggtagtgctttgcaacagaggcccgaagaccggtccttatatggccgaggtgctactatcgaaactatgcaccccgagcccagcctaaaaccattttagggattttgaatagagggggcggtgtgaatccaattccacaataatccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaataacaataataataaggtcataacaaaggtagataggcatggctaaataaaacagtgataacgcaggaatttaaataaagcggtaatgcaataatttaaattaaaataatttcataaactgggattcaatatgttcaaggatgatgtgacttgccttgctcgctttcccaaacgccggcttcaacttccacgaagagcggatcctccgaagctgcagcgtctacacgaccaacggaaaagaaaaggcttttactctaataaactccatataaccagtaggaacaaagcacaaaaatgggttcttgacttcctaaggaaaaattagagacttgaacggtccaattccgagttcaaatggccaagttatggccatttgaagtttatatgctctttaaatgaatatttgcgaatttcttcatttaaattttaatttaaaaagggttcagccg

SEQ ID NO: 62080 - DNA, 7018 bp, Oryza sativa
actgccacatcattatctagtaacaatcattaaatttaaacatcaaacaaagatgctatattgtctataattttataatttattaaattttagagcttttaaaatgcaagtatgttaaatcatcatcccacattatcacataatatttcaatatacatctttattattttttaaatatactatgtaactatatagttcatgttatttttctcttctctcattaagccatatcaaatcagttgtttttagtgcttaaatgaaatctatggtccaaattttctctctttttcttctctcattaatctatatcacctcaatgatttttagcctttagatgattaatctatggttcaaactatctcaatattttttttctttcataaattcatataaccttacttttacattttaatcatcattctatatactattaaaatttaaattatcataaaagatgttaacttatgtaatcttatgttgtctacttgtcttacacattatttttatttattgttatcatactaaattcccgcagcaacgtgcggggttttacctagtaataatcgtaagatccaaacctaacccattttttaattgcactatcgatggcgacagatcaatagtttaacatatgttttgtcactattcatctaatatatgaataaccataaagattttttatgggaaaaattttctatacatatgttttgtcattatattcatttaacatatgaataaccataaaaaaatggcactataatacttcctccatccacaaaagttacacatatttcacattaaagtttttctaaataagttgttcctatttgtagtctttatgcattcaagacttaaatgagaagataaattaaatgtttgatggagtcatctaaatgctcattggttgcatgcttgcattcactccttacatccaaaataatataatttttcttggtcttgatgacaaaagtaatatgtgtaacttttgtggatggagggagtactatgactttgtttggcaaatgggattgggaaaataatatcccaccctttaaagggcaatattgcatcctaaccattcatccttcacacctcatttaatcctagccattcatccatttccatttcctaatcccacctcccatatcccatttgccaaacacaccctatagtttttccgctccctctctccttttatcttttcccttataagtatgactgtactgatggggaataatttgtagcttgccaatggagtcttagggcctatttagttcacgaaaagataattttttaggtgttgcatctgatgtttgaccggatgttggaaggggttttcggacacgaatgaaaaaactaatttcataactcacctggaaaccgcgcgcgagacgaatcttttgagcataattaatccgtcattagcacatgtgagttactgtagtacttatggctaatcatggactaattaggctcaaaagattcgtctcgcgatttctcccttaactgtacaattattatttttaatctatatttaatgcttcatacatgtgttcaaagattcgatgtgatgtttttggggaaaaaaattggaaactaaaccaggccttaaacctgttgccggcgatacaaagagcgcccttttgtgttgaaatagctactcggtttagattttcagcgccacgtgaaacgattagctgtttctgtgctcattttctttttttttttatcaaagagctcatagcaccttttccgaacatatcatctcgggatggtatcttaaaatcaaggcagagcatttgaacaaattagctagaaccccgggcgttgctgcttaataaaaacaaaacatttaacatatgaataaccttaaagattttttatgggaaaaattttctatacagaacacctataatttacatacaagtagagtcagatgacagagatcaatcacatagggggcagtggctcaacatacagagacgactagttgcatatagtcgggactcaggcgggcaagtggtgggccatctcgttgttggagggggagagcgcgaaccctactctctttccccattgccacttgcggagttgcggtgactagggtgcggggtagggtcgacggtgctaccgtgatgtgttctggctggtggtgctcctgttccacctgctcgtcttcgtcggggcgcttgcggtcactggcctcaaccgcttcgcccaggccgaccgcttcaccaacctcactgctacacatcgcttcactgaatcgctggagcccgtgagggagttgctccagcgcccgacgctcgaggttgaggaggtcaccccactaagctcacggagtcgtagtagccctactatggcaccacggggctgtggggtctattatcgcatgggcatggttggtggcaactattgggagcctaggaggaaagatgcggagagggtggtcatgagggccgccacgcacaacctcaccacgtacctcacggtggtgagcttttttttttctcttccccaaaggtcaaaaaggtaaggtataatcccaagattatatattttattatgcttcatttggttaccatataagttttcttgaatgttatctgagtgactatagttcacatattgttgtaaaaatttaatttcatagatcagtaaagttcattcattgatgttgtttgtcttctaattttcagttgacttagttttgctaagatatagccccccttttttcacttgatctcgctttattccctgtgtagtatatatgtatatgtatgtttctatctccgttatctcctctcaagaagataatcaatttcttctactctaattctcttgtacaatgggtactagaaaaattacaatgtaaccattgaaatttatagtgtcatattggtgtagatgtagtttacagtataaaaaatttgactggtttttagaacaatatgacaaaaaaatatggctagtccctagtttaatttggcccaatagtttagacgcggttatgaaacaacatatatagaataaaacgtgaattgtacatgcagtattgctagtctcactaaaagaacagtagctccatggagaaataaacccgcaacaccagtcatgtaattccaaaagtagaaagatacatacaaagtgcggctggtgttacccctctctgtacattgttcaataagtagcacatttggaagcaactcagcagaaacatcatatcaccacatgcgtatacaatggcacaaagaatatgcatgtctgaagatcaaaagcctaaagagctaactttaatgttcacaccctcctgacactctttccatactccttcctgatctcccacagctgctctccaacttctttcatggtcggacggtcctcccgcgtcggagcggcacactggaatgccaagttcagcagcctttcgagcacctcatcgtccacaggatcctccaacaacggatccaatatctccctcctgttcccttcattgaatttcttgaatgtctgcagaaatacaagttaaagtgtgcccacattctctacttatggacaggacagatacaaaagtagagttttgacttgaaacacggttgtaggtaaattctagctagaggttcagttccgctatatttcaaattatcgtgcaaaaaactgaggacagttatggttagatcagaaaaacgagtatgattttaccctcacattttgccagagctgtattaacaatcagtgtcattttagttcatggtaacatatgatcacatccatagtaatagaagtatgcaacaagtgtaacatcactggaattaattgcaaagaattggtatcaaagaagaagccattgaacatacccatctgatagttattctctcttcagcagcccgcttcagttctaccggtcggcgagcagagagaatttccacaagcagtatgccaaaggagaagacgtcgctcttaggagtcaactggtatgttctcagatactcaggatcaaggtagccagcggttccttttacttttgttgagatgtgtgtcttttctgtgtcactggggccacttcttgcaaatccaaagtcagacaccttggcccggtagctctctgtcagcaggatgtttgatgacttcacatcccgatgaattattgtcttctctgttcacatcggagaaattatcagatagcaatacagtattattaaaatcaaacttcatcaaaataaaaagtgtgaatttcataaaaccgcagcaatagcaaatgatttcatcaatatgaaattttctcccttatgtgtgtatggcatgtgggcccgatttgcataaagcatgtgtacgtcatgtgtatgataggtggggccaaaattgtagagatataaagttacagctttttgataaaatcgtatgctattgttgcagttctctgaaatgcttagctaaaccatactgatagttttgacaaaatagttgtagctttctgaaatttactcaaatacaaatatagaaaattggcactagtgttatttcaaaatagaaattatgcaaccaaattaacaaggaaaaagtctaatagatcctctaaactataaaccatcccaggaaacttctgatctatgcaaaaacatttaaataactcctttagaggggtcttcaaggtggtttgccacttcggcatctgatgtggtagaaaatgtgtatggacttcgcaaaattcataaaaataaatttccttgcatattcagattgcatgtgatagaaataaataaagggagagagaataggtcatcttctttgctacacagggcatgatgatcgacccgcactgtggagagaactcgagatggccaaaaaggaatgctcactacacaaggaacttaatggtgctggtgatttagtagtccgatgggcattagagttgtgctggcaggcacatctctatagaaggtatagatgagcgcatcacatcaatattgatccaaggaaaaacagagatggcttaccagcatatagatgaagataagtcagtgcatgtgcaacatcaattgcgatttcgagacgctgattaaaatccagggttcttccatattggcctgcagaatgcagaaatatttattaatatggaaatttggaaacacacaaatggcaatgaagagaataaatcagaaagtgcaatgtaccatcaagatgctccctcagagtgccatttggaacatactcagtgataatgatacgttcatgtcccttatcagtaaatcccagcaacctcaccaaattccggtggtcaatcttagcaagcaattctacttcattgctaaactcatctctgggacctgcgaattgatcctgtgcacaaaaaatagtcaaacccattagcaggcagtaaaccaaatacttcgtctggtcataaatacttgatgttttggataggatctgactatcagcgacttctaataaagtactaagtttgaaaacataaaaatggtacgtagatttatcctgaaatgtaatttcataacatcataaacttattgttggcaacttttttttgacaagaagacaatcacgatcgggacacctaaacgccttgcggtgatatggaatcgccaaccaccccaatctagccaaaagacaaatcaagatgggttttgtagaaaaaaaagctaaaccggccagcggagccgatttagagatcaaaatcagcctctaagctgatttagatcgatatgaggataactgcccgtctcgtgggcaaacggaaggtttacgggacaaacctacaaaggggtaattgcactctcgagcgacggcagacgatttacggcgcaaatcgacaaagatgaactaaaactagagtaaagtagaaaacatggctaaagtaaagataaaagaacgattcgattgtgtttgaggaagagaaatatctcgatcaaaccggccttgtcccttagataggggttggtcttgcctcctacaagtcctccacgtccaactcggggtagaaaccaatggaaacccgaaacatgccttcccgagcaaggaaacccgagacccgacgaaaaacagactcgggctcggactcagccggtctgaccggcggcacgcaccgccggtcagaccggccctcaagcaacggtctgaccggccaacatacggcggtctgaccggccctgtggaggaaaccggcaatttttccaaatcttggcaataattccttaatttgaacctaggtgccaaatttgggtgtaaacacttacaatattatataaatttattctcatataaaattatgggtaaggcaccttgaggaccacgaaaaaaaaaatcaaacatcattttttacctgagggagtaacttaatccaaatcctaagagcagtgtattcacccatagatattctaattaaccccaacatagtgatataaaaggagcaacgtgtaccagtggtccttaaacttgccgaatagtgtcatccaggtccctacactttcaaattgcagatttaggcctttatagttgtttaacgtaccatcatgagtccaaatgtgcccataccctcttcaagagcctatgtggcatgctaacttggagctgacgtgacatacaagatgacatgagcagtgtagaagggaatatatgcatatatcccatctataccaagctcacacatagcttatgtgttcccacacaccatgtcggctctaagttggcatatcacatcgctctctagagagttatgataaacaagtttaagaacctaaatctgcaatttaaaagtttagtggcatgactgacactgtaagagggccgctagtgtactttacgcattggccctgttcttttcagcttattcaccagatcatttgctccacgcttcggaaaacacagtttctttaaaattcttttaccgcattgcctagaccacttatttcaaaccatttgttaaatttatttcttaaaatatttaatttatcactataatagagtagataatctgcgcaataatccattcataatctaaatc

SEQ ID NO: 62081 - DNA, 1848 bp, Oryza sativa
gtagactgtcccaaatcctccttcacctaacttaaatgaaggtgagaaattctgagtagccctcagaatctgctgcacagttaagttcacagatccaactcgagcaatttgtggagattgtgcgaatctagatggacttgggggtattcggtgtggagttggtggaaccttctcagatgacgtgcttacatccaaggatgcaatcgattcgactggaaaaaagaagtttggttgttaaggacaagatcccaacaatgcttttgagtttgacactgaatcaaaatggtgctagtacggtaggagaacattaatcttgcaaacagcttaacagtcagagctgcataccagaattgagatattctgcaacatatattaaaatacataatgtgcaaaatataaatggctttgcaaagaagttttattacaaatactttttcttggttcttctaggaaacattgagttctcaataaccctattaattgctaactagtaggggtgtcagagagatgggcacacctaaaacttaggtagcaattatttcattctgctgtgtgtatagagctaacgacacaaatgaggctggaaggaatagcagcacatgagttaaaaattacaggatgacagttaatcaaacaaacagattttgttctattagttacggactattatataagttctttttctgcactagatgccactccttcctaagtagcacagaccaagttaggaattggtagagatgatccactatggttctctgtaaatccacatactagccgggagttgctagtttggtaagtaaatggtaggtaagaaatttgtaaacacatactagtaatccatcagagttagctctaaaggtcccaatgtgccatcacaaactataccatgcagaagatggttaggatagcacaagattgaactgacatactcaacatactagaacagggagcatttgagcatgtatttaactcatgatgagagaaagctttagacaaccagttccctatgacaacaaattgcacagaatacatgtggattttaatccttacaaaatagctattcatctgactcttgccgtgaaacagtttgaagaacagaaatactatatactccctcttattacttgtcatttacgacatcagtaagtcttcaacacactttttacttcaactgtcatgatatgaaaaatcaataattgtgtgtatttaatttctagtccaccatcagcatgagtgggtgacaaccaaatggttttttttttcagcagtaatatagtgcaaggtactcatgatgtgtggactcacctgcattgcgctgaatggatgtagtgttatgcctgctgacttcctttttctcagcatgaaagcacggtatcatcagaccacagcataggagaatcacacctggcacagctagtagatgatcctgcccttccaaagaatcattatcatcctgattatgtccatgaattcccatgtttttacatgggtcatcttcaatttttgcatcattcattgagggctgccttaaaagcttccttggtatattttgtgctgcagttacaataattcccatgaaaccatgagtacacacaatttagaaggaaagaaaatctttgtgtgtacaacatcataccaagaaagtacacaaataaaggtgctctctcacaacatcatatcaataatttaccatgagcagatctatattggctctctcaactttaattctatacaatacaacatgataccaagaaagtacacaaattcaaaacccgggcattattcttagcacaattgaagctcgttaccaaaagctaatcaacaggatgaaactcaccggtgctt

SEQ ID NO: 62082 - DNA, 546 bp, Oryza sativa
ttaatgggctctgcagtaagagcaaacaatatgagactatgaaagagtttatgcaactacagagaagggttaaaatcctatagcaacatatgtgttacagttacctgtactataggaatatatgtgaatcggacgattgtacatctcagcaaatgcctggatctccatattgttcccatataccttgagaatcaagcatgtcaacataaattatttgcagtggaagaaggtaaggttctaaatttttccttgtcctaagtcctaattttattttgaagttgaaaaacaagcgctcagtatctacatgatagcattatttttaataaaaaaaagaaattctgaaagtcagggaaaatgcacagctgttgtgtggaagcataaatggttaaaaaaattaaatgcagacgttcattaagatctgcaaaacaagattcaaacagctgaaaaacatgctttccaggggcgcacatgctctatagtagattaaaataaaagacaagtcagctgactgaaaaacattagtttcataacattttcaaaaaaaaa

SEQ ID NO: 62083 - DNA, 1929 bp, Oryza sativa
ccgttattggtgggtaggaacaattgcttaggaatttctcaaattgcgtgtatgcacttctatttccaaaataaaatttctaaggaaacaatttctcacaacatgttgagtcatcatgatacggagaaaagctcattcgaatccaaatactccatggaatccgaatccaaatgtgatactcgttgtcattgtttctattagcagcactcgtccatgatcgacctttgagaccgcacatcgatccggagctgactagggcaatcatctagtccctgatcactatacactgaatctcgggcctaccttctcctcttcatcatcggtgggagtgccgttgtgtctatcatcgtgctatcttgtccaattcaaccacattttagtgtgtatctctgtaaatagcaacttacacatgtattatgacgtcgcataatcgcattgtcacttttcatatgagaaatgttgctcttgttacacgttatgacattacattgtcacttttcatatgagaaatgttgctcttgtcacacgtgcattataacgttacattgtcgcttacaaatgcatctcctcctccatgtgtggattgggtattttggtctataccaaaatatggtagaaaaaaagattcaaagtatatctgtggcatataaaatgacatgatccatacggttacaaatagataaatagtaataatattttttcgatacaaaaagacatgatcaaacgatgtctggctttggttctagtgattgtgtttttatcagtttcagtgtttcaaccaccatttcctcgatattgcattctaattcagaaactgttgttttcttcttgatggcattactcgttggctgaaatgttggatctttctgcaaagaaagatgtgtgtgccaagaggctgccgattttgcaaagtgtgtcagaaaattttgtctgaatttattgtggtgtttgtttgtagcaacggtaatggtaaaagaaatgtacttgtattttatagtgtaaccggtgtgaattcattcggttcagattcagtagtgttgattggcactgctgcgttcaatttatttatttatttatttatttatttatttattttttggaaaagcgctgctgcgttcaaattcaggctcaggctcgaggaatgtgttcactgtatagaatacaaatggaaaatgctaaaaatggcaaatggttttgtgattcagtagatcaagcaaaactatttatatcggtattacatcacgcacaacattgagagaacttatgaaccactatattgagaaatcttatgaggcattcagaaacacgagcattatattgagaaacttgaattgagaagttttaatagatgatctcatgacttagaattacttcgttcaaatgaaatctcatggatggcttgacaaaaatacctacaaaacttctgctgtcaagtgcaaataaatttggttattagaattacgccactctccgtgcgtaaaactacaaatatactgttaagtgcaaataaatctggttattagaattacgccactctccgtgcgtacaactttgagatacacttaatagtgcaatgacaatgggtgtgtggttttattctgtattcaatctccaacatgttcataatttatttttaaaaaatgtttgaagtgacatctctccctctaaatctacaaaacccagtgttaattaactataaatactttcagttatgacgtccggctgtttagagggacatctctccctccaaatcttgtgttatttagctataataaatactttcagttatggcatctagctgagaccggagcctgcaggtaatactggcatactgctagaactcatgcgttaatccctcaacgtccacaacttccttcgcaacctttggttgcattatacaatgtttggtaatactggcatactgccaga

SEQ ID NO: 62084 - DNA, 1367 bp, Oryza sativa
tcaatgtacagtactagtagtacgtgccaggtgcaacttgctaataataaatcgcttaatcgagcatgcgcaacggcacggcgagacgagacggacgcgcagctgcagaggtcgtgcgccacatgcatgcacgttgcaaccgcgattattttgtggcgtgctattcgatgtagttttccgtgctactcctatatttgttggagaaatagggacgttacccgtgctacgagtcgttctggaagaactgttctcggtggatggagccatggaggccagctagctgcagacgcagctggctcttccgttcacctggagagcatgcaccaagaggcacccttcctatacttgctagtctacccaggtgagctgtgacgttacacgtaacagctccgaagtttgcaattttgagcgttgctgtgtttgagttccttccaatcgagcaaccacgttatatcgcctctagtcttacgatccataggaattaatgggaggcgtgaaagtggcctgtccttgtatactctgttgacttgctatatgtgcacttctccaatttgtgcgtcctcttgtttcagccagctagctccgctgctccgacgtcgttgggcaacccaaaacaaagttgcagtcgaagaagagatctcgcagaagaacggcaggatctcatgccggactggaacgtaccgaggacgagggacagaacagatattggggactcctgtagcggaaactctaaatgcgcgatcgatcgcggctgcgatcggatagcgatcaccacccctcccccctccatccctacacgtttccttttttttttcaccgcattaattttttattttagtaaatttatgcacataaagtttatacacctaaagtttatagacccaaagtttataaattaaaagtttatatatccgattcaaatttaaatttgaattcaaatattttttatatatagtatttctatacatctaaagtttatacacctaaagtttatagacccaaagtttataaatcaaaagtttatatacccgattcaaatttgaatttgaattcaaatattttttatatatagtatttagatacatctaaagtttatacacctaaagtttatagacccaaagtttataagtcaaaagtttacatacccaattcaaatttgaatttgaattatatccaattcaaatttgaatttgaattcaaatatttttatatatagtatttctatacatctaaagtttatacacccaaagtttataagtcaaaagtttacatacccaattcaaatttgaatttgaattatatccaattcaaatttgaatttgaattcaaatattagtttatagacccaaagtttataagtcaaaaat

SEQ ID NO: 62085 - DNA, 1806 bp, Oryza sativa
  unsure (1)..(1806): unsure at all n locations
gaaattttgtgcaccccactgggtaatggataatgtgagccagatgacttgggtagagaaaccatctttgctcgatcggtcaaattccacaatagttctggttctaataaaacctgggattaaaaagtatctttagttccagtttaaaagttgaggggtactttttgatctttagtagatcatttttagtatcggtttaagaagttgttgagttcaagacagaccccgattatttttactcccggttggtataaacaaccggggactacaaatagatctttagtnccggttgtttataccaaccgggagcaaagagtaccccgagccgtgcaccatctcgatattatccgcgcgtctcctctcgatttcctcccctcttaatatctcctcctccatcccttcctctccccttcattcccttcctcacccgttcctccccttcccctctatttgtgatgtgatgtatttgtgatctctgatgtatttcttttcaatctgtgatgcatttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactgaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggtgaagagaagatgtccatgcagaggcctctgatagccccgcaagcaggtgtacactgttacatacatgtctagactctagagatggcaacagggtgctatgacccgacacctgactggtttttactctattagaagctaattatctattatatgctaattatgttttaactcttatacccatgagtttaccgacgggcgaaaattcttacctattaggtacatgggtatgggtctattctttatctactcgtacctaccaacccgagggtgaaaaaacctgtagattaagcctaaatccatgagtaacataaaacttctttcttatcttaagttctattctagttatatgaaattattatttgatttcttgattatgtaatatggttgtagattttttttactcgactttagcgctaatgttaatagcattgttgccagaagaattattgatgggttacggttcaaaaatagctaattatagaacaaaactataaatggtatgagtcaattatatgggtatgggtacccgttacctgc

SEQ ID NO: 62086 - DNA, 1510 bp, Oryza sativa
tccggtgccggagagcaccgccggcactggcgcgacgcgagggcgaggacgtcgagcacgtcgtcggcaagccccagctcgacgaccggcaacaggtcgagcagcgtggccaggtcgtggttgagctcccgcagctccgcctccatctcgtcggactccagcagcagccgcatccggctgcgcgccgagcaatcggcgacgatcgccttgaaccgctgcagcaccaggagcacctcccgcaggcacagcgacgccgaccgcggcagctcccccgcggcgccgcacagcagcaggtcgtcgaacgcggccgccagtagcttggaccgcctcgagatggacgcgaacgcggcgcgcaggaacggcgcgggcgtgtcgacggcggacaggtcgcgcgccaggcggtgcagcggccggagcagctccccgtcggacggcgacgggggcggcaggaacaccgacgaagagccagacgacgacggcgccgccgccgccggattaccagccattggcgcagtaaccacaaccaaaagaaaaaatccttagcttattagtggagtaaaaccaaacggaaatggtggacacgcagcggagagctcgaaaagagagagaggtttataaacttcggaggcggtaggcgtggcgtgacgagttggttgagagctggaaggaatcccctagactgattttgcctttttccgtttatttctattgtgattgttatgcatcatgtgcttagtttatttgtgatggtattaggattatcttatatgcatactatagtattaatgtattatgatgcattggctggaaaggggggcagggtcgtcgcatggtggccgttggatgtggcgcgatggacggccgggatgggaattggatgagtgatgatgagtcagcccgtttcgtttttgatcggatcgcatctcgctctcgggtgcggcggctgggtaagactttgggacagatgagggacgagctaagcacccgagtggagttaaaagtacggtgagagtggcttttgtgagaggacaggcgaagatgtggaggactagatatcgtcagaacctaaggatagctgtaaagattactttgttcaaatccaggcaattttcacgtggaagtgggagacctgtcacactaagaactggagtaactgctagatctatacaagagccggctgctggattaaggtcctgtttggtttatagagacttattccaagtccctgtcacatcggatgtttggacacttttttaagtattaaacatatactaattacaaaacccattccataaccttggactaattcgcgagacgaatcttttgagtctaattacgccatgatttttacaatgtgatgctacagtaaacttttgataattatggattaattaggcttaaaaaattcgtctcgcggattagctctcatttattaaattagtttttttactagtctaggtttaatactccaaattagcgtccaaacatccgatgtgacatgggctaaaaa

SEQ ID NO: 62087 - DNA, 940 bp, Oryza sativa
ttatataatgtggacatcatatatgatcgacctacagaagttgcattgtcctgtttccttcatataagttctgtgcatgtatttgtacagtgtaacctatttcagaacaatgatcaattgccaaattatgtgaacaaggctagaacgttgagaaatgacaatgacgtgactatgtaagtatcaagctgacttatttttcgaatagtaagaaccaatcaattagttgatgcattcaagcaaataatatccaaggagatgtcactatatatacgtgtacatcagcgaatgacctattcttttaggtctcgtcaccaatctagtagtaataatcagttcaaggatcacgcatgctctgcaggtactctggtaccagatcattctagcctgcacgcaaattcatatcaatcattgtaaaattcgtgaaaaaatacgtaggacgaaaacgatctatcttattcagtacacgcataactaactctgaaattaacctgcacttggactatatatgtacatatatacacgcagatgtgttttttagttcaatttcacttactacaaccactacttcattccggaaccgaagaaaacttccttgagctaattcgatcatttagcacgcactcaattaattaaatcaaccgcccaatcacaatggacaatacaataaaattaaggattgatacatccattggacaaattcttttcttcacccaaggtatccacaactatatctatttctagagaaacatatatataactaatctcgcacacagatcttattttccccggcttaattgtgatcacaccaaaatgttagataaatccatgcaagtcaaccaaagtatgcagcatgctcacttgtgttgagggagctgtagtcagtagtacttgttgatggctgcccggcaggatacaccggcggagacgccgacgagatcac

SEQ ID NO: 62088 - DNA, 15153 bp, Oryza sativa
ccaaagataaccatgttctaatcgatgtgagaaatggcccacgtcggtcggccattgtagttgggagcggacaaacatgctgattcccgccgcggccaaatctattcttatctagcatgtcttgagagcaaacagctttcaaaggaggaaacaatctaaatgatgattgctggggacatgtcatgaaatgcccaaaatcatactagcgacgaacctctggcagttgcctatgcaaggaaagcgaacattctaatcagcagaaatgttacagcggtacaaggcctagactgcaaacattttacacggattggagctacaactttttagacatcaatctaagctatatccagagttacaacgatcggcatggccgcttggccaccactcaggcatcaggcaccgtcaaggcatttgatggaggcagcaggttgagtggagctcatttccgagtaacagcttaccaatttatcattcacctgaaaaaaaagagtaacaagttaatcatgtgtcagtacacgctggtccgtccgataacacaacagcatttatctcattgctttttaagaaaaaaaaatctgctagaaaatggatcaaaggaactaaaatccctcaagttctctacttctcgtcaaataaaactatctgtatctcagcatcgcatgtaaagatttgattcaggtcacccttttaaacatgacagcagtttctcattacagtttaaagcatacagtttcaaaaaaccactgttgttttacaacccaaaaaaaaaatcatttttcttgcactgcattccacacaacatgaaatggtcactggtgtttactttcatatagttcacaaagaatgccatactgagggtaggtaggtatttttctcaccttcagtctcaacttttccaagcacgttcttgtgcagattggatgccctaaatgttaccgagattaattctgttaattgaaattaatcaatgaagaatctaagatcaacatattgagaacaaaaagtaatgttaaatagtacctgttgtatcctactgggatcaatagcaccaggagtctgtagctgagtataattcaattcctatataaaatgtttgagatgtaaaatgttcaaatcttacacaacttacaacttcaaatgtagatttaagagacaggaaagttaaaatctcaacagtaaagttcattcaaattttatcgctattatacagtgtttcaagatcatatattcaacaaagaagtttttgtctcttgaagcggatacaacctgacgtgtcaaaagtgctgatagacaaagtaatcaaatcaaagttgagaatgaaaaaataaaaggtttgaatacatagaagaagcacatgtactgaaacacagtgctaggtagaaacattcattagaatagttttcttggtttgacaagactcaagaaacagaaaagggatctctttaatgagctggcaacaggaaagaaggaaaaagatagaagcagaatatagatcatgcgaagctggaatcaaatagtaatgtgcatattagaattatagctcagggaacagcatgtgcacctgctgtttcatctgcatttgttgctgtccttgttgtgcctgaggaatttgttggacaggttgcattgctggatgtgtctgagcctgaggtggtgactgaagttgctgcatggcaagtttttgttggtgctgttgaagcaaaagtagtttctgctgttgctgctgctgttgctgttgctcatacagcacatactcttcaggcttatcccactgtaaaacaataactctaagagtgagacccacaaatgttgcgatctttaaaatgattggtgatgagtttcaattcttcaccttactctctcgagttatgctattgtagtagtatttaaaaccttcaggagacgtatgttcagtccaattgcaggttaaaggaactgcaggtgaagtagcctgctggggaattgtattaatgtttgatggaataatggcatttggggcaccagggttactagattgcactggctgaccctgtagtggaaacagaaacggttaaaaaaaatgtcagccgtaaaccacattatacaactaaacacaaaccgcgtacacattggtgtatgcatagaaaatacatgttgctcagcgacctgtgtgggttgttgatggtttagattcgattgctgctgctgctgcattagttgcagctgttgttgaagctgataaattgcctgctgtgaagattgataactggattgcaaagcagcttgctgttggagtagcaattgtggtgcttgcgatggcatctgctgcactggctgctgaagcatttgtggtgcaacatttgagggaagatgctgttgcccgggaatagcttgcatggaattggacacggctgaaggcacctgcacagcgctgacggaagcattttgttgcatcaacggctgtgacacaggaagctgaccagataacctattctggccaaaagaaccaggacccatagattgtggaacttgaagctgaccaatctgttgagcaggaccctgcaagggttgtcccagctgattattctgcaattgaacagggaaattctgaggcaaccctggtagcttttgcaaaggtgggatctgctggcctcccagatgatggccttgtgccatgggaggagggttcatgccctacaaagtaaaaggtatcatgatgtttaaccgatattttccatctaaagctattgatgaacagaaaaagtcgaatatcccagtttaccatatgtgacgaacttggcacagctgtttggcttgacaaagagccatttccgctgaacatctgaggtcgaaaagtggcctatgatattgcagtatcaaaggtaagcaaatggaagcaaacagaattgaactgtcataaaaagattgatttgaaccacataccgtatctgttgttgatgtaacagtactccctttcggagccataggattgtcagatccaaagttattaaactgatgaggtgctgaccttgggcttgatggatgccaagagtcaggaggcatatgccgaccccttggttcatcaaggttggcggtcggcctggatagaaaaagtagactcagttcaagttctaactattctcaagcaagaaatcagtttaatatagtactacaaagacagtcatcaaaaggaaaaatatgaaacaagggtataatgcccgcactgtttaattagaaaacatactgaagggatggataaattggactaattttggaatggggtgtcaaaatacctgttttattgttcggtttgttggatggactactgatcaaagtttatatggacgttttcatttactagcctttgtaggactataaattgttacttgcaaaatgcaagcctcaaaaatcagtgaacaggctgaagggacgggggcaaactatttgcaactattttcacttgcaatttaacattattctccaatctttaaaaagtagctgttcaatgaaggggtaaccaaacctgataacaagagctgcatcagatcgtggactgaaaccaggacctccaaatgcaggaccacccctaacaaaagacaattcagacatcagtatttactgggaaacgggagcaattgtatttatctaggtataaaatataaaacatgtgctgaacctagattagcatggaggtatcagcaaagaaaacatagggtgaaagtgtagccaccttgattctccaggtctaggtctcttaggatcagcgaaccgaattattaatggttgctcgcacccctaacacaacataatggatatattataaattttcagaaagtcaataagaactcagctaacagaaacttaccctcattacataattcccactcagagcactcatggctgccagcgccggttctcgtgatgagaatttgacaaagccacaaccttgattttgcatatgttacaacaatggtttgtaagggaaaaaaaataaactgcaaatcaatcaagttaatatgacagacctcggctctgcctcatgccatctttcataatgtagacatcttccacatgaccatacggcgcaaaaatctacaaaataaaccagacacaaatttgatttaatatgtacttgatatatgcttcttaacttaaaatgatgagttcataaataaagcatcaaaaagcaatgcaaaatttcacattggtcttggatagatgagttctaaatctacataaccttcttttgaacaacagacccttacctcttcaatctccttcgcagtagcttgcttattgagtgatgcgacaaacagcttgtgctcaatagcccctaacaaatagatgaaaagtgatgaaaccacccaataagtacaataaagaaaatataagtgaagaaagtaaatttctattaacaagtcaaacatatttcactccactaatatttttgtttagcctaaaaagggaacagtacgattatcaaccatagaagttatggggtggagctatgctatacaattgactcaaatcccagcattgttctaaagtaccaatagcccactgataacaaaaatactattagttaccatggcgttccctttcaccatcagcatatctgacttgaatagggcccattgcctgacagaaaagatacacacagtcaataattcaagagtcttacagacaaaagactgactataaatgagtacacaacaaagagattagttaccccaggtaaagtgtactggttgtgaagagctctgatggctcgctcagcctcttcagaagtagcatatttaacaaaacaacaacctgcaaatatgagcatatcgatttgatcacaagccgttgcaattttctgtatgtttcacaatgatcatgtatatgagagaaacatagcagagttagccaaagcaggatagaaaggtggcgcattattttgaaacaggtcgtgaaattcgactccacattccaatctttgacattgaagatgaacaatactactcccaccatcaagaagcgaaatccattcaacgagacaagcataaaagccttattaaaaagtaataagattaaataatataactatttggtaatatggcatgtcaaaatatttagactacactgtgcaactgccagcaacattcatgcaagaagaatttacggctaatgtatgaaacattaagttctttcgcgatgctccaactgactgcatattccattaaaatttcagtaacagcttgcatcatacaacttatgttaccatcatactagaacaaacataaagtgttttgctcgtaataaaagaaacagggtgtgcctggttcacaacttcacatacagcactatactacatccatcactccagaagatggcatacagacagcagttcacagtaatggatcatgtggtgcacagcaattgcagaaaattgtggtaacagtaggaagaaagctcatgtacccattaaatagacaggataacaaaaaatcttcaaagggttcacaaaagggagaccacatttgcaatctgataatatgagccagacctagattcaacaatgtcgatgcactcagattctgattagcacacgtggcataatgtaccaactacctaatagttccattcaatatcaatacaagccagtcacagcttgaccaagaataagtgctacatgttgaacatcatagtaccatcctctctcaacaataataatgagcataactcctgtactcataactgatgggaggcacacattaaagatggcaaccaagtcgtgcgcaataaacaaaatataatcacaacagcacatctcagggtacgatgccttgcgcagcctcctgactccaatggctggagtgtggtcataacccagatagcatattataaagtataaacgggtctagaatcagagttcaacttcaactgatggtaaaaacaaatgctcatccaatcatttccacaaaaaataaaataccagcaccacagttcaagtgcaagggcttttcccagcactaccatcaattccatgccacataatctgattttgggtattctgaactcaaatctttagtacgccataataacagaaatgcatggatcatgaatctgagtaaaaaaatcggagtgaaagttaccacaaatgaaatacataaaatcacaaaggtgaggactactataaacacatggtgcagtacgcattgcttaatgtatcatcatcaccatcatataaaggtaagttctacaaaagatcgactcaattttttggtgccacagtcccaggctaaagaaccagaatggctgaatcatcaaaagcaaagccataattatctggtactggaagtgataccagcagtgccattcattctcaaatacaggtcaactcaaacagagcaagctgatcacatacaacagcaaaagctgttggagattgcactttaatagatatatttcatacaaatggcaagtaccatcgtgatgaccatcacacccagtaatgacactctgtctgcaaacatacaattcccactaaatgcatacagaataaaaagttgtcatgcccaagcatccataaattgcatagtcagcatatcacaatcaaacaaccagaactcacaggatatcattattatttcagaataaccaggaaggccgcgccactcatggtaataatgtatagctgaactgaacaaatagcattactgtccatccaaccacaactctagattagtactgctcacaacaagcacccatgatttctgaacactaaacaacaaaaagtatagcaccagtttagattagtcaggacaacactacagtgcaccatccaaccagaaacccactcacaaatcaaagggttcatcactcataccaacgggattccatacagagaaattcacgatgctagaataacaaaatctggatccatggaacagaaaatgatgaaatagtttggtctgaattcatcaaaatgttccctgttcttttgcagcacattcaaaagaaatggatgcaaaagttttcaacagattgatgtgactgaacaaagttgctggtactgaatctgctactttgtctagcagcagatcagaatatccagttagattacagtaatcagacaacagttaattgcttccattctcttcctctactgaaccaacaggagagaaacagaatggaagcgcggtaaaatgaagtcaacaactgccaaatctaactgagagaagatgcaacctcgttgctcctagtaactctcaggacctgaaaagaaagagatacagaacttgtaataatattaaggaaaaaagttttgccgtaccttgctgttcaccagtcttcctatccttgatcaaagcaacttcaacaacatctccatgctcctcaaataaaggacgtacctggagaaaggagaaatgtcttttacaaactggatagctcaagaagaaaatagaaggcaacaaaagagtgccaaaaatcaagtagtgaacaacaaattaaatgggtaaccatatgaattacttataatggatatgagatcagataaacccgaaactaagcaataggcaaaaggtagcttcagctagtttctaagtgagctttttctctcaacgtagatagtttcttagatgatttttgaccaacatgaatgcctatatttatattatcttctaagccaacttgtagaacttgtaagcattaagcctacggattgtttcagatacagcgatagctacgataaaacaacctcaaataacagattatagtcaggcagaagaatacaaattgaaagcagaacataaagagttaactaaggacgaaagagcagatacaacatcaagtggtgtaagtgtaacactcacatcatcctcagtcgctgtccttggaactgacccaataaaaagtttaacatagttgtttctgttatcatgatctgcaccgaaaaattagatgtaaatcatattttgcagatgaaagggtgtaaaacataagctctaaataattctccagtgaagcccacttagataaaacagtacatcgagatgctctagagcattgtattcattactactatcacaatccctacattggccctggttggctttgaactggaaaaaagaactaaatagtatataaaacaagaaacgtttagctgaacatgctataactgaatgctgaacctagaataaacagactctcaagtttcagaacgagacgatttcctagcccctcctgcaaccattaggccatgttatgaagtaaaacattctctacaagactaaaaccaatcaaaggtcgtcctccatgcaaaaaaagttaggtggtggctttgccatctagtacatacgtcagagccatataatggaactgtacactcgtgtgcagtgcgaatttcagcaagatatcccacatgcgaatattaattgcttaggttttccaacatccacagtaaaagttgatttactaagataattttcatacataagctaaggtacaaatcgtgaccaaaacacctcgtcacgtgtaagcagatcccaatcctaagatagctcgggaaaacctaaagtatcccaggcgcgataatctgggcacaaacctgagtggtcaccacggccactgccgtagcggtgtctcggcccgctacccggctccccgtactcgccgccgccgccgcttctgtagcctccgccgccggagtggtccgacgggccacggtacgggtggaacctcccgcctccacctccgcctccgccaccgtcgccgccgcccccacccccaccacgggagaagcggtggggtgggctgccgctaccgccgccgccaccgccggacgaccagcgagaagggccgcggccgaatcggccgtccccgccgccgcgagaaccgggcgcggggccggaggaggggtcggtggagcggtcgccgccgcggtgcatgtgggtggagggggaggtgggctagggttttgcgagagcacgagagaggagaggagaaggagaggagaggagactcgggagggagaggcgactcaggcgagacctcgactcgagacacaacacaacacaagagcccgtggggattttttttttattttgatctttggtttctcgtttacttgagttgtgtgcgtggatgagattggatcggatggtctcgattcgatgcgcctattggtcagaagtagtagaactcagaagtcgttgagctcgtccaatttaagctcaaattaaaaaatatattattctcttaaaaaaaagtccaaataccctctaaactacatatagaagtttgtaaggcatcttaaactttaaaactagatatctaactccctaaactttacaaaacagttcatattatctcttaaggggattttgtataatggtttttatctaatttgtactctctccgtttcaggttataagacgttttgatttttgtcaaagtctaattgttttaagtttgaccaagtttgtagaaaaaagtagtaacattttcaacccaagataaatttattatgaaaatatattcaattattgatttaatgaaactaatttagtattataaatattactatatttgtctatgatcttagtcaaacttgaaacagtttgactttgaccgaagtcaaaacgtcttataacttgaaacggagagagtatataacttggatgagtttgatcacgtgacatatacattggacatatatattaaaatctccatttaaatctttctttttaatcacttgttagctctcacttgtttgcaaacaagtaccaacataataatagtatagtataactatataagtacaaattgatgatatgcaaatatgttatattagttattcaaaattgtttgtttaagcttccaaaatatgcaaaaccaccttagggggtaatatgaacggttttacaaagaccaagggattagatgtccagttttaaagttcggggtgctagatagactttcatctaaagtatagggggtgtttggacttttttttagttaacaagacttaagtacccgtacatacacgtatctctataaatacacatatactctctttgttcacacatctatactttttatatagttggtacacactaactcctaaagctcaacatgtaactgtgtcacatcatcatccactatggcatatcatcatcatactctagagtattttaaatctcatgcaagatgatgaggacacaactagctcggatataaccatgactatcttatgtattaatcaaccaaaggtacatgtgttctacattagatttacttattatatatttgaacaaacgttgctacacaataagttttgtatgttttcgtttgtagagatacttgcttgggcgaaagaaaagataccgagcataacgaatgcatggatgatcaaagaagttcattagggaccaaatcaagaccttctcctagtccacttccatctcaccatgtcacttttggtccatagaagataagagataaagttctacatgttttggattcagattcgggccttctgacagcatcaacttcaaacggacctagccgctgatctagaaggaatttcggggcccatgagtacttgttggaaagcttatggactctaatggttttggtcccacgtcaaaattcctaccgagatgccgggaatctctaaaacaagccacgtatcttatccagtccgaatctgatttgggttttgggccttgtaattgtgtcgtgggcttagcccaagggggtgtgcgccctagggcaaccctaggacgtccctaatcatacttaatcagtaaccgtcatcatttagagtcgggttttgcttagattaatctgtcaagaacagtttcgccgttagatcggtttgtaaattcgtgtgcttaatcattcatatgcaaattggttgcaatctatcttgttcttgcttgtgttcttcgattcgcatgtagggattagccttcttggtgaggtcaaccggatttcggcacggttgataaccagaggagacgtggtgctgcgattgcggggctcaatagcgtgttcattcagaagccggatcgagttgtgtcgcgactccgcccaattcgactgtttatcaatacctattgaaaaatcgagacctaacatccctcatcacaagcatgacatattatttacaatattgttgtatttttagaattcaacatgcaagtaatgttaaaatcatcgtttccacgttattttcacattatttacacatatacatctatcattataattttataatgtataccatgtatccatccacataccaattaactagtatttctcaattattaaatgcttatttaccatactataattttttaatgtaaaataaaggtcttattagttatatctgcttatttaccccctaaactattgcgacgatacaaaatactcccatgaactataaaaccggacaattttcatcctcaacttttcatattggacgaattacccccctgactcgctctagagcgattttgatcctacatggtagtctagtcaacatgaaaaaaaattaaaagtgacagggcccaccatgtcatacatgggcaatagagcattggggaagatatgacatgcgggtcccaccgttttttagtttttttatgctgattgaattgccacgtgtgtaccacgtaggaacaaatcgctctagagcgagtcggggggtaatttttcatatataaaaagttgagagtgaagaatgtctggttttatagttcatgaggataattcgtaccgtcagaataatttatggggtaattcagacttttttattgtgttttagcggcacaaggatttaattagcatttaatgatcctatttgtaagcatagtaatcggtctaaaattggagtaaatcatatactcataatatcttttgaggttgggctttatgcttggatgatattggcacactaaagttatgatttagcatagtgtggcttgaaatgcatttgcagtgacaataggtgtgtgttttcaactacaagatcccatgttcaatgtccaacgtactcacaatttttcttatttttttaaaaaaatgtttgaagggatgtccctccctcaagatcccatgtttgaagaaaaaaaaaatctttttttctatgtgtggcccaataaaaatgagcttggctagatagataatttctaacgtaagagtgcatctcataagtcataattcaatcacctactcaaaaaatttaaacagaaaaaaacaacaaccattacagtgttgcctttgcaacatgtggtaatttaaagagagtataacatctgcggagacaaccccattgaacaagggttatttaatattttgttgagtaagaaagaagatgacgctattagatgctcctagtgtgatttctgtgatgagatgatttgaactgtgttatgtttctacatagcgaattggtgtaccgactactacctccatcgtgttaaaaaaaaaaagactaccacctccatcctagttgaagtgcagttgtgagttttcgtgtccaacgtttgaccgttcgtcttatttgaaaaatttatgaaaaaatttaaaaaaagtcacagataaagcattattcatatattatcatctaataataataaaaattaatcataattttttttaaataagatggatagtcaaacgttgaataaacgatacaaaactatattctttcttggacggaggtaagtactactccaatttttatgaagatatgtatacacctccaagaccttgttcggttcgaaaaggattcccttcctcatggggattgagcaatcatgacctaagttagcttatttagaccgtaagcagcagaagaatatatcttatgcatataaatttttcgtacacatcaactagcaaatgtaaaaaagtttctagaaaaaatttgacacataatacatcctgggctggttagtgttgtgataaaactagcgtcattttttccacgcttgtgtgtgtgcttggtcgggtattcatttaacactatatataatagtgatccaaatagtgcccgaccggataaccgtttgatcaagcacactgcccgtttttcttgagtactactagctctcttcactagtctacgtgtcatctatttagaggattttttttaaaaaaaacaaaatgggtacggttttggctgttattagctgatgattaggaggatgagtgcattcccccctaagatacacctacacggagtggagaaacacactgctatgatgataacgtttgatttcttacaatgagtcaaggggcaagactcccgtaagagtgcttcacaaccagcactgtccaggattatcagtgtgcccaatcaacctggtgaaatgtgcttagcgagcaacatatattcattcatctgaaacataactctacatagaaacaggctaaacaaaacagactgaaaataaacagatgcagataagaaataatcaaaggtaatgagaaacagatgcagataagaaataatcaaaggtaatgagatgcatcagcaacggcaaaagatccacagcatactcatcttggtcatcgggttcaaaagattttgcacgttgctttcccgcacaataagcacatatatcgtaaactatttcatccctcttctgtccaaagagcggcaaaactaaaacgatattaactccgacacattacacccctgaatcagggaaagcttttaaagtggggaaagggggggagatctacagtttttcttcttcttatgtatggtacacacaagaacattacgatcttcgatcatccacctgggggtcagggtccaaaagatgaaatggcaattatcaactacagaaatcatcaaaagggcgaccggtcctatcttaactgctgactgctacactatgcctcctaaatctcacagttctacatcgtctcaacttggcgattgcttcttgtgccttcccttgaagaaggtccacataaactgatgctagcactgccctggggttgttgggcaacaaggcaacgccacggcttaccatatagttagcctgctcaagctctccctgcactgcagctgtcatgcctaggtcaatataaagaacaccctgagcttcctcaggcttgaggctttctgaatactgagattctcctgaggacaattttgtgactaccggagcaactgaatcttcaccatcgctgtctttctcaacaagggctttctcgcagttctcaatgctgtaaggcaactcaatatcatcgccatctctcaaataaacagttaattgctcagcagcctcctttggtctattcagtgcacaaagtgcttcagctgcgtatacatggctgaggaaaacatacatcctggaacattctggcagctgctgtagcaacttggcaatagacaaagctttcaagtgattctgaagacacaactcaataaatgcaaggtcccccaagatggcttgtttaattttgaggttctcttttctacatatgtcatcatacaaagcaagagagctctgcaaggtgacattcaagtttgaaattcccttctgttctccatttgcattagttagtgctggaccaggcggtttggaatctgtattagtggtgttcttctgacctgagcctttctggccttgcagtgatgtttgattcgattcctctgtgcctgatgcaatcaccagattttccttcgtagagggatccaataaaatttgggcattgagtagacactgtctagcaaatctaagggatatcagatttccatatttgtccaaacttacctcctccccagattctgaagaatgacttggcttcactgggtttataactaagtgccgccattttcctgaccccataacatcaacttcaatctcatcattgcacgaagtagcaccacttgaagtcaggatacccttttccagagctagcaggctacactcagcaaaacggagccaaaagagggacctgttgcacaagagcggcatggcttcacgaaaacagcgagctgctaacaaaggtttcccgcacatcaaatgttggatgccgcagttgtatgaaataagacaagatttgtcttgcgatattgcggtcagcttgcatggtttctctgaacgaagtgataagctatatttcaatgctttgctgaagcaccatactgaggtttgaatagat

SEQ ID NO: 62089 - DNA, 5038 bp, Oryza sativa
ttgcgatattgcggtcagcttgcatggtttctctgaacgaagtgataagctatatttcaatgctttgctgaagcaccatactgaggtttgaatagatctctgttggtggagtatgcaaccaagattattgtagaacatggccagcattgcttgttcactccgattattgggtgtgctcagcagcttcacagccttgcgatagtttcctctggcatattccaactgagatttcaggagaagctctgttgatgaatccctaccacgtgccatgttcatcagaactttcagttctcgctttgcaaccttaaggttcctagtaagaagcagaagccggaccttgtatatttgcagtctaactttcaaatcagcagcagtggcagcaagatcagctgaagcccttgagaaatcatttaaaattggtctgccccagttctgattaccaccatccaaggtagagtaaaaagattcaaactcaagtgtatcatcagaaaaatttcctgctgaaaggttttcagatccaccagcacaagtatttgaatcagaatctggaggtgtgctaatctttgcagaaggctttggttgagctgactgctgctgagctgtattagcattttcattctggtttgttgcgctaactactccaaatgacctttccaagtactgaattatatcctgtacaaacatatgtgatgcatgcagttgaataagatgctttatacaagagctaatgctgcaactttgaataaaaaggacaaacaaaaatggtacggttcgccatacaagttaagatcacaactatatctgacaatcttaggcacttgagttcagtaattctcacgtggaaaggcataatcatcatttggaatggataaaagtgaataatggaagccctaaaatcgttcagaacaggtaaatgtgaattttttgcattgaatcacttcttttttgttacaatgagtgttcacgcatggtacttctaaaattaacatatgaaaacatgagaatttggtcatcttggattgttgtgttaatactgcaatttaggacaaaacagaaaacaatatatggtagttctattttgtaatattaaataaatatagggaaaaattgcacgaaatgcattccagtcaaaatttgacaaaaaagggaactagttatggaagggtattttgacaccatggagcatatttttgggaaaaaatgtagataacaatgaatgtaaaacatcataagtggtaaatattggcatatgcaccaatgccaaggaggaagacattttttttaatttttatgcatcaaacagacgagacacagcatgtattgcattttcaggagaatctattgacaaaatacccataagcccacaaagctaatgtagtatttgtagcatcaactcacgatatactgagatgttaaaacttaccgcggcattcgatgcatcttgcaaagctaatgtaatatccaacaacagaaagcatacatgaagagcagttgtctgcagtattgaagaaatattagaaaatgtaacaacctggtttccaagttaagcatcttataactaataatacctcatcaattggttcaatatttcggtagagtggatccaaaatagatagtgcagattcataatcgtgaagatggtaaaggataacagcctgcaaattcaaaaatgccataaacaaatcaatcacctcttcagttaaagctcacaccaattacaatgcttaccatggttgattggctaaagcagtactacaattaatgcaagccatagaccagaaacatcaaacaatcaaataattacttttgcaaaagaaaagaacatacagtgttgaatgttattatggttgtgtcaaactcatccccataggttgtcgcattatttgcagcagaaatcagaggtataatgccactccctcttgatccagaagaaacactgtttcctgtcccattggcagaatcagtttgttgtctagatgcacaggcaagctcttcacttcttctctggatgcatgtaaggtggaacattagaattttcgtaaataattattaaatcaggagaataaaacaatgacataataagagaaaatgagaaatcaaaacaggcaccataaattaaggcttaaaaccacacaaaagtagatggctccaatgctataagtagatgtaagtggttaggggacgaccataacacgttacagtgatatgtgtgcagttgtgtaaatgactgaataactggcatgctgcataatattagatatttatatgcgcaacttgaatgacgaataaaaatggagtctgagaacctaatgtgagttccaaacatatagtgatgatatcacatctgaaaaaaatatagttataagttcatccactacaaaaaagaatatatggttttctttggtcagcattaacagcatttacataaaagttagaaacctttgacaaaaccagcatttgtaatattgtttcttacttcccatcaatgaagaatcgtaaattgtggaatacaaagactaccgttaggtccagatatattcaaaaaagaagaaatgatggctcatgactaaatataagttttgagcccctcactgatagatgtcgatcaaaatgcacgcaagtcaagatattatgactactctcaacatgtagcatgttatatgccttctgttttgtgcattaatgcatcacataactcctgactaatgagggatgcttttaccatatacaacatatacacatacaacaaacacaaataaaatgtagatgttaaagtttactatacacaaaacaaaataaattttcgtgcatgtagcatgtgacaaatatcttcatcaacccagaagaaggaaaagaacaaatttgaaattggaactgaaacatagatgagttgtgcaaaatgataagacccacggcgaatggatgaaggaaaacagggcagaacaagaagactgtccttttgagaactaagtatagttagtaacatataattgacactaactaaatgattggactaaagtgacaaacatcaaaattatatcatttcttgtataaccaaatttacaattggaatgaatttatataagaaaaaaaaagtaaacatagttttaggtttgaattattgttgccaagaaaattttaggtacatttggaaaacagaaatttctacccaaaaaaaatcagaaactcctgtacaaacagtaacttagctgtagagttctctactgacaaaagaatggatatttctagtacatagcctcaatggaaatatgaacatcaaaagtcaaacaaactaatgcaaattcactaaccttaacattgcctagaatttcaagcaatttctttgggtcaggacaaccatccaagaaagattctgcaatagccatattgtgaaggacctgaaagattataaaaatgcaatatcagatgccaaaataatacatgatcagagtatcatctctttatcaagatatagtggaaaagctaccagttcaagataaccaccgtagaaaagcatctaagagcataatatgcagtatacacagatatcgggtaattgttttttttcctatttgtatgcatattgttctttcagacttataaccttattaaacagatcatgccctatacatgaaatggacaagataagtaattagaatcatgcacgaggagaagcacatactgggtgacacataccagtgtggacatccatgtctacgcatgcatcaaacacaacatgaaactgatgaaatacaaattaacaagcatgcaaacacaaacccaataattcaagatgcacccacctgcatatcacacacagaccataacgcacatacaggtgaaatatgcagacatctacgcaaacacggaggcaagatgcacccaactgcctagattaacatacgcaaactcgcaactcaccccacgagctcaacccataatgctgcggaagcagctccactaacgaacacctagcaagcaagatataacctagagaagcagatggattcggtaaaagattttgtcgtttagcgaggaaggacctaacccaactaatcaccccgaagcagagatggcgaatcggctaccttggggtcgccctccttcttgagcaggagctgcgcgagcacctcggcgcagtcggcgtagcggcggctctggaacagcacggcggcgtctctggccatagcggccgtgacggagagcatcccttcctcctcggtggaggacggagactggggcggcggcggcgggggcgcctccttgggctccattgtgcgggtggatctagcaggatgggggctaatcgggggcgcagggcgccagggtagggccggaatcgcgcggcgaggcggtgaatcggagctccggagggcaggatttggggggccgggagggagagctagggtttggaaccgacggcgcggcgagagcgagactcgacgggggatgtggagcgagttgccaactgaggaaggccgatggatagacgtcggaggtcgcctcctcttttcctttttcttttttttttaattttgatgattgtttttctacccgacttatgcagtagtactaggcatcttaaccaccgtcggatctactcaaaatgttaaaccctaatataaaaaataaactaataagactccagcaaattggaaaaattctatgcgggggattgaaagtttacacgagagaattgatggtgagattaagatggaaatttaatttttaatcccagtatcttgtttggtagatgtggtgaaaattgatacggagtttagttggagattaggtcattaatcaaaacggatggctgagatttgtttaggtaaagtaaagaaggaattccctcccaattaccacccctacccaggtcaattccccatccccatcccaccaaaattcccatgtatcacaaccaaacaaagcagttaatagcctcatccctttaaactcccaatccctcctaaaaactccctccaaccaaacgagccgatagttataatccggttgcaaaataaatactacataataaata

SEQ ID NO: 62090 - DNA, 6012 bp, Oryza sativa
tgtttaggtaaccccaagaaggaattccctcccaattaccacccctacccaggtcaattccccatccccatcccaccaaaattcccatgtatcacaaccaaacaaagcagttaatagcctcatccctttaaactcccaatccctcctaaaaactccctccaaccaaacgagccgatagttataatccggttgcaaaataaatactacataataaatatatggttataatattattacaacacaataaatactagaaatattttagagtaaattgcattgccgataaaaaaacttgtcaggtaggtgcaatctactgcacgaacttgcaaagtgctcgctttcgtgaatgaacttgtctggtgcatgcgaaggaaggcgaaaaggacacaacatggctaatcttattgatttaggggctggttaggaaattatgtaaacatatactatatgagaaggttattattagacatacacatcttcaataaaaaatagaataggatatagtgatagttgaaaaagataaaggaaaagagcaatgatataatggttagaaatatatgaaattcattatttccatgacaaaggataaagtagagaccaaatttataaatattacatgtcttatgcatgcatactcactacacgtaagcacgtcacatcctaatcaacgtcatcttcgtaaaattaacatggtcaagttattttggtcctcttcgcacggactagacatgttcatgtactgaaacaagcattttacaagtttatatactaaattgcacctacctaacaagtttgtgtaccaccaatgcaatttacttcatatattttattatgactcctgagttcataagagattttttagatgctggaataaaaccccggcaactgctcaacgagctacaaccaattattacaaaattcactcaacgatgagcacacactaacaagtccataataaacatacaaatcggcgctcatatgtgagtgtgatgacaagcaaccttgtgtgcaacggatgctacatctcgcctcgtgaatgtaggggtgaatgaaaagctcgtgactcgttagctctcttaactcatggttgactcggctcagctcgttgcggttttataacgagctgagttgacattttagcttgttggaaataacgatcccgtgcgagctaactcgcgagctaagaatagcccaatcctgccacttcatacgagcccaacaagagtaaaaatggcccaacaaactgaccactcctcaaaataaaggccctaactcttagtctccctcccccctaattccttgctccagtaactaggcaccagttgcataggttctcggagcagcatcgccacccactggcatttcgcgccccaagcccctagagccgccacaccgccgccccagcccttgagccctcgtcgtcaactttgcccattgctagtagcctccactgggaagtgaggtcatggtggcccacctcgtcaatgcccgcggtagtcgcagctccacctctgcctcatcatcatggagaagaccaatgagtaggagcaagcaagtccaccactggtgccaccaagttcaaaatcaaggagcaaatgttagagcttgttgtcctcatcaccatcggcagtgcaacactgcaagccgatctgccatgttaattttggttggtgatttgtttgcttcgtcttttggttggttgcaatttcaccaggcttctagatctggtaaagctcgggtattccaaattggtaaagctcgagtattccaaattgatgtgtacagaaatttcgttctaggtctgtgatttttattcaattgcacaaaatgtttctggcctagttgctgtaatctttgagactttgatgtgtttctttgaaggaaagactagtcaaacgtgtattggccgtgaggcaaacgagctacctcgagcttccaagtgagccgagccggggttatagctcgttagggtaaaaagccgagccgagccaacttgatatccacccctatgtgattgtgcaggcgttgcggtgtagcatgaacatgggtgatcttgtatgtgaatgcgtcgtgtgagcacaagatcacccccacacttgttcttgtacctagggtgcttcaaagacacaaagacaaaacaaaagtgaaagcaaaaggactcacccggtgatgcccggtgggtcaattattttattaattttattgatgggtgcaattacacaaggaattgaaaaaaaaataaagaaaataactgaaataaaacctaacgcgcctatcggactccaaaggatactatggaaggtctaagggctagaagcacaggacatatcttcctttcccacaaccttatacaggcgaaagagcttggcacaaaggacacaactaaaggatgcaaggcttgtcctgagctcctcaagctctacctgtccctctgccacagtgtccatatgaattatgtaaaagaccaaagctatataaagaagaatatttcattaatactataagtcttatataagaaggaagagctactagagctatacccgaaatctcctgaagacccgaggactaagaaaactccactagcactagaacaataaactaaacttgagatagttctttatctttttcttgagtgtgtgttggagagtgaatgagcacccctttatataacctctcaatgacggttatggcagttggaaatgccggaaatgccctccaaccgtcattgagagttgtaacaccttgaaaatttcggtttagaaatacgaaattaaaaattcggaataaccaaaaaatcttttcaaacttccttgcatactggaatttattggattttatttcccgttttcctgctatatatgggctaaaagatgaacgtatgagaatatgcttgtattttgatttcaaatattatttattcaaagaaccatgattatgaaatatgtcaatatttgcaaataccaatcattttcctaaaatcccttctccatatattagaaccccttcgacatatttgttctataaataaagttatatattacaattttgaaaggaaaccctctatggggcagtccattaaaacaaatactactttacaaaggaaatattgttttgattattaactaagaatccttgtaaaggattaagtcttttggcaactatattgcaaataatagctactaataaagtatttactgaaagccctatttgtgaaatataattcttaaaatggcaattttaaaagaaaaggctttcttagataaagtctggtttatctctttgagaagcctagcctagcccgcataatggattttgtaattaattgtgtgtttagtttttgtgccaaaaatctcgattaaatcttatctcctaaaagtatgccccctgttcgacatcctcccctgtcccctctctgccccgtctgtttggtcaagcgctttggtgctaaacaaatcacagtcccgaagctctctgctcctatcgcaattttatcgctctctcaaaactcttatcctacggttaaattgaaatcgctctattgtttcgaactcgataattccctcgaaaaatctacgatcgttcgacggatttatttatcgtgcatcgattcaaatatcttcaattttatccctaccattgaaccctaccatgttgattggaattatatgccatgagtcacccctattacccctatttgatatcgagattcattcattcgagcgatcgcaaagaaatcctaattctaatccccgcacgacctttttgccaaatcaaactccaatgtctcatttagcggcctaattaccattatacagtcctatgtacagtcttggtgcatgttcgagttcaagtgccaattccaatttccaaattcgagactcccttgtaatttacaaaatccccgaggagatacaaaacaagtccagcagtactagttcaaataaatcaatgtccaaattatacagtaccttgcacagtccaaattataaatacagtccaatttacaagtttcacatacacatcccaagttcctattacaatcgggccatctcttttccctgccaggccaacccatccctcacagcaagtccattgttaccccctcggcatagcagtagcagcccactccctctctccttctcagcctaaagtctactttgctttcctcagccaacacagcatgcatgcacagaagatgtttgatgaaatgcctgcaagccatcacacacatttgactaccatcaaatagctgggaaccctccccaacaacaccccatgcaccatgcaccatgcacccaattcacagaactctccaccaaaaaccaacaaacacagtaaagagagttcacaccgaaaagaactgagctcaccaaaaggaattgcataccctgcctcctgcattccaacagccacaaacatatataaaagccgctgccaaaaaccatcacctctgctttgccactgccactgccactgcctctgcctgctcctccctgcgcacatgccgccgcttgctccgccgcgtctggccacgagtcgagcctcggttgggcaaggggttgaggttggccgccgcgccgtcccgtgagcttcctttcgcacgcaagtgcacgaactatgagaacaatcgaacctttgaacgcttgaactcttgaacgtatccaaaacttgcaaacgaacttgaaccatggacgtaaccaactaaaattcaaactaaaaactgaaaaacaaacctctgtgaaccttggtggagcacttggcgcgcgaggacgaaccgcgagccgagcctcgacgcccgtcgaccgcgcacggtgtaccgctactcggctgccgcgaggtgagcatcttctccttcccttgctcttctcccttgtaacatctgaaaatttcggttttaaaatacgaaattaaaaattcgaaataactaaaaatcttttctaacctacttgcatgctagaatttatttgattttattttccgttttcctgctatgcataacgtatgagaatatgcgtgtattttgatttcaaatattatttatttaaagaaccatgattatgaaatatgttaatatttgcaaataccaattattttcctaaaaacccttctctatatattagaacccctctgacatatttgttctataaataaagatatatattacagttttgaatagaaaccctctatgggatagtttgttaaaacgaatactattttgcaaaggaaatataattttgattattttctaagaatccttaaaaaggaataagtccttcggaaaataacttgcaaatgatatctaagtagtaaagtatttatcaaaatcttacttgcaaagtgaaaaataattcctaaaaggctattttaaaagaaatgactttcacagataaagtccggttttattcccccttaaaaggcctagcgttgatatttcttacaggggcggacctacccattgggcagggttgggcgaccggcccagctacggcccacgttgccccactcccctggatgccatatccatcagtccatcaaggaatagcccacaagtcagcccatcaagcaaacaagccaatgttagcccgttaggcatctgttaacgaccaaatttggtaagatatgaaccaggttcggcattggaatcgaagtggattcggcaaagacatagatttgaagaatagagtatgcatcggctgcgaaggcatcggctggattctgaatcggctgagatggcttcgaggctgcttctagaatcgatggacgtgcttcatgaggattgccacgatggagataaagctctcagataggtaattgtatctattaattaggatatcttatttaatttccttagagatatgtttgggtaaaagtctgccgcaaagacttatggtatcttagagtttgttagagataagagtcgtgtccggcaaggacatattttgtatctcgggtataaatatgacctgaacccatgtaatcaattaacacatgttcaataacactttcggcgca

SEQ ID NO: 62091 - DNA, 1088 bp, Oryza sativa
cggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccacagagccacgagcgccgacccgaggtggtgggccttcgtcctcggtacaatgctgttgagaaagatggaaaagaggagtgaggaggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaagg

SEQ ID NO: 62092 - DNA, 4135 bp, Oryza sativa
ttcctgcagccccacctgcatgacgtaagtagcagtagtaggatcacctgcaagaagaattctgagagcagcaagcgtacgtggcgtgagattctgacggtgcgtacgtggtgttgtgtgttgggcctgcaggtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggtcagtacctctatcttcttcaggcacgcagtatagtactcctatataattagtagcaaaagcgttcagtggctacgtgtctaattgttcatgtgggttttgtgattaatttgcaggctgtggttggtgacgtggcaccttgggctgttcctggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaaatctttttcgcaattagacacagacgcacgcacaaacgacactgcatgtacagttgtacacaattacacactcgcacagaccaccaaaattactggaccaccaaaattttgtagtatcacaaaaccaacccatgtttaacggtatcgaccaataaataccataatatctgatatcatgtagcaaattttgccatttaacaaatatttaagaacacaaaattgattggtttgtaatataacctttctctttacataattcattgattatacaattgtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtctaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaacccaggtttgccttttttttttgggacggagggagtagataactacattccccgtaaagtaagtatgagtgtatgggatacctcatatctactacttcctccgttttatattataagattttctagcattttcaaaagactggaccgacatatcttaagattgatgaagtcaacacgaacatcttgctgtcgataggtatctcgtctaccactgaaagaataattagccataattacaaacacctgtgatatactctcttatttcctaaatatttgacgccgttgactttttaaaacatgtttgaccgttcatcttattcaaaaacttttatgaaatatgcaaaactatatgtatatataaaagtatatttaagaatgaatcaaatgataagaaaataattaataattgcttaaattttttaataagaacgaacggtcaaacatatttaaaaaggtcaacgacgtcaaatatttagggacggagtgagtaggacttaaggtctgttcagattatagccaaaataaacctagacatagacttattcaaaaattttggcaatattgtcaaaattttggcaggattttttatgtatttaccaaatttaacaacaaactaaacatagacatttctttggcaactttactcaaaaatagtatggttgaaaatgacatcaatctgaatagccctaaatcaggctggcctgggtcaaatacaagaaacataaccggtgagctattcttgaacgaacgtaattcaggatacaacatattgttttgattctacataatttataagttgaatttccaaaactcaatcaaaccatcaatcttcaaatatttcaattggatatatgaaaaccatgtgtagattttcttttaaaaaaatcgtaaacatgtacaaaaaaattctgaatttttacattagttgctcgtttgctactgggctagctagcagtctagcaccacaccaacatggctaggcccaagcccaactcgtgatccagtcatccatagtcgactcgactttgggttcgagcgatcgaaactcggtaacccaggcgaggcgaatccaaatgcgaccacccgctggccggcctccccgctcgccgccgccgccgccgcatgaccaccgccgtcctccggccatccccaccggtcgccaccctcctcggccgctgccgcaccgcgcgctgcctcgcccagctccacgcccgcatcgtccgcctcggcctccacaaccaccacgcgctcctcgcccgcttcgccgccgcctgcgacgccctctcctgcccctccgtcgccgcctccctcctctccgtcgccgtcccggtacgcctgcggaacgccgtgctcgcctccctcgcccgccacgccccgctgcgggacgcgctcgcgcagttcaacctcctccgcgggggcgcgtcccgcccggacgccttctccttccctcccctcctctgcgcctgcgcgcgcgcctcctccctccccaccggcgcttccttgcacgccgcggccatccgcctcggagtcgacgccgacctcttcgtccgcacggcgctcatccagttctatgggaggtgcggcgccgctgccgccgcccgggctctgttcgattcactgacaaaccccagcgaggtctcttggacggccattgtcactgcctatgtcaactctggtgatattttgactgccagggagttgttcgaccaaattccacaccgaaatgtggtgcattggaatgccatggttgatgggtatgtgaagtgcggtgacttggagggtgcaaggaagctgtttgatgaaatgcctgagagaactcctgcagcgtacacatcattgattggcgggtatttaaatgcagggaacatgggagctgcgagaacattgtttgataagctagaggaccgtgatttgttcgcatggtcaacaatgatatcagggtgtgcacagaacggttaccctggagaggctttgaggatttttaacgagttccaaaagcaagaaatatgtccagatgagcttgttattgttggtttgatgtcagcatgctcccaacttggtaacatcacattggcaagatggattgaaggttacatcatgatttatccaatagacatgaacaatgtccatgtgatggcgggtctcattaacatgaatgcaaagtgggctgcagg

SEQ ID NO: 62093 - DNA, 3479 bp, Oryza sativa
taggcttttgattggtaagggcttgtttacttttgtgtcacttttaaccctactaattttggtattatcaaatttttgtaaggcaacaaattatacatattcttattaatgttaccctaccaacctttggtagggcctgttcactttgatgctattttcaactttaccaaattttggtaaagttaacaaaaaagtggctacatttagtttgctgctaaattttagtaactatataagaaatcctaccaaaattttggcaagttgtcaaaattttgacaacattgccaaaatttggtaaggttttttttcggcatcaaagggtctattcactttgatgccattttcaaccttaccaaattttggtaaagttgccaaaaaaagtggctacatttagtttactgtcaaattttggtaactatataagaaatcctaccaaaattttggcaatgccaaagtgaacaggcccaaagttaacaggcccgtagttttataagtttccactcgtaaaaattccatcaaaacttgataaggcttcaaacaaaacatatctagcactaaaaatttggtaatgtaaaaatgtgttaaaatttagtataaccaaattttggtaaggttaaaagtgactataaagtgaacaagccctaagccaaataatttggcaatatcaacatttattttttgattggttaattttggtctcaaacaaaagaagcctgaagcctgaaatctgcaatctgaaatctttagacagttcccgtgtactatctccatcactaagacttcatttttagcccatttctacccatgccaatacaaaggaaaaaaaaagaatgttcttactttagcaaactccaatataattattctccactttagcaaatctcaatacgtttgtctcccaatactctaatgcaatgatcgctgaaaaagatggcgtctctgtaagacaaatagatggaaaacaaacttattctgagatgaaggaagtaataccatagtagcatccaaatctttggtaaaactatcttttctcttaaaaacatggtaactcaaaacattatactaatgtaaaatcggataacttagtaccatcttaaagatactcgagttgtaacataacatcgtaacatgataatgacatataaaggctggatctctggatctacatactaatgacgtactccctccatcctataatataagacgcacacgtatttaaagatttagcatttaaaatatttcactaacacttagtataatactcccttcatctctaaatgtttgacgtcattggtttttttaaacatggttggtcattcgtcttatttaaaaattttaagtaattattaattcttttcctatcatttgattcattgttaaatatacttttatgtatacatatagttttacatatttcagaaaagtttttgaataagacgaacagtcaaacatgtttaaaaaagtcaacgacatcaaatatttagggacgaatggagtataaaataaattttatttgttaaaaattatatcagattgatatttaaatttactttcatatggttatagttttgtggctaggaaccttatagtacatggaaaattataggttaaagattagttttggagaccgtgtcaattttgaccgcgtcttatattatgggataaagggagtagcatgtattttttagctcgtgatttttacagcggtaataaacaaatttacccatgtaaaatagatccttgccatacatattgcaacgtcatgcagttatatatgaccatatgaggatttgggccccgaaaccctgatgctagttcaggcaacccatgacggccggccgagccaaggcttcagaaaccattatgagaaaagaaatcaaaggatatatatgattatcttattgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccaggacattaatgccggtgagccgcccccatcgtcagcatctcagcggtatgcagatgccgtgccgatcgttcgacggccttctcccccccgcgaggaaaacgatatccttctaaacgcaattaagaatcagatacacggacacacggtacaccggtgcacaacagatttgctttgccatcaagccagaaaaaccggtcgccgtgaaaggcacagggaaacaaaacctgtttttcttttggttctctgtcacgtcaagtgcaacgaacggcacgtctcgcttgcgtttgcggttgcgcccgaccaaccagccgatcgcacgacgcgtaccgactcaagagtcaggtagacgcgccgcggcgtggcacggaggagacacggcgcgccacgcgttcgcggcctgagatgatacgccgaggcgagccgcgtcgcgccgtaccacgggcgccagcgcggccctggcacgcgccaccgaccccttctcgtcggctgccacgccggcgccctgcactgcaagccgcgcccacacggccacaccggcatgcgggttaaaacgaaagaaaattgtgaaacacaccaacgcactgtacaggtactggaccacgtcgcagccaggacggctgtggttttgaccagagttcaccgcgcttactactagtagggcacacaaggaggagtgctatataaaagccggaccacggcggaggcgcagtagttatcaccggttcatcgtacaaaagaggagagagagggtgatggcgccagggagagaagaagagaaaatggtggcgactactacgatagaggacctgcacggggctgcaggaat

SEQ ID NO: 62094 - DNA, 10545 bp, Oryza sativa
catggagggatccctgctcgcgatgcaatgccactgacaaacaatcttcaagtcgagctatttgatgtatggggaatcgacttcatgggacctttcccaaagtcctatgcctgcgagtatagcctagtggccgttgactatgtgtccaagtgggtagaggcaatgccatgcagggccgtagacgccaagcacgcccgccggatgttccatgagattatcttccctcgttttggaactccgcggatggcgataagtgacggagggtctcatttcatcgataagaccttccgaaaatttttgcaagaacttggggctcagcacaacattgccactccatatcatccccagacaagtggataggcagaaacgaccaacaaacaaatcaagaacattctacagaagactgtcaatgagatggggaaggcatggaagaacaagctacctgatgcactttgagcatataggactgcttataagacgcccataggcatgtcaccataccaacttgtctacaggaaaacatgccaccttccggtagagttggaacacagggcgcactgagctatccggacttgggaacatggatctaaagagagccggacaacacaggaagatgcagctctctgagctggaggaatggagggacaaggcctaccacaatgccaagatatataagaacagaaccaaaagatggcatgataaacaaatcaagcacaaggagttcaaagcaggggacaaggtgatgctgttcaactcacgggtgaagcttttcgaaatggaaaacttcaaagtaaatggagggtccatataccgtcgtcgacgcttcatcacatggagccgtcacgctgcgcgacaatgaaggtaacatctttaaggtaaatggccatcgtttaaaagttttccttgatccattagaagttgatcgtgacatagacgtggtaaatctagttgcttttagcttctacccggagtcctcaggtcctccttgatccgttaatttttaatgccatgagtccttaggcctccctctagttatcttaggtctagctatcatgatgaaaacaaaaacaaaaataaaatataatataataaagttggctccttgatcttccaaccaagtgagtcctttttgcttcactcttgtctttgtttttcttttttgtccaataaagagtcccatgtacaaagacaagtgtgggggtgatcttgcacatcaacaccataaatagagcaagatcaccctagaagtgatgagccatgacaaacaacacaagggagattgatgcagtcatacccaatgaatcgtcctctgttttatacagagtgcaggtttgcacaatttttcctttcgacatccattctatcttgagtttaattagattatcaattttaaaatatcgaagataattaaactcaagctagggatggtacaattatagtttatggtctccctgaaaataacatacatgcctattattctttgctcattacttgttgcttgtggtgacatatccaatagggaccccatgctatctaggtaattgatgaatgagatatagtatgatgatagaaatcttgctcttcatgttgcacacttggaaattttataaaaagaaaaaatataacgatgctaaactcctcattgatattttcattcccactagagccataggttgatcagtcatgattagcttgctacatacgctacttgttattacattgagctttgtcgaatattgtgagcctagtgaaatgcttttcatacttttatggtcaagatcacatatattccacatacatgcgcacatgcttgacttctacactggaagttagcattcctcatttgtcattcatttcatccatagtccacaaaataaatactccatgtcatttatgcctcttcctccaaagttctttcaaagaaaagagagagagagagagagaggcatttctatgcaaaaagaaagaaaaaaagtgctcatacaagtatggagcatgatgatgataaaaaaaaaaagaaaaaaaaagaaatagccatgcactctcccaaatttcaaaagagaataaatggacgacgaggtatacaaaaggagttattattattttcctttttctatccacaaatttaccatacacatacacatgcacttcttgaccagaaagtatgtcttgtatttctgtggatcaattatttgactttgcaatatatgtgatgcaagtaatgctctactcttttccatgccctgagcttcacatagccttattagatggtaggaaaagaaaaggcacaatcatatgcctttgtgaggaatcatacactttgagtgattaagagaatcaatggaggagcaaagcaaagttataattttgtgttacaaaaaaaaactccaagttgttcttcatgaaatgttagggtgacttgagtcaagattgttccatttctcaattgctcaagatcgcatggtagacactacaaagatccataagtacaggtatggctttgaataatttgtttgcatgattattagtaaggaagtcataaccctattgtatagtctatagccttcattcgggacgagcaaagattaagtgtgggggtgctgttgatggtccttaaatcataatatttgaccgtcaatacttgcatataatgaaataaaatatgttatccaacttagtggtaaggtttactactaattatttccactagtgttggtgagatatgtgtatgcaggtattttgagaagaaaatacatccgtgaagcgacaaactgcatctccgcgcattcaggacacatttacacagattggaggccccataagtcaattaaacaactccaaatgggcccaaccatgatgccaatgggctgagagcctcaaaattagtgtccacgaggaaaaacgggtccaacagagccctccgggtttggccgaaccaccagttcggccgaaccacttctgaggccgttgatcacgagattcgacgtggacggccctgattacttcttgatggcggttccggggtagtttggtcatttcacataggctgtaacagtcatacctacctataaaaggaggagctcactctactttccatcacacaactttgagctgagttacaagaggctctattgtatcttttgtacattacaataaggtagagagtgaggggatgctctggaggagtgcccggaagtttggcgctcatccgacttctacctcgacgagtgtagctctctaggaggaattctggaggagtactggacctctagtactaggactctttagtatttatactaagtgctctagtactaggactccggatagggaaggaagttcctgcgcaagtattagagtagtaattaataacttatgcgtggtgtctaggttaaagattacctttgtttgttgtgtatcccacggttttgtcagaggtagacgacaagtggtgatagccctgaatcccgtcctattaattctccacgttcggatacatcatagagctatagtcggaaccacgctggtagaccagcaggggtcggtgcccgaagcaacagataggaaaatacctttgcttagcttagataattaaaacacatagaaagtcctctctagcctgcctacctatagttgttgtccttggatcatcttagccttaggtagattacacatgttccctgagttcgatattcttttggggtcacccgaaggtgaagtgctacagcagtattccgtgcgcttgccgatttacctgtggtcgtaagaaataccaataggcaccggccctcccttggtctgccaggctatgtccagtcttgagctctatgatatacccgaacatggagggatacataaaggacagacatgactattaccacctaccggccatctcaatttttgggtagcaaacaacaaagaaaggtaatttctaacctagacaccacacttaagttattaattactccctccattccaaattgatctacatatagttttttttgaggttattcctaaatgatctacatatttgtgttcatttattaagtctattcgttatttgtgtattggagtaaatggacattgatgcatgcatccatgcacacaagtatttataacccacatgcaatatattgatttgctattggctaggaaatagtggggatggtgcatgcatagagtttgttgctagagtaaatatagtatgagagagttattagcttttcttggtcttggtgtactatgaaatatgtagatcaatttggaatggagggagtactactctagccttgtgcagaaacttcattctttatccagagtcctagtactagagcactcagttgcacactaagtgatgaacccgcacagatgagaatatacctcacttaaaataaactaattaaagaacataaggaaagtcgaatacttactttataaaaggaagcatccgccaaggtacaagcgagagaagaaggccgacaatcctgactttttctggtactccattggaagaatcccgacagtccaacactccttcgtataattcttggaggaactccaattttttggggcacaccttctggagcttcccttcactccctactcaagccaacatactaaagtaaagtctaaaatctaaaggtgagttgtactctactttgttctgcattttccaagtgtgaaggcctcctccttttatagcttgcaacgacagttagaatggcagttcttgatgagggatgttaggtcccgatcttctgataggtattgataaacagtcgatttgggcggagtcgcgacacaactcgatccggcttctgaacgaacacgctactaagccccgcaatcgcagcaccacgtctcctctggttatcaaccgtaccgaaacccggttgacctcgccgagaaggctaatccctgcatgcgaatcgaagaacacaagtaagaacaagatagattgcaaccaaattgcatatgaatgattaagcacacgaatttggggttccacaaaccgatctagcggcgaaactgttcttgacagaataatctaagcaaaacccaactctaaacgatgacggctactgaataaaaatgattagggacattctacggttgccctagggcgcacacccccatgggctaagcccacgacacagttataagtcccaaaacacaaatcagattcggactggatgatatacgtgacttgttttgcagattcccggcagctcggaaggaattttggcgtgggaccaaaaccatatgaaagtagactcaataagctttctaacaagtacttatgggccccaaaatttcttctagatcagcggctaggtccgtttgaagttgatgctgtcagggggcccagatccgaatccaaaacgtatagaactttatctattgtcttctatggaccaaaagtgatgtggtgagatgaaagaagacttggagaaggtcttggtttggtccccaatcaacttcttcaatcatccatgcattccttatgctcggactcttttctttcgcccaagcaagtacctctgcaaacgaaaacacacaaaactcattgtgtagcaacgtttgttcaaatatataacaagtaaatctaatgtagaatatatgtacctttggttgattaatacataaagtagtcatggttatatccgagctagttgtgtcctcatcagttctggtggtcggttcatccacaaccgtcattagggtgtaatcctagatttccacttggaaggccaggatgattggctacaaggtcggttgggcagaaccacgggttcggctgacatgtgggccccacctcctagttgctcctttggctaggagactaactagtgggcccttatggcagttaggattgtttagctcaactttaagtcggttttgacagtaaggtgggccggccctccaattcttatgctcgtgcgtgattgaccgaaggttcattttcgttgcatggcgggtgtattttctccttaaatgacctgcatatatatacttactgaagctagtggaaatggttagtaataaactcctaccactaagttttggtattatatttgacgtttcttatgcaggacttgacgattaaagtttgtacttaacgaccgtcaacaacacccccacagttatccattactcatccccgagtaaagctcatgggtcgactagagtaatgactttctgctcaatgatatgacacgcaaaatatttcaagatatacatgtgtctgtgaaccttgaagtgtctaccaccttggggttttctttgatgtttataaacttttactgtactcctcaattgattctctcgaatcactcaaagtgtttcattccacaccaaggcattgatgttggaaagtactaatcataattggtgggcatcaattttggaaacacaagcacgttatacttcgaaatggaaattacctgcatgcatgttctatggaaagtatatgcatgcaatatcttatcgtgttagacccgctaataggttatagtatcctatagtgcattgcacagatcttaaagcatttggattgtggatggccatggagcctgggcaccatggtgcaccaaagaaatgtactaactatatatatatatatatatatatatatatatatatatatatatatatatatatatatatatatatatatataaataactaacatgacgatgcgaagaagtatgtgaacatgtcgcccattataggtgtagtttaggagcacaatgcttatgataaaatggacaataataaacagtacaaataattacatacatggagggaagcaaaacatactatatggcactaaattctcagcttattactagcattcaattggttccttcttttgtttatcttatccaccaatgtaaataatccttttgctcatttggttttgtttaaactgaacttttcataacaagtgcgatgtatattattcactgctatgaaaataacagtaaccttgtttagttcataaaaaaattcagtacaaacatataaaacatcctactgatctccgcactggcatcaccatcgggtgctcttacacttcagaagatagtggcatgctttctcttccctccatcccaaggattacaaggtaaagataaacgggtaactgaaaaaccagagacagggaaccatttgtggcaagcttgggacaaggcaatctagcctacattcgaatcaagtataaatatcttacaatgtacatgtcaaagatttgaagttatcaaagagaagtaacaaagttgttatgatataatttacataacaggaataaagccaacatgtccacaagtaaaatacttaagatctaaactagaaacaaacacttcaggcatataagaataatactatagataagcaaaatttatgcgaactagcttgtcctgaatcactgaaaaaatgaaaattgtaggattgaaacatggcgatcaaccctaccggaggaaagaggggagggagggaggggttgaaatcgaaatcgaactttgaaatatcaaaactcaccttaacctcaaaagcaaaaaagacatgcatagtctgatatggtactattcaccgtttgaccattgctattcactagtttggaaatttcaattcagacacaaaatcactttaaacacaataaatacatcatatcaattattcatcacaccatattaattatcaccacgatttccaaaaaatatcataaatggtccttctccatcatgtttagagttctgctgattcactcatttacattaataatcgctaaaagattgctatgcatttattgcttttgcactttgttttatatgtcatcgatatgcattattgctttcaaaccttgtttatattggtttgctatgcatttattgcttttgaaccttgcttattgatatgcatttattgctttcgaaccatatttatatggtattgctttgcatttattgcttttgaacctaaaattacattgtttatatgatattgttaaacctttattgctttcgaacctaaaaaaatatgttgtttttagatggatgagcatagaaggcactcatcaagcccaaaataattaccagcaagttatatgccagatacttatattctagaacttcaccctttacatgttgtatgacgcatattggttatttttcatgtcgtgacatagtttcaacctgagacaaagagtgatagtctctttttcatgtacaaacttctttcacagttcatgaaaaataatcattgagattctctcttccaagctcacaacaaactaatatatctctgccaaacatctgatgatgcaaatgttctccttttttctaatttccttctccttctttgctctccctcctcaccttgtcttgctgctccttgtctgtcccagatatttctaagttcacatgtttgtgatgctgcactaccaatagttaattatacaaaactcggaaacaccccatcaccattccaaactttaagcctctaaaacactagcagacctcaatcatatgctctcctaacttaatttacattgtgggcatcgagcccaggagaccttccaagattatgaacaatatcagcagagagagctctgtttcgatgattttattctctatttctccaactggaaaatctaattgaattacaggtgaattatatagctccatagcagccaagacttggaacatgccatcccacattcccagcgactcaactcatgataccctcagaacatgccatcccacgatccgattgaatcggcctaagctaacaaactttgttgtgcacaccgcacatcacaagggaaaatgaaaaaaaaacagaggatttgattatcagtttgccatttctgaattaataactggcatacaacctactccattggttcttccttgggagcttcagcaatgttttcaccaaagagacggaaactacccttgggtacgccgttgagaggtgcagcccccatcaccagcaccctcccctcctctttgttggggatggaggatgtatgagggttgcggctgctaggaacagaaacattactgacatctattggagtgataagggataaaaatgatccaacaaaggcactgggaaccctcttgtcaccccatcgctcgtctgagttgtgactcttcatgtgccaaccaagtgcttgtccactgctgaacatcgttccacacttgcggcactcatatggccctctcctgctctgcctggcactgctgaccaatgagcgggttgcctccttggcaacggagacatctatggtgtgctgcactcccttgcccatagtcatctcattattcttgtgtgcagtcagatgaccaccaatctgcaaaggacagtcgaacatctatgaaccaacaactttataagcaattttctttaaaatttagttgcatttaaagacatatgggtgccctaagaaatttacctcagaaatgttgggtggggggacagtgatggtggcctgcttgtggaggccaacgatgaggtccccagtagccagctgcatgttgccatacgcctcgctgtgagcccgcttcgacggctccggtaactgttccaggcatcgggtggggttcctactgctgtggttgccagtggaggtccagctgggcatcagcacagccatagtgagatcacccacttccccatgatccttcttggcaattttcttagttgagatctctcttgctgtcccctttgctgccatggttgccaaacatggctggaagggccgctccccgtatccatgcagctgccgttctcgcaccacaattcctgaggctgagatccgctcttcggacaacattgccatagaagcagaggatgctggaggtggctgcatgtgatcgccagcttcatcttcacatcggccaccatcaatcacttccccatgagcttgtgcagccgccaacctccagatccacccgcctatcggcactgaaagggcagaggagaagcccaattccgatggatgttgcctgctgcttccatccacatgcccatggccatcttccacaccccaacgaggaagtgaaggcggcaacatcgagccacggcgccaaagtgcagtgcccccatggcggcggtcacctatgatcatgtggcgcttgcctccctcagcttggatgcgtggtggttggcgggggatgtggaagcgatagctcccaacagggcgctccgactccgatgaggagatccgggaaggggccatgggcgccgccgatgaggaggggattgattctggtaagagatagggtttctctggctaaaggatttacctgtggatactgcttgtgcgctggtactaaataagcggggggagggagggaggggggatggacacttgggcaggcagagtggtaaatcttgacattaaataagttatcatcaattgaccttatgaggaaggtattttactgcttcctattttgtataactgcacacatttggtcttggtccatggagaatgttgggtctcaacccttgttggcccaacatatgttgtgctgtattcga

SEQ ID NO: 62095 - DNA, 7660 bp, Oryza sativa
ttaaacatatcgagaaatcaaatcgcaaacaaagaatgcaccatttcgtcataaaagaaatatatgatgcctagataaattagcttgtacttaaaaaatgaaaattgacatttcttctaacattttggtccaatcaaggataaatcaagaagagaaaggagctccctgtaccaaaagtactacctaaccaaaagtagcataatgagaatatatgatgcctagataaatcagtatgtaattaaaaattgaaaattcatattcttctaacattttcgtccaatcgaagataaatcaagaagagaaaggagctccctgtactaaggcccagtttatttcagcttaagattattgcaatctaaattattaaatcagattactctaagctagattataataagctgacatagaataagctgcgagctatttgtttctttggattattggaggcatctaagggtagtgggtctttagccacccaataatctgaaaaaagctcctccaaagaagattattatattatagtaatctggcttatatattataataatctatcataataatctacttgtttgtttcagcttactcctaataattcagattataataatcctaagctaaatcaaacagcgcctaaaagtagtacctaaccagaattagcataatgggatggttttaatgtttcacaaaatgagacctggtaatatgcacatgagtagtatatttttcccaaaaggcagaaccagacctggtcgtcgataatcaaaaaaaaatattccttcattggattgactggcacatacaaatagaaaggttaggccctgagatttagtagcattgaattgttgatcctagaaagcaatggggaaaaataggtacaaaagggtcaggttgacatggagttgatgccatggtgcccaattatgcatgttcaagttttgaacaggagatctagttttgccaaatcaattttaaacctaataacaaaatacagccatgtcatatcggataacctccatacagtaattttcattacacaaaaattaaacttgtcccttattttttttaaacaggaattggaaattgatcccatccagacaattgaacggagggagtagtaattagtatcaaaccagcatcccgagcctagtaacattgttcactgtcttatcgcatagaaataaatggcatggttccgatagtccattgttcacaatttcatggcacaaaaagaagctaattcaaactaacatatatgccactgtaaacgagttccatcgtctgcacactcatagttcaattttataataaacatgaccaaaaatggtatagccaggtgaatacattctccaacttgaagcacataatataaatttctcacatataatcagttgaatgcggctacaacttcatcttaagatcagacgtaatattggtgctccatcttagggttacctacaagcgtaatatttgtgctccatcttagggttttttttgtaacaatagaagaaaagacaacagttcatacatgattttgctgttttttttttacttaatacatgattttgctgtttacgattatgatttgcaaagcccagcaagcatgcataatgcatttgctatgaatcaaaacaaaccaaaactgaactaatacaatgtactatgtcacaatgagatgagttttgtccaggttcaatctcagaatatatgtgaaaaaaaatgagaaattttttttttgacttaaccttgtttgtaggggagggggctcggaggatggagagcatgatgtaggccggcgtctttaggatcagatgactctgtgcactgtagggtatgtctgtgttatagacggtgacgtgtacagagaagataggcctattcactgtgcattcccacacaatcgctgggacacgatcacctccacaccgtcggtttcgcctccatgcccctactgtaaagaggaaatatgaacagttgatctcatcttgcttatggcacataacaagtaataaataaaaatatttccagattcaagcatattgctggttcaaaactatattgggggatatgcatcatttatactccaaataaagccagcacaaaatcttaatacaggaaatatatgatcaaacccaagagtaaaaatgcaccatttctaattcggatgaatgacaatcaagtccattgcatctacatataatgaggcatgttctgtacactcggtcatcaattttattcagaaaatgacgatctatctcacaagtatatggactcgattattacataaatgctacacataattttcactgtaaattgattgattagacaagtacttaatcatgcatgggtggtacagtggcaaatagggaaacaaatcaataataatataattttgacccatattcctataaactattcaattctgatatatataaggccttacttgattcggcggcaattccagccaagcaatttgatgtcaaattgagcagtgaactgaaatctgtgtattggttgtagctggaaacattttaacttgtaatgatcgtttctcaaaactatctcttctcacaaacatagatgaagtgaaaaattgagcactacataaatctttataagaatttgtatgcaagaaaagactcccatattgaaacacagttgtaaatatgagtaggttccaagaagttgagtagctatacaagaaatcatggtaatagaaaaaaaccgaggaattgtaggaatccttactttcctcccatatcacagaaataagcactcaccttcagtagcatacaaaaggaaccaagggaatgatcaaacaccactatttttcattgggatttaccaaacccatgcactaaatggccaatgccatgaacctgttgccataattggaggtaaaaatatgagtagtaactgcactatatgcagtttagtaggaaacatggtagcatatacacattctcaagtgtaacagcaacatatactcctgtataaaaattcagcatactttaggttccacgtgtagtattcatttgaaaagggaacttcatggcattaatacaacataatcttttgatctaagcacaattcagaagcaagaaaactgaatgactgttatggagagtgtcaagttcgtcttgtccggttaaatatcttaactatagagtcttcagaaagagtgacaacaggaaggtgattccccatcttagtaagcagcaagaatctttaggcagaacagtcaaccatgaagctacattttttatagaacttctactctcaacagaaatacaaaaccattatgtttgatcagattgtttgcgcaatctgcaaagtaggctactggtagcataaatggcagcccttaacagttattaagcccatccatacatcaagtttaggtataaggtcacttgaaatagatccataccataatgcagatgtttgccagtcaggaaattgctgcatctttgtccagatgtctatgactggatggttcaattctttagcaactgtcaggcatgcctgtgcataagtgccagcagcctcattggttctttcaggtagttttgaagggtcatcttctccatacatgtccctgcaaggaaagacagggacagtcagtaaggttcgcaaatcctctttacaaaaaaaaaagggaacattgtttaatttgtaacttgaaaaaagaatcttcagatcaagctaagggccaccaagtggtgggtgactggatatatacccgataaaccaaatatgaaataatcccataatgtagaatacacatagttttacatgagaaatacagacaacatgatggtcaaattgcataccctgtactgtactggtgcattatgaactcggttttaaattcttgagcaaagtaatttttatcggagtaattcaataaacagagagcacaagcaatttcctagctgacccctttattgtcgtctgttcatgacaattagcaggaattaatgccatggatgaaataaacagaggatggcaaatacaccgtgatgccattaacagggaaatgcaacaagaatgccatatagcaacataaaaccgattaaaaccatcttgttgttattccttccatccttaccggattctcaccggttcataaattggtggaggcgtgatgagtataattttagtggagggccattgctcctgcgaaagatcgaaaccaaaacagagttaaagcaaccataaagcagcagcatcaattagttcaagttggggaaaaccaatcgatttcaatccaagcagaaccttgaagtaggcgcagatggcgcggaggttgctctggtactcgtcgagcggcacgtgctggtgcacctgcatctgggcgctgtggagcgatgtgcgaaggaaggcgtgcgacgatcgcgtacgtgatttttctgccagtgatcccgcgtgcgtgttctgtcgttggatgcgatgcgatggatgattttcagtcgttagatttgaggaatgaagtatgaaagacgtaggactgtgttggtgaattatatggtagaaaattgggaagcacttagattgtctttccaaccatatatattaaattagactatttatatataaaaaataaaaaataggagatgtttccttcgtccgtcaaaacaaaataaatagtgaaaaaaataaaagaaagttcgactcccgtcaaaacaaaataaatagcgaaaaaaataaaaaaaagtccgactccctctcagaaacgaaagaaaaagtccgactttatatccgatccccccttaaaaacggaaaataaaacacaccacacctctcggtctcggtttgagtcgagatctcaggcacactcctctcggtttcaatctataccgtgatatcccatacatcttggtgaaaaaaattgatgtgccggattgaagatctgtttgcaaaaacggaacctaccggtcgagagcattccatttttatatgattttaatttttgggtttgtacttttctatttgagtccctgtaatttttatatttacatttgagtccctataatcttgcaataagatacttgaggtcgtttttttgaaaaaataataaaagggagagaacgagggcataaaggtgcataaaaaaaaagaaaaactgcaaaaaaggaaaaaaagggaaaaaaagaaaacaacaacaataaaattttgtttccactaagtggcgaaaaaagcagtagatccaattcctataaaaggcaaaaaaaagtggtgaaaaataaaggctagatccgattcctttaaaaagggaaaaataaagtctgattcctataaagacgaaaaaaatctgaaaaaacatctaaaaaagtttgtccgattccctaagaaagtggctaaaaaaatggttcgtgaaaaaataaaaagctggttcgtacaaaataaaaaatgcacgcgagaaaaaaatggaaagggcgaaacaaattccgatttctaatcagtgtatatctcttctctatctctaatctaatctaactatttaaaaagagaaaatgcacgagaaaaataaaaacggttcaaaaaaatgcgtgagaaaaaagcgcaaaaaaatgctaaaatggttttccattttccataaaaaaaacatgcgagaaatattatttccatcgtcggtaatttttttaaaaaaaacatgcaagaaaaaaactgtaagaaaaaatgcgccatttctaaaaaatgatttgaaaaaaccgcgcaagaaaaaaacaccgtctattaaaaaacaaatcgctctgaaaaaactgtcagaaaaaaacactaaattgatggatgcttgagtcggataggatacatcgatttttttaccatctattacacggcttttatttcgtcatatattcccctgtattggaaaaaaagcaaaaaaagaacattaaaaaaagtgcaaaaaacgtgtgagaaaagaaaagcaaaaaagggagaaaaatatggttttcgttgtcagtaaaaaaaatcaaaaaaaacatgctacgaagaaactgttagaaagaaatgcgccatttctaaaaaatggtttgagaaaatcgcacaagaaaattatacaccgtttaaaaaaaacaagctgctcattaaaatacaaacattatcattgacatgattatgcatgaaaaacgtatattattattagaatttattcaccagttcagttttggtccctccagttgtcccatatacttactaaaccaaggctgaaatcagttttaagccatttaaaattgctggggaattatgatcaattatttaatcacttagtagattatttttagataaatgagaccaacaaaatgtttatctagaaagtattaattatatgatattgtatttgaccaacgttaatatggttttatgtcaaaataattattatttccttaaatattaaattatttctagaattcgaacatatttcactaaagattttatttcgatactataaagtgtgtgtttctttcccattgcagatgcctttttacctttttttccttttgtagcactaaaaaaactgaaaacatactatagtagagtgcaacaaagcaacgaaacgtttaacctctcttactaaatcccgttgcaatgcacgggcatatttgctagtatattaaacatgaaggaagttgactggctaggttgcacatcccttggaagttggagcaaatgtttggagacagtgtactccaaaatcagcatgacgtaaacggtcgtcatcttcacgtaaccactttgatcttctagctcgtctcgatagatgcccatcaagtgttgtacatgtgtaaacctagtgttgttctcgtcaatattgaaatatgttttagctagaagcgagttcacctcttgttgtagtttctttgtacggctacgtgtgatcggtccttgaaatggtgtaacggattagctctcatcagtgattaagtcagatgattgtcttgagtgttcatgtgacgggtggtgggacacatcactacctagggcttatattcatcatctttgtctgctccctgccggcaaaatctatttgtgcttcttctaccactgctatcgtctacccgactggtttccaccgtttcttctctacccacacctagtccccaccatgatccccgagtcagaagttcctcaccgattgcttggtgtcctccccatctcatcttccgactgaatgcaaggagaagagcatggctgaaacaaataaataagatatcttgcatttaattgaggacgtttaggtggaggaaatatttcgaatgcacagaagatcctaaggttcatatattaatggatgactttgaatagataagcaatagttaggtacatattagtatttagtttctttataaaaattactgacgtacaagtttgtcagtcctacattacttttctctatcacaaacttgcatggcttacattgtagcaaaaaaagtagtggcatgtagaaacaaggaggttgaagcccggggaatttaatagccagtatataaaagagcaacacatgataccagtgtcccaagctggtacattatactagattagaacagcttgtttgtgactgggaaaaccgatagtgtcatttggtccatcaccagtacgatcaacaaacaccgatctacgtaggcgtcctactgctccacctgtgatttaaggattg

SEQ ID NO: 62096 - DNA, 5763 bp, Oryza sativa
tccctccggcgtacgccgtcccgccgcctcctagacgccaagcgccgccgcgccagcccacggccgcacgcaccgccctcggctgccatccccgccgcccttggctgtcaatccagtcgccgcctgactcactcgctgcggcgtcgtcgcccacagccgccgccttggccgccggccacctcctccttcccccaccaccatcgccgcctcctgctgcgtcggcagcgatgctgcacgccaccccaccgccgcgccaagtgaagagggaggacagggacgtgcgacggcggccggcgaaggtgggatcaggccggcgaaggtgggatcgatccggatgggggcgggagaaccggatagcgtgaggagggcgtttctctctcctgttttggcggatgtctatttttggaggatgttttggagcgtcagctggagcctctttttttgcttccataagccatttctcatatggagggttggataaagagctgctggggatgctctaagtacctgtgtaggtaaggactgatcacccgttacttgtgtaggtgacagtagtagttcagcagtgtccaaccatctgtgatgaaaaataaataaataaataagtaaataataataataataataataataataataataataataataataataataagcatcaaacactcatcatcaccgtccagcctcaagcaaagggtgaccagattaggcggcccatttggtcatgatcgccatctctagtaacaaagagcttaggtggccaccagaaccggatcatgccggctcaaactcgtcttctttaaatttttagaggcactaggagcaactccaataaaatggccaaataggtagccaagttaaattttagcaattctaagaaaaaatcgtgctccaagagactctccaactggatgcccaagccatccggctggctaaacctgagttcccgctagccaaatctagccagtcaagccggctggccatccgctcatccagtgggacccatgttctctctcactctctctccccctctctctctcctagtctcctggcacaagcacgagctcggccaagcagcagcggcatccaaaacttgggcgatgcagctagcgttgcattgcaatgcattgcagctcggtgttctttgctttgcttgccgcagccattttttggccgcttctatagcagcttccttgctttgcttgccctcccatgacatgtcctctccctgacttgtgttgggtaaatcgatcgatgggcgccgcggcggcggaagaggtggtggtggtgagggccccgccgccgtcatcggggaataggaggtccaccaccgcccgatgttgttggtgcaatgctcccgccatcgtcgccggagctcgaggaggattgtctgattatcaagattgagtcgtgcagccgggtcttcgcgttcgtggatggcgccgtcggggagtccggcgaggagagggacgcgaagacggaggcgctcgttgaggtgctcgctgcggtgaggatgagcgggaagaagcaggggctggagagagaggggatggggcggcggcagcagaggggagaggggagagaaggggaggaagaagaggaagaagaaaaagttgcagagagtgacatgtgggtcccattgtcatagactcagaatagagagtatgaatagagaggctgttggagtagacaacaagtttgacttgccaaattagatggagagttggccaaatagacatttggagagtcagatttgaagagactgttggagatgctcggccctatttgattcagcttaggattattataatctgaattattagaagtaagctgaaacaaactgatagcttattatgatagattattataatctataagctagattactataatctggtaaaccactctacaggtgtttttttaaattattgggtgactaacagctaacaaacaaataataatccagagaaacaaacagctaacagcttattctatatcggcttattataatccaacttttagtaatctagttttataatttagattataataatcttaagctgaaacaaacaggaccttaggcttcaatcctaggtcccgcacaaaaaatggtcagcctacttaacaccgtgaaagaaataaaaaatcactatcatcaacaatttttgtgaaaacttgcatcataccaggttttcttgattttttttcctctgttgtgctagtgctaaataaatttaacgacggaaagtgattaataattatttatagaaccatgattgtgaattaaattgttttatagaaccacgacagaaagtgcttctctaggagtgcttgctctcaaaatgtctcctgcttctcctgtgatacctgatctgtctcctagtagtattataaggcactgtggagattatggtaccatatacccacagggttacattacgtgactggtaattcatagtaaaagataaggattcgggtattgtattatcttgtatgtcaaggaaatatcccataatcctagtcggttacgattgtaaagtatctataggggacttagaccgtaagggataaggtttttatcttataatcccgagtcgggggtgtaacaacctgaaaatttaactaatagtttaacatgtcaaatgctgtgtttctaataacattataggagtttctataactttcataaaaaaaatcttgagatgattcttatgtttaaaatggttttgccagactttcatttgggatgatatgaatctttagctactattatagggaaaacatttcttttccagaaaacaaatgaccctataatcttggtggcgaaatctataagttgctacgttaatgaagtcttatctttttttcagagagtgcattagcgctaataaaatctaccaacacattttaggagtagcttgactaatttaagttttcacttgcacgaggggaacaatgatataagagatcaagctgactcgataccagattgtcggtgatatgggcccgagggtaccccttaaggagggcgaaggccacccccagcccacgtggtgccccccgagggtgtcggtccctggggtggagcagcggctgcctcccacgtcaggggtcaggccgtcctgaggccctctatgctttgtttcgcgtgtgcgccctgggcgggcgctcccagcacccaaccaccacatttaatgaacaccgcatttaatgcggcgggcatgcgcactgacagaccatttgcagccggaatgacggatgtgacggcgtgcaggcctaggacagggcgccgtgcgcatgcgcctcctactagcagagggcatggcctatgcctgccccatcccgtcaccattaatgagcggctttctgcctctcatttggactcagaccagctttttccatgctggtctgtttgagagatccctaccccttggtggggccggacggccagtagtcgtcgacagttaaaaaggaatgacatgggtattcgcccgtgtcggccggcgtgatgggatggagcccatgccgtggtaaggcgcgcgtggcttcccatgtcgggaggacaaacacacattaattacctgtaaagaatgttgtcctttcccttgaagttaggtcttgggcctttgtggtaaccccttaagatataaaaggagaccaatgcctgcaagaaagggggatcgaaacctagagaaagaaagcacttgtattctcccaccagaatcaaccacgcacatgagtccctggtccgaacatgtataaaccgcatacatctccatcactcccgaggggcccgacgccctccgcatgtctttcccatcaactctcaaaccttcacccgtgtccctggtccgaaccagaaagggggtcccacaatccccagcttgaagagtttaccctccgacacaaataatccacaaagctccaccatttttctcccttttagcttttaagccaagtcgaaacctctttgtatttaactttattgaatgaccaatcggtaattttgtaacctcatagtctattcattaatttttcgcttattaaataatctacccgatcacacatagcttttggctagtagattgagtaactagtcactgtgtgcttgagtatatgttttgagtgaagtccaatttattggcttgaatgattttctttgttttgctgattggtacatgttaaatgaacatagagacgctgtaacaaatctaagcaacataaaattccttgaaggtcctcatgtcaattagacaacctaagatgacaactatgaaggtttcatcattttatcaccctttttactacctcaagtatatcggtcaagtataatcatacttaattaattagaaatctaatcggcaaaatgaagcaacttctaaatgtgcttaaagttgaacatgagggtataggttttataatttattaaaatactagattatttatcacaagttaatatatattttttagaatttttacacttagttttgacctccttaaaagtcaatttagttctcagcataccccttttcacctttttgccagaaataaaaatatttctaattttagagtgaaactttgaaaaatggaaactaggaaactcaggatatctccacatcagagcacataattttagcatttttctaactagttcaaactatttaaccaagaaggagagaaagaaattcctgaaaaattaaccaaaacagatgttcactctgcttcctacccatcctcctaacccttgcctagtgtaccacgtcctgccccacatgtcaatgtcctaggctaactccaccctgggtgcacgcaaaatgtcacgtggcacccacgacaggcatgcatgccgacacgtatctcgtgtggtggcaccgttcttcgcttcctctttgactccagctctccaagctgctccctctctactcacacttcaccccagagccaagaaatcaaagtgggagagtttccccttgctctcctcgccttcatcttcttgctggccgtcgggatgactccataactgccgcccaatgggtcatcgtcatcgccatttttctttcgttcccgactcaccgcagcacgccatagcctctgctctgatttcgccccgtttcttgcagccgatccccaggaacaccgacctcgccacgggagctctggagcgtggccacaccgtcgtcaaagcgcagccgtgggatcatgtcgccattcccgtcgccttaagctgaatccggctgagttgctgcgccactgattttgcctcatcgtcttctacaaaatgccccaagaatctcacggatctatgcagcgaggagggagatcgaccaccgccttctccgactccgacctagcccccccgtcgtcgattcctgttcaagcggtgagccatttgtcgattgtttgcagtagtaccaaccttaggtggtgttctatgtcataatcacgccggagagacgatgtaaaccacgtcgccgatgagatcacggccaacacacacacaaaaaaaaaactcatgcgaacagaggaacacggtcttgtttggtgctgctgaattgacagcttttccagactattccattgcttaaaataagctattacaaggaaagcaaccatagcctccaattaggccaaaacaagcagacatgcacaactaaccatatagagctactactaatcagcacacaaggattattcttaacaatctcctcctaagacttgctgtgctcattactgatgttgatcaggccgatctttgaa

SEQ ID NO: 62097 - DNA, 8677 bp, Oryza sativa
tgagagggcaagtccaacccctatataagggacaaggccggttcattgtaaagatcaatctacaatcaatcaatcgaatcgttcttttcatattgctttcagttttctcttagtttgtccatctttgtcggtttgcgccgtaaaccgtacgccaccgctgcgagtgtgcgacacctctttgtaggtttgtcctgaaaaccttccgttttgcccacgagacgggtagttatctagaaatcagctccgctagccggtttagttatcaaaacccatctaggtttagctctttgctagatcgaggtggctggcgactctaggatcaccgcaagacttaaggtgatacgatcgtgcttgtcaacttgtcaaaaaagttgccaacacgatttttggcgactccgctggggaggagatccgttcatcgtcaactcaacttcgacttcgccatgacgaagccgccatccaagacggaggtggagccatctaatgtgatgctggtcacattggatggcttcgaaggagaagatcgtaaagctatggaggagtacatcaacgagctcacatgggaggcgttgatgagagcaactactaggactcgtcaaggcgtgatcatcaagcccgggccacatcccaagcttgctcccgacgtggtaagtaatgacgaggtatcacaatctatccaacaacaaattgcatctacaatagattcatctatggctaattttaaagatcgattaaatgtaatgtttaaggataaagttgatgggtttttaaggagtaggctcggttcttttatggatgattacacattaaaagataaagcctataccactgctgatcaacctcctataggtcaaacgggtagtaaaaccgacggaacggcgttcacggccggtccgaccgggcctgacagtcggtcagaccgcgacacaaccgtcggtccgaccggccaaatgaccggtcaaaccgggtattatcccatcggtccgaccggccagatggccggtcagaccgggtattatcccaccggtcagaccggccctcaggccggtccgaccgcgcaacatgacgccggtcagaccgggccctgggccaatcagaccagtgcaatcgtcccgatacagggaattgatccaatgattaatgctagttatttgtatcactttagaacatttgatcctcctgtatctactgccaccactagtcctcaaattcccccacatattcctaacatttataatgatgtttctaggggatatcctcccgatactaggcaaggccaatataatcatattgcgccacaaacgcaacctattaggccaccaaacccaccaccaaatccacaagggcctaataacatggaggatatgattagtgatattatgaggaatagattcgggatcgaaactaggaatcgtgctagagcttacaaaaagccatatccccattattatgacaatgtgctgtttcctagaaattatagagttcccgaatttgccaagtttagtggtgaggatggtaagaccacatgggaacatgtaggtcaatttttagcgcaatgtggtgaggctaatagtgatacttttaaattgcgcttgttttatttatctttatccggtaatgcttttacatggtttacttctttactggcaaattctattcatacttgggctcaattagaagaacaatttcatgattatttctatactggagaaactgagcttaggttatgtgatttaacatcggttaagcaaaagtataatgaatctgttgttgattatattaagagatttagagatgttacaaaccgatgttatactttgaatataactgatagagatttggccggacttgcttttaatggtttagttgctcctcttagagaaaaactagatggccaacaatttcttgatgttagtcaactcatgcaaagggctctggctcaagaaagccgggttaaggataataaaaaatttgatagaccattcgacaaaaagcctaatgtcaatatagttgattactctgatgctagtgatagtgaggaggagggtgatcatgatatttatgttgccgagtggtcatggactaacaaaaataaaccttttgtttggtctaacctaatgccaactctcgcaaagatcggcagagtgagggtaaatatagttttgatgtggccaagtgtgataaaatttttgattatcttttgcaagagaaataaacctatctctgtaaagccggctagtgtagcacggctaagccatataagtttgtataatgagtaaagaggctagtttagagttgttacaaaagagggtgcaagaatatcggtctacaaagaacaatattggagaaaccgttgaagattttgatgaagtagagaagcttggacaagggtttacatcggccgatccattagaagaagtagatataggtgatggaactaaaccaaggccgacttttgtaaacaaaaacatgaaagccgattataaggttaaggtaatcgagctacttaaagagtatgttgattgctttgcgtgggagtaccatgagatgccgggtcttagccgtgagcttgttgagcatcggcttccaattaaaccgggttttaggccttataaacaaccacctcgtcattttaaccctttactatatgaccgagtcaaagaggaaattgatcggttgttgaaagcggggtttattaggccatgtcgttatgcggagtgggtttctagcatagtcccggtggagaagaaggggagtggtaagattagagtttgcatagattttagagatttaaataaagccactcctaaagatgagtatcctatgcctatagccgacatgatgattaatgatgcctcgggtcataaggtgattagctttttagatggtaatgccggctacaatcaaatctttatgacggaagaggatatgtacaagacggcttttaggtgcccgaggtttgttggtttatttgagtgggttgtcatgacctttggtttgaagaatgccggtgcaacgtatcaaagggcaatgaatttgatcttccatgatttgctaggtattatcttagagatctacattgatgatattgttgtcaaatcggatgatatggaaggacatatagctgatttgagattagcttttgagaggatgcgccggtatggtttgaagatgaacccacttaaatgtgcttttggtgtgtcagcggggaagttcttaggattcatggtgcatgagagaggagttgagattgatcctaagaagatagaaaaaattcgtgatttcaaagcgccgacatgcaagaggttcaaaagttgctaggtaaagtgaattattcgaggaggtttatttctaacctagcgggtaaaatcgatgcttttgttcctatacttcgcttaaaaaaagaagccgattttacttggggggcaaaacaacaagaggcgttagaagagttgaagaggtatttatctactccacccgttgtgcgagcgcctaaagccggaaagccttttcggttatatattgcctccgaagacaaagtcattggtgccgttttgacgcaagaggaagatggcaaggaatatatcattacatatttgagccgccgtcttttggatgccgaaacgaggtatgtttttatagagagactttgtctatgcttatactatgcttgtaccaaattgaggcattatttgttatctagtacatgcatagttacttgtcaagccgatgttattaaacacatgttgcaaaggccaattctaagtgggagaattggcaagtgggcatatgctttgatagaatatgatttgacttatgaaccattgaaaactataaaaggccaaattgtatgtgattttatagtagaccatcatatagatgttgcttatgagggagaggtttgcttagttgaagtcataccatggaagatttattttgatggttcttcttgcaaagaaggtcaaggcataggggtagttttgttttcgcctaatggcatgtgttatgaggcatcggttcgtttggaatattattgcacaaataatcaagccgaatacaatgctttattgttcggcttacaagttatggagatggttggagctaaatatgtggaggcctttggtgattcggaattggtggtgcaacaagtcgccgggatctacaaatgcttggatggatcactaaataggtacctcgattcatgtttagatattattgccaattttgataattttgctattagacatattgctaggcgtgataattctagagcaaatgacttggcatagcaagcatctggatataatgtgaagaagggattatttatgatattagaagagccggtgcttgattttaaatctttgtgcgaaattggcaaaattggagaccaggggcggtctgaccggcattgcacggccggtctgaccggtgaccaggggcggtctgaccggccgcatgccgtcggtctgaccggcgaccccgagcagtctgaccggctctgtgtggccggtctgaccggtattgagcagagcgctggggggcacgcttcaatcgatttggaggccgaattatgtgagaattcggacatttgtgcccaggatatagaagaggattggagaattcctttgattcaatatctaaaagatcccacacttaaggttgatcggaaaattcggcggcaagcattcaaatatacattgcttgatggagatttgtatcgccgaaacatagatggtgtcttgttgaagtgcttagatgaagatcaatctaaagtggctatgggagaggtgcatgaaggaatttgtggaactcatcaatcggcccacaagatgaattggttgcttagaagagcggggttctattggccgaggatgattgatgattgcttcaaatattataggggatgcgaggcttgtcaacggttcggcaatgttcaattggcgcccgccgccgtgttgaaccctataatcgaaccatggccgttccgaggatgagctttgaatttcatcggtcaaatttatccttcgtcatcaaaagggcataggttcgtgctagttgctacggattacttcaccaagtgggccgaagccgtgcctttgaagaatatgactcatacggaggtaattgactttattttgaagcatattgttcatagattcggtattccgcaaacgttaactacagatcaaggtgcttcttttatgtctaaggaagtgaagagttttaccaaatcttatggtattaaattgttgagttcttttccttactacgctcaggctaatggacaagccgagtcgagtaataaaacattgttaaagctagtaaaaaagaagattgaggaacacccgaagaggtggcataaagtgctttctgaagcattgtgggcacatagaatatctaaatatggttccactaaagaaactccttttgagttggtttatggtcaagaagccgttttaccggtggaggtaaatcttggctctcttcgttatatcaagcaagatgatttgtcaagtgaagattacaagacgttgatgggagacaaccttgatgaagtcatcgacaagcgcttggaggcattggaagagacagagaaagagaagaagagggtggccaaggcatacaacaagagggtgaaagcaaaattgtttcaagttggagacttggtttggaagacaattttgcctttgggtactcgatccaaggagttcggtaagtggtctcctagttgggagggtccttatcgagtgtgcagcattgttcgagggaacgcatactttttagagacacttcaaggggagcattttcagcgagcaatcaacgggaaatacttgaagaaatacttcccgagcgtttggcaagccgcttaagaggtactatggctggtaattggattatcgtcctaagagcaaaaacatgctctatgcttttagattcacgttgttcatcaaaaaggcaggggggcatgtgtttacacccaaatttagcacctaggattaaaataggaaagattgccaaaatttggaaatctaccggtttcctccgagtaggccggtctgaccgccatgtgttgggtggtcagaccgccggttgtaagccggtcataccgacggtgtgtggccggtctgaccggcgggtccgagtccgaccctatttcgtcgggtctcgaggtttccttgctcgggaaggcatgtttagggtttcctttggtttctaccccgagttggacgtggaggagggcctgtagagggcaagaccaacccctatataagtgacaaggccgggttcattgtaaagatcaatctacaatcaatcaatcgaatcgttcttttcatattacttttagttttctcttagtttgtccatctttgtcggtttgcgccgtaaaccgtccgccgccgctgcgaaagtgcgacacctctttgtaggtttgtcttgaaaaccttccgttttgcccacgagacgggtagttatctagaaatcggctccgctagccggtttagttattaaaacccatctaggtttagctctttgctagatcgaggtggttgacgactctaggatcaccgcaagacttaaggtgctacgatcgtgcttgtcaacttatcaaaaaagttgccaacaagtatatgattgcgacatttgtacggtgacaacaaaatgcttaagcgattgaagtgctcaaaaatctcgtttcaaaaaaaaaatgctcaacaaacacctaccatatctgcctaattcaaaatttccctacatatctaaatcttaatttgaatattcaattttacccatgatagaaaactaaatttaaagcggggtttggatcctgggactaaattgtcacatcgggtgtttggatattaattagaagtattaaatatagactaataataaaactaattgcataaatgaaagctaattcgtgagataatttttaagcctaattaatacataattagcacatgtttactgtagcattaatccataatagattcgtcttgtgaattagtacatggttatggaataggttttataattagcctatatctaatacttttagttagtgtctaaatatctgatgtgacagggatcttaattttagtccctgatccaaactgggcataaatcctgttcaaatgaaatccactcaaatttcaaattccattcgaattcagattctaaaaaccaacctactactctctcctctacaactaccaaagaggcaaagcgaaaggctcaagaaagcggagtccacccatccatctcctccaaccccaagatccccacccaaatccacctccggcggcggcggcgatggccggcggcgagtacaccccggccgacgctgaggcggacctcctcctcccgccgccggcggggtcggagccggacgagccggcggcgcggccggcgccggcggacacgctgggcgtcgcctacgccatcttcttcaccctcggcaccggcttcctcctcccgtggaacgcctacatcaccgccgtcgactacttctcctacctctacccgggcgcccccgtcgaccgcgtcttctccgtctcctacatgctcgcctgcttcctcccgctcgtcctcatcgtgctctgcttcccgaaatccagcgccccggcgaggatcaacaccgggatgtcgctcttcacggtggcgctcctcgtcgtccccgtcatggacgccgtctacgtcaggggggtccccgggctgtacggcgcgttcgacgtcaccgttgctgctacggtgctttgcggcgtcgccgacgcgctcgtgcagggtggggtcatcgggttcgccggcgagctccccgcgcggtacatgcaggctgtcgtcgctggaactgcaacatcaggtagtgctccgatttcttggatttggatagttctcctgaaatttttaacacatcatgttcacaaatcagtcattcggttcggttgacatttagagctgtcgaatgaattcatggcgattttaattttctgagcagaatccagtgaaagtggtcaattgtcttggtccagttgagttctctgatggttggattgttaccccttaaacttgttaacacgtccgttcacaaatcagtctctccgtttgacatttagacctgtcaaattcatggcggttttctgaaaattttctctggtactaatttagtcaaaatggtcagttgtcggttgtcaattggacaattgcaaatgtgtgagctgagaaattcgatcaggattatccattgtgccagtctattgttatgcataaacaaggtgatttgaagttagtgatcaagaaacaactactggccatctctttaaatccatcaaattaaagttagagtgacacgccaatggagtacttgcaaactttacacattcaagtgaagaaattgcaaatgcaggcatttcgagaaccaaaaggcaatgtggaaacataccagcaccttaccaatccgcgtacttgttgcaattcagattggtttgacaattgttgcaatacactgtaacattgtttcttatattgaattttgcaggtgtacttgtctcagtattgagggtaattaccaaaggagtatacccgcaagatgccaatgggttaaggaaaagcgcaatcctatacttcgttgttagcattgttgtcatgatcatctgcatagtgtgctacaatgtggcga

SEQ ID NO: 62098 - DNA, 1477 bp, Oryza sativa
agatttattgtagtagaaaaaagtctcatccaataatagattgtttttttagaatgaagggagtatagatgtgatatcattgttataggatatatcacatctatacaaaattgcgctcctacttatattgggatggatgtactccctacattcagctagaactggatatatgggtctcacatattctattcttgtaaatctggacacgtatagcaacttgtactgaatatgaatatctagtcttacgagtctcaggttgctatctcttggatggaaagagcagtactttctatgtttcatattttaggacattttggcttttttctaattaattttgttttaagtttagtcaagtttataatataaatatagcgatgtttttaacaaaaataaaatatattatcaaaacatatttaatattaattaaactaattttgtgttatatatgttgccaactttttatataaatttggttaaaactttttaaaaaattgaatatggaaaagtcaaagtgacaatagagtgaggtactccacaataaacgtgtggtaccatttccattatcaaatatcagtgagtacaatttatctctccaattcagttaaaagtaacctctagcacattactagttttttaggtgttctttagtcatgacacatctttgtgatgtctatagtaaattacataaaatttaagtgttttatagcaaatttgctagttgcatggatatatgtaattcatttaattatatataggccttgtttagttcgcgaaaagaaaattttttggtgtcatatcggatgtttgaccggatgttggaaggggttttcggacatgaatgaaaaaactaattttataactcacctggaaaccgcgagacgaatttattaagcctaattaatccgtcattaccatatataggttactgtagcacttatagctaatcatggactaattagactcaaaagattcgcctcgcgattttccctctaactgtgtaattagtcttttattttatctatatttaatgctccatgcatctgtccaaagattcggtgtgatgtttttaggaaaaaaatttggagaactaaacaaggccatagttgtaaagaggtgttttcaacagagtagttaggctgtgtttagttccacgctaaaattaaaagtttgaagaaattggaacgatatgatggaaaagttagaagtttgtgtgtagacaagttcaatgtgatgaaaaagttaaaagtttgaaaagaaaagttagaatctaaacatggccttagcaaactggtccgtttggatttttcttttcctcgtacagtctgcattctcactcgtcaacgtttcggtcagaccaacccaccaatgttaggccacagttcgcatgctactagctgtctagctgacacgaatggaggctaacgaacacggagtaataagtttacatgaccttctagggagttttgccgcccccccc

SEQ ID NO: 62099 - DNA, 1223 bp, Oryza sativa
tcctcctcttccggatgtacagcgcggcgaacagcccgagcaccacggcgacggcgcaggatgacacgccgacgaccaccccgagcttccatccgggcagggccgccttcttcttggtggcgccctcgtcggggagcatctcgacggtcatgttccacatgagcacgcagttgagctcgtacgtctcgccggtggacgccgagaagccgaagtagcccttgttgccgcggaggacggtggagaggtccagcggcgcgtcgagcaccggggtcgagggctttctggtgtcgttcttggccatgtacacccacacgtgccgcgacgtgccattgtagtcgacccagacgaagtagttgccgtcgtcagtggtggtgttgctgggcgcgagctggatgccgaatggggtgagggaggcggaggcgttggagcggacgccgttgatgtcgaggccgacgtggttgtcgtcgatgtcgtagggctgcttcacgctgtccagctccacggccgcgaacccgttggtggcgttgccgtcggtggaggcgttggtgagaccaaggaactcgccgtggctaccgaccggcggcccgcgggcgttgctggacgcgacgacgaacgcgagcccctcgcccttgaccgttttgttcaggttcgagcggaacaggttaaccttgaacacggtggagaacgaggcgacgtactttccatcggcggcagcggcggcggagttggacgacgacgacgacgacttggattcccagacgacgaacggggcggtgaagaaggcgtggccggcctggttgacgaggaatatctcgggcctgttgccgctgtccggggtgagctgcaacccgtcctgggcgatggtggcgttgcctgagaaggtcaggttgtcggggagctgcaacaggggcttgtcgaacttggggaaggagaatgtggtgaactccttgccgtcgacgttgctggtgaaggtggtggcctgcgcggtggcagatgggaggagcaagaaaacggacacgcaccacactagcatgagcacggccatggcggcacggcggagacggcgcagaagcaacatggagcagtggagttggcgatgcataagtaaagggagatggagttggtgatgtactgatgtacagtcaagggggtattcgcgggaaggaattggtccagtggttgtcgacttctcccacttgcggacttgccaatcgtgccacctg

SEQ ID NO: 62100 - DNA, 10126 bp, Oryza sativa
tgctttgctgttttacactaaaccgttgtaagtatgtagtactgtgtatatactgctgctggttcaattcatatggtaattaaggaagataattaggtttaatctaatgagacatggttgcatcagtcggtggagccgggtagccaccccccccccccccaaaaaaagtttccaactagtcttttttagctctttaacacgtttttaaaattgctaagtagtgtgtttcatgtaagagtctcactctcttatttatcgcgcacgctttctaaactactaaatgatgtattttttaaaaaaaattatatcaaaaagttgctgtagaaaatcatattaattcattttttaagtttttaggtaatacttaattaaccatatcttaatatgttgcctgttttatacgcagcgaagagattcgtaacccctaaaaaaacacatcctaatgaattaggtggtgtttagatctagggacttaactttagtctatatatttagacactaatttagattattaaatatagactacttataaaactaattacataaatgaaaactaattcacgagacaaattttttaagcctaattaatccataattagagaatgtttactgtagtatcacataggctaatcatggattaattagactcaatatattcttctcgcgaattagtccaagattatggatgggttttattaatagtctatgtttaatatttataattagtgtacaaacatccgatgtgataggaacttaaaagttttagtcccatctaaacagggtcttactccaatataatagaagggtagccctacccacttggttcaagaaggttggccccaggccatccgaccttgaacttgactgattgggatgtcatggcccacggtgggggaaaaaagtttgatcagcttttgcattcttcgaaattgttttttttttatattttttctctattgtttgagagttgagactagttcaagctaatgagccgagccacgctagagcgaaaatcaactttccttcaaaattaaattatttttatgttgaaagaaaaattacagatcaatcgtctagctgcacaagtgcacatcctagggcggtggaggcgtagagctcactgagaatagacgattcacaaaccatcccaatcttgaagtagtacttcctccgtttcatattataagtcattttatttttttaaaaaaattaaatgatgattaagtttgttgaaaaatataacaatatttttaatacaaaacaaatatattattaaaatatattcaatgttagaattagtggaactaatttggtgttttggatgttgctaaatttttctataaatttgatcaaacctaacaaaatttgatttgaaaaaattttttgaacgactcgcacaagacggtgcgaagttctattgatagagcaggaaaaaattacaagattacaacccaggagggttgtaaccaggaaaaaggaaaaaactataccaccacccacacgccgacatcgctaacacacaagcccaggagaaggctaacaccggaccggccgccgctaagcgtgaccgaccgccactagaccaacaaaggaacacagacgagaacgccccctagggaaatccacgtttgaggcaccgatgctccaccaccacacaagctttgccgacatgtgagacccctgcaccggcgtcccccgctggccagccttcgtgcgccgaagaccaccacacccaccggcagctcctcctcacacctaggtcgcctcctccaccgccgaccgcgcctttttgccccaagccagcctcctccaccggacgcgcctctcgagccgatccggcctccctccatcggctgcgcctctcgcgccaagccggcctcagctgccatcggctgcgcttctctgcaccaagccggtctccgacccctccaccaaacgatgccgcgccgaccagatgcagccgtctcccacgccctcggctagttgatttgaaaaaatgacgacttataatatggagatggactatctaagaaattaagaagcacagacagacaaacaggggcggagataaagatgggcaccttgggctttggccgtagacttgcctcaaaattgtactgaaatcttatcaaaatatactgaaaattgaagtgtctaggattaaatacattactctgccctaggggttgcaaatctctggctctgcccctgaggccctgaccggcaagatgttcatccccctcttttggctacttttcatctggtttgaattgtaccaatttttaatactcttttctttagtttaatcaaatggagaaaagttgctttattctttggtttcttttatatgctagatgtgcttcacctaattaaagctagttaattatcatgcataaccgcacagatggctccacttttttctctacactggcactaatactttgccctaaacaagcatcaatgattaatactggcatttgtgctcccagttgtacttaatcatacagatcaaaagccagcttagggtactctcctctctgaatcaaaactacatgttgagctgatttgagttgtcccaggtatatacctgctcaaatactctaaaataatgtataataatatgctgatacagctagctagcgaatccatgtcttgtgattagtagtaatgttttaaagatagtatcttaattttcaatcatcaggctgcttcatccatatatattgagcaagatatcaacacggctagccatcggttgtcactgagcagatgaaacaccccgtttcttgcatgaatattgaactaattcctgtgaaattctctgtttgcaaacagggcttgttattttcatggccaaggaacaagatcagctcatcaaggtatgtaccgtaacagagcaaagctacctgataatacattttaaaaacgcttacctagtaataataagcatcaaattgattttcatgtaatcttatgaagttactgttgacttgttcatgcagagagttgagctgaaggtgagtgtcaactgctgcgacggatgccggagcaaggtgctcaaagccctcaaccttaaaggtactaccttcgtttcagattacaagacgttttaactttgatcaaagtcaatatgcttcaattttaactaagtttatataataataataataatattttaaaccaaagacaaatttattatgaaaatatattcaattatcgatttaataaaactaatttggtattataaatattactatatttgtttataaacttagttaaatttaaagtagtttgattttaatcaaagttacaacgttttataagccgaaacggaggaagtatctatcaaatggcattaactgtcttctcggccattgatcttggctgccatggttgattcttgaagctttgtgtttttgacgctttaattgtgggtgatggcatgcatgcaggcgtgctgaggacggaggtccacccgacggccggcagggtggcggtcgtcggcgacgtggacgccggtcgcctcgtcaagaggctcgccaaggtcggcaagatcgccgaggtgatcgtcgtcgcgcagccgtcgccggaggtggagaggaggaggcgcgacgtcggcggcagcaagaaggaggcgtcgccggacaacgggaagatgggcggcggcacggcgccgaaacacggcggcgccgacgacgacaagcgcggcgagacgaatggcggcgcagggagcggggctagctcagctcgaatccatggcggtggcgacgacgacgtgaaggcggccatgtgctgctaccaccgggcggagccgccggccatggccgtgcccgtgctgcagccaccgtactatgcggcgaacttcacaatgccgccgccgcagccgccggcggcggcgtacggttttggtggctgctaccacgggactccttcgccggcgatggcgctgtgccgccgcggccgtattccggtggtccggccgcagccgacccggttcgccgacgagtgctgcatgtacggcgacgacgacatcgccggctgccacgtcatgtgaagatcaccagtgtgcatcgaattttttttttctttaatcttctttctggttctactaatggagaacactagcctaattttatttatttaattgttttttttatgaattttcagcaaaaactaaaagtcttaatgtataccatcgaaaaaagtaattagtgttacagatccagctcttagtctctcaaatactaatgtccagttttggtctggacgaggagctagtgcatcgaaactttttctttaattctttgtcgttcttctactaatggagaacactagcctaatttaattaatttattttttttatgtattttctgcccaaaataaagtatttctgtataccatcggaaaagtaattagttacaatacagatccagctctaaatctctcaaatactatgaacttaatcataattgttagacttgttttacaatatatcttaccatcttaataacctacagtgatcaaaaaaccctttcagaaggtactgaaactacaaagcaaagaaaggtgcaacagctcaataaccaaatcactttcgatagaggcatcagttttcatttggtgataatacagtaacttggaagtcttggaaacaaactttcgcatatgccacagaaacaatgtgatgacccatgtatttttaccaaattgatcataccaatagtccaatactggtaggatagagaaatacaaagatgtacatatgtgtaactagctgtctgatattatttgaaatagcttcaagttatgatcataagaacagacaactttgtgatctcacaagacagttccactgggaaattgttacatcaacctttacatatcacaggagataaaatgacattttaagatgaagcagcagtagcttcaacaggtgcaggctcagcatcccagaacgaggtcttcttgcccgtctttgaaacggtctgaagaacggcatctggtgtaacatttcccttgacagtgaccttctgctccttgatgtctacgtcaaaggactccactcctgaagcaaccacaagtccaactcagatgtttagatcgatgcgctaaatattgcagtgacacttacaagaatacatatgcaagtataaataatcatttgtgcttccatgatctaatgcagaatattggaagtcattagggctgattgcagaggttgggtttgaaagatagccttagcattattcaagcaactgccttggaccaaaatgtgccaaagatgaagcacatgtagttttcctttttaccaaccattctttcaatttgattaaaaattaattgaatttataaatagcatgcaggagagaaattcgaaattatatgtttgcccactatactctatagttgtggataatttcaaatagcaatcattaacaacagagctcaaaattttatttataataccagcaaaacaagcaaatacagctataaattctcatttgaatactaaagttgttgcctaacttgtttgcgtctgcactccggataccttaatttccttttgtctatggacattgccacttacacaagtggtgagtgtcatggtagtgacagaaaggtacataattgccaaagtatgagtccaaaatacaatcgaaagcaatattacaaaacaatatctttatgcctagaaatcagacgcaggtacaatttgaaactagaaattgcacaagatttcacccaatcaaaattatccagtgttcgtcaaaagcatacagttaagggaatttttaaagaggagataccaattgcagagatataccaggattggttcagattcagcattggcataagttaagtccaatgttgcattgcacgcgttacattgtaaaaattgctcgcaaaaaggaaaaagttctcaacaaacagaacgctgaggacagagctaaactaaccttgcatctttcccagtacccgcttaacagctccaacacaaccttcacaggacatcccaaccctgagcacaacagtctgcacaatagacaaaaatagcaaggatcagctaagtcctcattcgtcctcaatcacatcttcgcacacgccacatggtactcggaatacatcataattcccaatcaagatttactgtaaccgacaacaattaaatgaatttatgcttcattctggaagggaactagtaataatcagatggggacaatcatgctctatcattgaactcacagaccataaccaacaagatggctcatttaaggtaggtacaacaactatccaatcgggcctactccgcaatctgtactcgtttcaacaagaacgtacacaaatcaaaatcatcaagctagtttcgacccccaccatgaagttctaaaacttgtccatcagttggtgtttgaactactgaaactctgaaaggtataccgccctcctagcaagatttcgcccaaaacatcatccccaagtcataccctggcctgcaagcacgatgaaggaaagccaagacaagcacgcgcaagaacaagcaagctgatcgatcagcgcgccggccaatcatcagatcataatcagatccctaattaaccccacacgcaagctaaaagaacacgcttcttcccccatattcaaacaactcgacgccaaaaaaaaaaaagaggaatcctcctctcttggcctccccatctacccctatcgatcaaccctctcctctctctctctctctctctctctctctctctctctctctctctctctctcttctctctccaggaccgcaggaagggaccgcgcccctaacaccaaacgaataaacaaggagttctgtcgcggggccgtacctcagccatggcggtcgacgcggcggcgaggcgaggcggagaaggcggcgagcggtggtggggggaactccggtggcgtctcgtctccgggcgggttgggcgggggctaaataggtaaatagacggaggcaaggcggtggcgtcgttgaacgggcgagaggaaggtgagaggagaggtgacgacgtgctttgatttttttttctttttttcttttcgaacgtgggatgacctggtctgcgcgtatgacatgtggggccacgggtgacgtgtgggtaggtgatgaggaggaggaggaggaggggggctggttctagattttccttttctttactgtacggtgctgacttagccggtcaacgcgacgaacggctccggggacgtcgtgattcgtgccgtccgtcaccgcgttgcccgccccacgtcggcccgctgccgctccaaaatactccctccctccaccaaaacaagaaggatcaacccctccaaattgatgtgtccacgtgcatggtcctagccctaggagaggtcacatctgtgtttcctcctaggttgattcttcttggacagaggaagtaggcttgttgtcgaaatctaaacttaaaaacttaatttatagctaattttaatggtttttagtagctttttcaatattggtttttaagtcgctaaagtaaatatgtaaaaattttacttataaattattattttttcactaatacttctttcgtcccgaaaaaccgaatctagtactggatgtgacatatatctagatttgttgtactaggatgccggtgctagattggttttttatgggacagggggagtatgttgttatggttaaatagtcggttgtagggcaaccaataagaactcaaatggtgaatagtctggcaggaagagtagaaagtcctactccgtgtgatcctaacatatttagaattttagctaaaatttgattgtattttgtaagatggaaacaaccatatttatccctctcaaatatgttctaatttgtagcactcttaaatatattaaaattcgtagctagaattttttttcgaagaattagtttttactttctgcttccttgatatggctgccactatttttcaccccaccgcaattttggacagctagtaatttttaaaccatcgacaaaatgccaaacttcttgaacgataaagccaatgccaggtgccagcatgtgaaagtgaacggaggtagtactaacatataaatgattccttttacaactaattttaggcagaaaacatgaaccagtacgaaaagcacgagccgtgtcaacaacccgtgataaccaaccaggcaaagccagcctttgctctttgccatctatgcagttccagaatgatgaacaaacaattgcccaagttgcgaaaatgcaagcataattcaaatgaaatgagatttgacctctcatcagtagacaagagatgcaatgccatacaatcaactacaccatgacatgacaaaacggaatgtttcaagtatcacaggagatcagcttctgactgcataaatttctcaagtctaaatcaccattctagataaagggggagcattagaaattgtacagaacaagcaggactccctacaacggatacacattcatatatacgttgctgagtacaagaaggattgctagttccacattcagtcaatgaatgttgttctgttcatacatctctccatatttaggtgtattaaactcccgtttttgtcaaaactccaaccagtttacagaagtactcccaagtcctaccaccaaagtgttatgagctcctgtgagataacaattcacattgtcagataataatacagaaagaaaaatggtctgaacccttgtagaatcaaagacatatgcccaacatagttgatttatcacataacataaaccttcggatttgctatttcactggcagcttcaatttgacttggcattagcctctccagtttcatttttttttctctgaaggaataagccaggttatacacctagcccaaacatttaggtccatttgagcaaaataaaggtatgaaagaggcgagggaccaagcataattatatgcgccctggttatctagcgctttcaaaattgggggtggaattatgtggctaaagcttttttccttttctaacagaaaaattccagtgactaccatcccatcaggccatcacttctcaaccctagtcagctatctcatgaccaagtttctactgaaatggtattaagtctcttaggggactcgattcgattacagcaaaccagaacactaatccacaaataacaatagcatattgaacaatgcaccagtggtggtggagggtggtggctgttgtcaatagagatgattctggtggttttcacacgcttatttgccaaacaacagaattattatttaatacaaagcaagcaccgaggatcttaacatccactttaacaagttaacagtattccgaatacaagtgaagaagcttgattgattatccagtaaggaagcacttcaaaaggtaaaaccataaaagatcccccacataaacaatatcttaattaacaaaataaaatggattacgattgttgcaactaggttagcatttcagctcagtcaaatatttccttatactctatacagatcagcaagtgctcatggattgaatattacggtcttggactgtgtaggatatcaaatcaaaagaccaaaccgataacaataatgacagcaagtatggaattcttacccaccaaaagaagcagcaagcagatcggttatgcttagctcatcctaatccgccatgctggaatcaccaccatcaggagcatcaatttcatcttcgttcttcaggttcccacagacattgcactcaaacacatgggacggctcaccgtttggcaagggcggaagtggcgcaagcatgccatagcattcaccatggttacacagataccttacaaagaagtatgagtgcgggaaatcatcatcgctatcgctaccaccataccccttcttctgctccatcccatcatcaccaccttctccaccattaccatcctcttcctcctcttccgatggtgtcatcctcatcgccgccatcgctatcatcatcttgcttccacttgctctccacctgacaccgctcacactcgcatcggaacccatagtcctccagcaacctctgctgccgatccttgtactgccaattggccgcgaagtagctgaggcacacctccctcccctcggtgatgtcgtgaag

SEQ ID NO: 62101 - DNA, 777 bp, Oryza sativa
atgtagtttttgagtttgatgtgaccggttacctaaagtgtctggattagggaaattccttcgcatggacccttctgcgaagcctgctggataggcattatctttcgaggtagctctcatctggagtccggacctggaggtgcctttcactgctctggccggcaaatcctgcgtcagcaagctacaataaaaattgcaaatctgacgtatatgatcatgacgaatgattatccattttcctaaggccttgtttagttacaaattttttcttcaaacttccaacttttccatcacatcaaaactttcctacacacataaactttcaacgtttccatcacatcgttttaatttcaaccaaacttctaattttggcgtgaactaaacacacccttttctagcaagtatgctgggtaaccacaatagcactagcattgtcaagtctgtcacacactattttttacacctatttaccctgaagctgtgcattttactatccacttaacagttcgagtacacacatacgggaaggccaactgcacaggcatcaatacactacggcacatgggggcgtcaattgtatgagttcatgcatagctgttactatctctaagaaaatagtgccactcaaaccccgacaggcacggttcggccagtcagcgaaacgacttcttctagtaagtgaagcagattttagtagaggtaagttctaagtaaagtgactgcaaaccttggtacgagaacatgaatgtaccatagcccagaaattcagcaggtttt

SEQ ID NO: 62102 - DNA, 3528 bp, Oryza sativa
cgcacatccgatgttgtgtatgttcaatattgtgattcgggtaaaatcattggctcattgtgcatgtggcgcacatccgacgttgtcaattggagcgatcgttggctcataacaaggatcacacgtgtgaacgtacctagtaggctagtaccgtggctgcgccccttgctaagcttgcaagcactagtatcagcctgcaggcgagcagcatgcacaaccgtcgatgatgctccactaatatagtcagagagagaagtgcgcctcttacatgtgagagtgcgcttcttacatgtgggtctatggagagatcttctgacgttaaatcagagaggcatggtggctgatatatgggtccataaatgatgagtctcatatatcagtgaccatgtgcgcgctgtacactaatgtgagaggatttggtttcgtttaagcagagcacacaacctctgaatttcttcactgttactagttgcatgtttcctctgtttctcctctgcgggcataaggcataagcgagcatacaagatgtaaaaatgtatagcaagttttttgaactaaaagtgtgaatcgatgaacaaaccaagttgtactattattcagagaattcaggggagcgtctctgcatccctccgagataatatgatcaagtacacactatcctggacttggagaaacaactctacggactgaaatcacgaagtcccacggaagatggaacccttttatttggtgtttgacactgacactaaactgcacgaacgcacaacagcatacagctttagtaagtaacacgacataaactcgataaattaagcggatgacagacacggcaccggcactgcatgcagtactctttgttgctcatggcagagtgtaatctgtgaaagagaattgagaaggaatcgatcatgttagattgttagcgccaaccaactgaaaatgatgaaataatcatagattgttcgtggcaagagttgacagtttgacatgttgattaggctgtcttcttcccttttttttttcaactctattcctccttttcaaattattaaatgatgtgattttttataaaaactgttactattttttaagtttttttaattaatacttaattaccatgcgttaatgactaacaccgttttctttgctgctcccgatctcagcttacctccgcacttgtagccgacggggcggtcggcgatgttgcagcgcttggggatggtgatggcgacctcgggcttgatcccggcgttcctggtcgtgctggacagcatgacggcgcagaggcacttggggctctgcttcccgatggtgtgcaccgccgtgcagcacccgctcgacggcgtcgacttggggtccttggccgccgacgcgcacggcgccagcttcagcgccatcttgtccggcggcgtcgccccgcactcccctgcaccgtccgccgccgccgccgccaccaccaccagcgcgagcaccaccaccacgacacccctgatcaccgccatgtcgatctcgatcaatcgatcgctcacacacacacacgcacgcactgcgaataactagtaattaactaccccctgtgtcacgctgtcacgtagtttttcgttgatgggcttcatggctgctggtgctttatatatatacaggcgtagcaggtgaggtgacacccccatgatggtcggggagagtggtggagcgagcactatcgcctcaccggctcgcgtcggccaatggcgccgtgcaagctcggccacccgcgcgcgcggcgatcgaccgagaccgagcggagagatagctcgctcggtgcgcgcgctagtgggtgggtggttgtctcggcctctcgtcgacgcgcgccgcgtttgtgacgacctacctgatcaagttcgcatacgtgccgtgctctcaagtctcaacaacgcaagcatccaagcatggctgcatgagcctgagaaaaagcatcgtaagatggttcaatcaaatgttgttgcgcagcggtagagaaaaagagatctcgactagtttagcgagtactagttttgaacgtccactccttacttccactccttacttgcatactactcaaatagttataaaaagcttttaaaaaatatattaacatgtgatatatcactctacaaacatacaacttaaaatttaacttctgtatatgacaacaaaaaataaattaaacttacaagtagaaattaaatgttaagttacgtgtttatgaagtgatatatcacatattaatatatcttctagtttttattaatttatttgtaactatttaaatgatatgcaaacaacagaaaaacatccatacaagagttttggtggtgtgtcggtggtgttggtcatcatttcgttcatcggctaagcacttagtactaattataacctactaggattgtcaaaagcacaaatgtaaacgtgtaagtattctgatgactgatgagaaaaaagagtgtaggcgtgttaggtgtagccgtgtaagcgcgcccggccggcacctgtgcacagcaacggtgcattgccatttgccacaatcccaaattcgatgctccgttcataagggagtgtctctagaaggagagtgccctcaaaattgaaaaagaaattcagatcgacgcttcatcctggccgtgttgggcagtattattacaaacttaaaaattaaaaaatagagttggacgaagattaagatagtctacctaaaataaaaaagccattaacatataattaaaatagagttggatatagattaagttagcatacgtaaaatgaaaaagtcacatgattaattaagttttaattgttacaaacttaaaaataaatttatttgatattttaaaattatttttatataattttttgaaaaacatattgtttagcggtttagaaaacatactaataaaatccttggtaaaatccacgtcttaataaaaaaaacaacataagatatgtaagcgagaatgctgggctaagtcatgtgcccatcagcccatgtgtgtctagtgcccctgtgcagcgggcggtaggcgattcgcgccgccgccggccgtggggcgtcgcgtcgcgtgatggtagtatcaggtgggtgggacaattgggatggaaaaatatactttgactccctcaactatagctccgagtatgattcatatcctttaaccacaaaaccaggtaaattgactcctccaactatcaaaaccggtgcaaattatatccctcggtgattttagctgacgtggcgcctacgtggcggtattgaccaagtctttgttctacgtggcgcttatgtggcattagaataaaaataaaaaaaaggtaggacctacatgtcactcacacaaaaaattatattgtgggatccattgatatgtgagacccacatgtcatcctccctctagctccttcccggcttcccttcttcctcctccctccttccctctctcccccagcgtttctcttcaccccggccggagcggcggtggggagtggcggcggtggcggtggtgacagacgaaggga

SEQ ID NO: 62103 - DNA, 3806 bp, Oryza sativa
gaggtccggcgagaaccctggcggaagcatctgcggcggcaccagcgccgccaccatggcgtgcaggctccccgggtcctggtcgctcgggggcggcgttgcggcggaggagagggagaggagcacgcggagggagggctccgggagggagtaggcggagagaaggaagaggagcggctcctggtgcggctcggcggcggacgcgaggtttccgttgccaccgccgccggagagcgcggtgcagaggaggcgcgggtgggaggcggcggcgcaggacggggagcagaatcccgcggcgcggcaggaggggcagggggatgcggcggcggagagggagcggaagcaggcggagcagaaggaggggagggaggcgagcgaggccgggtagaggagcagcggctgctcggtgaggatgacctccccctcccggatgctgcgcgccgcgaggagcccgcgtcctcggccggggagatcggccgcacgcagcgcgtcgccggccatggcggagcagagcttcttcctcggcggcggcggcggcggcggtgggagaagtgggggtttttttggggttaaccgtttgcttgtaagaataaataaatgggccgaagattaagtgggccttgtgatgtatgtgggccggaattaggggcccatgtttataaatggaataagttcacatgaggtctctcaacttaacagcgagattttataaggtcccttaaccacaaactaaaaatgtgtaccctaaactcactcaaaccgtgcactcaaggtcctatggcagtatatatataggtggtttcgctgacgtggagaaaaggagaggaggcggccgacgcgacggcggcggcgggacaggaggtggttggcgcggcggcgggagagagagagagagagccggccggcgcgacgacgacggcgggagaaaaggacggcggaggccgagttggttgcggaggtgagctcaagctccgcgtcttggagcgccgtgaagtcgtcgctgccgcttcgacgctcgagaagagaagagaaggagaagaaaaaatatgcagctgatatgtgggccccacatacttttttttggctgactaggatgccacgtcagtgaaatcacccatatatactgccataggatcttgagtgcacggtttaagtgagtttaagggcacacatttatggttttgtagtgaagggttcttaaaaaaatctcgctgttaagttgagggacctccggtgaacttatttctttacaaatcaagggagaaattatgagtgggcatttaatgggcttggattggaatcatgggcccaagttggaataattaagcgagaaattacgaggtgatttataatttgggagttgacaaatggaagcgaggaagcgcaatagggcacgggcatcggatgtgtttcgtgcacgcaacattccaatccatggtgaccattattcttcttcttcagattcacaaaaatgagatcccgtgaccgtgatcaactgatcattacgtgcagaactagctatattttattttcttggcgaattttttttattcgctcaatcgctctcataggagagagattttcgtacaagaaaagaactttcataatgttcgaaatactatttttggtttttaatagatggtcgtggttggctttttaatactaacgttcaataatgtatcttattaaaaaatacataattattatttatttagttatgtcttgatttaattattaaagaaactctaagcataatctctaagcacaatacattttctcatatttacataaaattttaaaataaaataaattgtaaaacatgtattaaaaaaataaatgacatcatgtaccctctttgatttatattataaattgtttcgactttttcctaattaaattttcttttagatttgataaaaaaattactatcatctaaaacaacaaattgtttcattaaactatcagttaatatattttgatattgtttattttgtgttgataatattattttattttatataaacttagtgaaacttaaaatatgttaacaaaaaaaattaaatataatttttaatataaaacagagggagtattcaaaaccagaggagtataacttaaattcctcactacttaaaataacttaatctactcagtgtactaggcctcatttgttgcccatattttctgataagctaaaatggtttgttaggaaataaaaaataatttataggtaaaacttttatatatttgtttataacaatcaaagaatcaagttagaaaatttaaattttaacttttattttggcttattaaatcaatcgatgaggctcctaggctacatggattaaatttaatagcctagttatccactatatcaaattgtcatgtactagcattactgtacactaagcagcccaacgacccgcaacatctcgtgcaccatgtgcagatttctctgcttatcacgcatgccattaaagattaaactatctgtgtcaatgctatgctacagtgacaccagctgctgtcagtgagacgaagaatcgaacagttggtttttgttaaccaacttcgaattaaaagccacatgcgagaggaatcatctgcaatagcggcgaatcagtggtgcaatgcatgtcactgtacgcctgattttggtgtcctttagtatctttttctctttaattcttttttggagactgatagggagtcttctcccatctctgttatttagtaccagaaatgcaaagcagtgaattgagtattaccggttacgaacttgagaaatgatatatttaattttttaaaaaagtttctatataaaaagctcttttaaaaaaataatgttgttttgcatttccgaaacgggattgctatatagcattcgaatgaaatttgggatgaaatcttacagattttgaaccattggatccataccaagactcgtgcattgacttctctcctccaactccggcgggctcctcttcttctccggcgctggcgacaccccaactccggtgggttagggtttggggttagggtgagggtagaaggagggttgggggagggagaagaggggggtttcctcgggacttagagggatggccgtgggcagcgaaggactggcagtgggcggtggactccggcgggcggcgaggcggcggcggcgccgcagaagccgccgggatggaggagggcggtgggccggcgtcggcagcgggggcaaagcaagcgtaagattaggagacggcggccggtggtggtggatccggtggccgggagccaccggagacggggaagacggcggggcaagggcacctcgtcgtcgccgccatgaggagaaagagaggggagggggggctcaccggcgccgttgactctttccggccagccggcgaggcgggcggcggcgcggtggggcggtggcggcggtgacggtggtggcggcgtgagaggacgggaggaggagtggaagcggcaactgaaatgggaggaggaggagtagggttaaggggctgcatgaatcttaaagcatatccaatggtccaaaatttgaatgataggaggtgggattttctatcacatgatatatagacagcccctttcggaaaacgtagggagaagctgatttaagctcagcctgagtcgaggagatggccaagaaatcgcattctcgatttcgatctgatatttcaatatcctataaggatgtataaaagcactacattggttgaaagaaatatgagtaggagaaaactatcctggtcccctttaacatttaatcacacgaattttatattcaagta

SEQ ID NO: 62104 - DNA, 9413 bp, Oryza sativa
cggtgagcatttgtcattgtttccagtagtaccaccctaaggtggtgttgtatgtcatattcacgccgaagagacaatgtaaaccacgtcgccaataagatcgcggccaacacacacacaaaaaaaaaactcatgcgaacagaggaacacggtcttgtttggtgctgctgaattgacagcttttccagactattccattgcttaaaataagctattacaaggaaagcaaccatagcctccaattaggccaaaacaagcagacatgcacaactaaccatatagagctactactaatcagcacacaaggattattcttaacaatctcctcctaagacttgctgtgctcattactgatgttgatcaggccgatctttgaacgtagctcatggaacttggtcttgcccagcagcttcgtcagaatgttgcccagctgttcttcgctcctgatgaactccacattgatcaggccattttccgcagcctcccgggctagatgatacttcacttgaatgtgcttactctgtccatggagtactggatttttggtcaaggaaatggcagacttgttgtccacccttagcattggcgctctcggtgtcgatccttgcacttctgccagcacacgagcaagccacaatgcctgacaagcagcatttgcggctactatgtattccacctcacagcttgactgcaccaccaccttctgcttcatggattgccaagtgattgggctgctgccgaggaaaaaaatcaccccagtcatgctcttcctagcatcgacatcaccagcataaccgctgtcactgaaccccctcaggtacgcctccttttccaccttcctgctgaaccaaactcccaaattcttggttcccgccacgtagtgtaggatgtgcttcacagcagcgagatggtcctctcgtggatcttccaagaaccggctagcatacccaacagcaaaagcaagatcaagacaggtgttaaccaggtacctcaggctcctgacgatgcttctatatgccgtcgcgtcgaccgacggctccgagctgaacttgctccgctttaaccgtgtctccatgggcacttgacattgattgcacccttccatgccacacttttccaggttcttggtagcataagctccttggctgagcaaaattccacttgcgctctgcttcacctcaatgctcaggtagtagtgaagttgaccgagatcgctcatcttgaatgcagcagccatctccttcttgaattgcctgatgtcgtcgtagttggagccagtgatcatgaggtcgtcgacgtagaccccgaccaccagctgtgcgttgccgttccgcctgacatagatggcgtgctccgatggactcctcttgaaaccgagtgactgcagtgtgttgtccagcttcgcgttccaggcgcgcggtgcttgatgcagcccgtacaacgccttccgtagcttgagcaccttgtgctccttgtcggcgatgacgaacccggccggctgctccacatagaactctttctgcaggtccccattgaggaacgcatacttgacgtccatatggtccagctcccaccccttgtgcgccgcgagggcgatgagcaggtgcaccgagtccaaccgcgccaccggagcaaacagctcgtcgtagtcgatgccttgccgttgcgcatagcccttcaccacgagacgcgccttgtgcttgcacactgctacatgctcatccctcttcaccatgaacacccatttcaacccaatcgcacatcgaccaggtggaagatccgccagcgaccaagtcttgttgtcttcaatcgcttccatcttcgccatcaatcgctctgcctcatcgaacaaggcaagctcatcagagctcactgcatacagctcctccgccaccaatgcacatggtgcgaagccacatggcgaggctggcccgatgatgtcgttgatgctgcagaaccggagtggggcatcatcatcgtggtcagcgtccaggtagtcattgtcgatgcctgctggtgagccggtttccagctccgtgtcgcgatccccactgagatgcggtgattgctcacctgacgtcggctcctcgccaccagccctgccaggatgcggcaactactcccccggctctgcagtggcaccataaaccactgaggctgtcggctccatagtggagtactccaccgtgaagatgttgtcgccaccacctagctctccatcatcgctgctagtgccccagtcccactgggcttgctcatcgaacaccacgtcacgcatcacatgaacacgctttgtgacgggatcgtaggcgcagtacgccttagacccacactcgtagccgacgaagatcatcttgcggccacgatcctcgagcttcgtcaggtgcggcgttgtgttccggatgtagatgatgcagccgaacatctgcaggtggtgtactgccggcttcttcctgtgccacgtctcgaacgggatcatgccgtccacgctcttcgtcgaacacctgttcagcacatacacagctgtgcttaccgcctctccctagaaccatccgggcagtcccttcaacttgagcatgctccttgtcgtcaccaccaccatgtcgtttcggcgctcgacgacgccattctgctgcgagctgtagggcgcagttgttggcaactttttgtgacaagttgacaagcacgatcgcagcacctaaacgccttgcggcgatctcagagtcgccaaccacctcaatctagccaaagctaaaccaagatgggttttgataactaaaccggctagcggagccgattctaggtagaacgatggatagctactcgtctcgtgggaaggttttcaggacaaacctacaaagaggtgtcgcaatctcgcagcggcgtcggacgagttacggcgcaaatcgacaaagatggacaaactaaactagaactagaagcaaaagtaaaagaccgattcgattgattgatagttgattgatttttacaatgaaccggccatgtcccttaaatataggttggtcttgccctctataggccctcctccacgtccaactcgggatagaatccaaaggaaacccgaaatatgccttcccgagcaaggaaacctcgtgacccgacgaaacagtcctggacttggactctgccggtcagaccgaccacacaccacttgtctgaccggagttcaagccgtggtctgacaggcctatacacggcggtcagaccgtcctccagaggaaaacaccagtagacttccaaactttggcaactttccctattttattcctaggtgccaaatttgagtgtaaacacatgcccccctacctttttgatgaacaaggtgaatctaaaagcatagaacatcttttggtcttagggtgataatccaattaccgggccataggacttcctaagcatcttgccaaacgctcaggaagtatttcttcaagtatttcccattgattgctcgctaaaaacgctctccttgaagtgtctccaaaaaatacatgttcccccgaacaatgccgcatacccaataaggaccctcccaactaggagaccatttaccgaactctctggatcgaggaaccaaaggcaaaattgtttttcaaaccaagtctccaacttgaaataactttgctttcacccttttgttgtatgccttggccaccctcttcttctctttctctatctcttccaaagccttcaagcgcttgtcgatgacttcatcaagattgtctcccagcaaggtcttgtagtcttcacttgataaatcatcttgcttgatataccgaagagagccaagattcacctcaaccggcaaaatggcttcttgaccataaatactctcaaaaggagtgactttagtggcaccaagtttagatatcctatgcgcccacaatgcctcagaaagcacttcatgccacttctttgggtgttcctcgatcttctttttgactaatttcaacgtcttattattggactcggcttgtccattagcctgagcgtagtaaggagaagaactcaacaatttaataccataagattcggtaaaactcttcacttccttagatataaaagaagctccttgatctgtagtcaatgtttgcggaataactaatctatagataatatgcttcaaaataaagtcaattacctccgtatgagtcaaattcttgagcggcatggctttggcccacttggtgaagtaatccgttgcaactagtacgaacctatgcccctttgatgacggaggataaatttgaccaatgaaatccaaagcccaacctcggaatggccttggtttgatgataggattcaacacggcggcgggcgccaattgaacattgccgaatcgttgacatgcttcgcatcccctataatatttgaagcaatcttcaatcatcctcggccaatagaaccccgctctcctaagcaaccgattgatgagttccacaaattccttcatgtacctctcccaaagccactttagatgtatgctttcagctacacagtactccacgaactcgatcgaggtgaattcacctccgcgatcagtacagagtcccttgagctttcgtccggattcgccttctgcacacgcctgggtgtccttgacggcagccgctgcacaatcctttgaaggaatcgcggctacccacatgtatcggctaaggtcgtccaccaacagcaggaaatacttgttcccccatggtgtcgccggcgtgattggaccgcacaagtcgccgtgcaccagctccaacagctgtcgtgcacggtactcggcctgcacaggaaacaaggtacgtcgttgtttcccggcttggcacgcctcgcacagctgctcgagctgcccgatctccagcgatccctgcaccaactcctcccaggctagcttccgtagcgctgccatgttgacgtctccgaagcgctcatgccagcaccatgccacctcgtcaccatgcccatgcagcgccaggcacgacggctatgccaacttgatgtggagcatgtacagccagtttgccgtgcgctttaccttcgccagcaaccgttggtagggctcccgaatccacatcacgctgtcatcgatgtcgaccttgcaccgggcctcatcgagctacccgacgctcacatgttcgtcgtcaatcgtgggatatagtagatgtcagagaacgatcggagctctccattcttgcacacaaacacgatggtcccgcggccctcgatccatgccatcgagtcgtcgccgaagcgcaccggcccaagcaccgccgtgtccagcttcgcgaacgccgctcgggatcctgttggtatttcttaacattacagataaaatccgcaagcgcacggaagataccgatgtagcacttcacctaggagtattctcaggtatcgatttccacaggaaacaggtattacttccttatcaggttcacccaaggacactaagctaaggtgggcaaaggatagagaagatttcctagtgagaaacagtgtctacagaaagcttaattttaatcctaatgcaatactccaggcactggcaacattgttcccaaatgtcgctctactacgtacccaggtagggaggacttaagtgccacctctacacccacctcaaacatactgtgggatacgcagcaattactagctattgattacctaaacaccacgtctaagcaattaatatatactcttctagtgtttataactcactaaagcaatcactatattttagttgattatagcaaacaataatcccgtatgatgattaggtactaaccaagaggtaattctcacaagtaaatctaaattactcagaaagataattatattgaaagcagagtaattaacagaataaaagaaacaggagaggattaccgacaactccggaattcctccgacttcttctactctactctcttcctaattctagtatacaaaatagtacaatagagcctcttataattcagctcaagcttgaaaatatgtgttgagagtgaaggagtgaagctcttaaataggcaggtaatgacggttgtggaacggaaaatgtccgaagtgccctccaaccgtcatcaagaatgtatctgggacgtccacgccaaaccacgagatcaatggtggagagatgggttcggccgaaccctggcatggcccaacaggcccagaatttggcctgtggatgcttcttgctctaattatctgtttcttgcaattttgggctgattctctagtattttgatgtagtctaaagcccatctcttgtatggatgggttctttcttcactttagtctgatttccctcccaactttggtggtttatgacctgcatcaaataaacaccaacacttgtggaatatgttagaaataaatcctatcactatgttggatgtcttattatctgagttttatgcaggtattagccgtatgaatttagcacttaacagccgccaacagatcccgacatgtggttgttggcaacagtgtccaggacccatgtctctgcatcgcgctccttctcctcatccaagtgggcaagcaccttttcttccccgagcaggatctaggtgccggatgccaccgtcgtcgcctcaggtccgccggatcccgtcgccgccaccgagttcctattctgccctccgcatcactaggtcggcctacaggagcggaatcaccgacgagttgcgctggggaactccaaggggcgatgttaccactggtgcgggcagcgccgacgcgctcatgtcttgcagggataccgccaccgcaggagaaggggatagagttggcgacgatttcaggagaagcagcgcggcctcccctttcttctggacgacatgggccacttctttcttgggcttcgagtggcactcgcgagcccaaaggcccaacttggcaaaccgcctacactcgttgcatgtgcacttgctagagttggatggcccacttgatgatgagccttttccattgccatgaccacgcccacaactgtgttttcctcctccaccttgccctgtgccgccgttgaagccgttgccggagtggttctctgcttccagcttctcgcatcgtgcgtcccattgctcctcagtgaggtacagcaacgctggtggctcctcgtctgcatcttccactgccggagccgcccggtaaggccttcaacggtgagcatcgacacatccagcaaagttgtgatcacgaccacgatatgcttgagatgttttggcacgctgcggatgatcttgttgacgatcatgctctcctccagcttttcacccaaagtagctagagtcgcggccatgccgttgaagtgtagcacgaaagtcttcaatggcctcgccatcgttgaatgttgccagatcgaacttgtgtcggaggttctgcgccgccgtcttcttcacgcggtcatccccaacccgcatggtcgctatcgaggagtgaccctctctagcgggagatcgtgagacccccctttcgtgagttcggccgggggaagaggctcgcttcgggagataatgtatccaccctgaaccctgcaaaaacgcacacgggcaccgggattatacaggttcgggccgctatcaagcgtaacaccctacttctgtgtgtgggatttatggatgagtgttacaaaggttccaaaactccggagagctcgcctgccttctcttccaagagcttaggtctattccgtctcgtcccctttcttggtgggcaaggtccttcttttatatctcaaagggataccacatgcaccacctcaacctactcttctatcaagcgaggacccaccctatcttgaccggacctcgatccatgccttcgtccggaagctaagcctcagctcgttcttgagcgggacccagcgccgtcccccacctgacacgggggacagtcctgtcattccctcataaatgggtgaagacttgtggcgaccgtccttctcgtggagggagctccgaatcatgcctctgacgggacgggtcatacctatctccactccggggcccgagggtcgtcaagggtcggggcggagggcgcggcgccggggtccctcggggggtttagacacgctgacggcggcgcgagcctttcctcgaaggtccccggggggagtggggctcgtgccgacgcgatgcgcgacaactcatcagcgactgcgttgttgcatcggggcacatgccggagctcgagtccgtcgaagtgacgttccatgcgtcgcacttcacggacgtatgcgtccatttgcgggtcggtgcactggtactccttggagacttgattcacgaccagctgggagtcgcctaggacgagtaggcggcggatgcccattccgaccaccgccctcaatcccgctaggagtcctttgtattccgccatattgttcgtggctcggaaatcgagccgaacgacgtacttgaggacgtccccacttggtgaagtcagcgtgactccggcccctgcaccttcaaggttgagggagccgtcgaaatgcataacccagtgcccagcacgaatgtcggcgtttgggtcctctccatctccggagagggagggaacgttggacggaacagggtcctccactggggtccactccgcgatgaagtcagccaggacctggcttttgatcgcgtgccatggttcgaaatgcaggtcgtactcagcaagctcgatggcccacttcacgacccgaccagtaccctctcggttgtgcaagatttggccgagagggtaggacgtcactacggaaacccgatgtgcttggaagtagtggcgcaatttccttgaggccattaagactgcgtaaagcatcttctgggcctatgggtatcggggtttcacatcccggagtgcctcgctgacaaagtagacgggccgttgcacctttcggtggggccggtccttgttgtcaggggcaagagacccggggtgcccttgctcaggggccccaggggggtctcgggtcatgtcaggactataggcctcgggaccacccgccagagcctcccttcctcccacgggggcctcggggtcctcccgggggttgggggcttcaggtaccgagccttcgggggatgaagggccatcgccagtcgaggggctcccggtctgctctcgtcgcgctcgactactagggtggcactcaccgcgtggggggtcgcagccaagtaaagcagcaatggttcctccgtccctggggctaccaagatgggaggggaggtcaggtaagctttcagctgattgagagcttgctccgcctcctctgtccacacaaacggcccggggcgcttgaggagtttgaataggggcagcgccctctctcccagcctcgatatgaatcgacttagcgcggccatgcatccagtgacgcactgcacatcaataagcttgctgggggggcgcat

SEQ ID NO: 62105 - DNA, 3457 bp, Oryza sativa
tatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagccaaggaggtatttttaataaatggaattgcatttcatgagtaatttaaattggaaaaggttttaaaagtctcttttggctttgggcctaaagtcggcccaaaaccttctctctctcctggcccagtccggcccgaagatgagccggccgctcgcgcgcgcgcgttcgcccgctgataggtggggcccacctgtcagggccgtcgtcttcctcgcgccgtcgcccgcccgaaccctagcgccgcgtcgccgtcgtctccttccaaatccagccgcccctttccatttccggtgaaatcaatagaggggaaatgatcttcgggatctcctctaccttttctcttttggaatcgtcggctaaatcgtttggaaattcgcggattcgatctcgaatcggattcgtctctctctccttcgaaccctaatctttccttctcgtcgccggtcgccgtgggccttcgccgccgccttccaacccctataaaaggacccccccaagcccgccgctacctgccgccaccctcgccttcgcctctcgtcaccggtagagccctagcaccgtgtagcctagcgccgccgtcgtcgctgttcgtccagccgtgcgtcgccgtcgctctggtcgtcgttgccgctcgggaaagtcaccgtcgtgatcgccaagtcatcgccgacctcgtccgcccctccgtcgtcaccgtaggccaccggaacaccgtcgccgttgtcaagctgaaggtcaccgccgtttcttcctcgacgccgtcgccgtccgttgatcttccgccgttgttttggtcaccggtgagttcgccgcgtcgccctctacgtgttggtgtcctccgttcgcatcgtcgcgccgtcgttcgccggcgagcttgcgcgcccgagccgccgcctgtggtgacgtcaccgctgacgtcgtcgtcgtcgtctcccgtggtccggccgtggaccggtcgatctcggccgttcgttttggatggaaagatttcagccgttcgtttctgtgagccgccgccgtgcacccggttcaccgcgaaccctagccgctgacgcaataattcccttttccttttcaaaaataattcattattgcgtcataattcaattaaaatctaaataaatgatttaatccgatttaatctttgaaaattcataactaattcatctagctcggatttagttggttcaagtctctaaatttttctaaaattgagatctacatgttaaaaatatccacatgtacagttcatgcttgtttatgtgctgttttggtgttttgctcctttctgtttagattccgacgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaactatttgaatagccgtgcccgcagttatgggcgggtctaacaatgtctttcgtgagtagtttcacacttctcaccataataaaagatgctataactggtaataatttgtttagctcctggtttggaatggtatattcctggtttggagatagatctgtacagccgggcatggttgttcaggatggttgggcctgagcagcatgggtgtgctgtttagtgttgattaaaattgatgattaattactctactgttttataattctcaaatgtttgctaaatgctgcttttgcaaatgagccctatattatgccattctttggtgtccttgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatctttttttttccgctgcttagatctttattgattgagaggaactatctacctctgtaatgacattttatgcgcttattaattagagtaacaattgtactctattatcaatttgttattgtgtgcctcagctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgctctcctccctttctcttttaattaaaccaaactaatagcacatgcacttcataatctcttttagtggttctcattcaaaatttattctagtgttgttagtactgtacatctattactgtactaatggctcatttaacagcaaatgttttacaacattgttttattttgctgcaatgaaataaatttagcatgttgattttataactttcttttattttcttttggaacctgttgttcaaaagtacaaaatttgtgaccttgtttcaacttatcttgcaagcttggtttactttatttacttactttttactttgattttctaactttattcaaattaatctaaaaacttgtgctattaattggataaatgtcttaactccctcctttcacttgtctttagatgctgcgcta

SEQ ID NO: 62106 - DNA, 1576 bp, Oryza sativa
ctcattttgtgaaacattaaaaccatcccattatgctaattctggttaggtactacttttaggcgctgtttgatttagcttaggattattataatctgaattattaggagtaagctgaaacaaacaagtagattattatgatagattattataatatataagccagattactataatataataatcttctttggaggagcttttttcagattattgggtggctaaagacccactacccttagatgcctccaataatccaaagaaacaaatagctcgcagcttattctatgtcagcttattataatctagcttagagtaatctgatttaataatttagattgcaataatcttaagctgaaataaactgggccttagtacagggagctcctttctcttcttgatttatcttcgattggacgaaaatgttagaagaatatgaattttcaatttttaattacatactgatttatctaggcatcatatattctcattatgctacttttggttaggtagtacttttggtacagggagctcctttctcttcttgatttatccttgattggaccaaaatgttagaagaaatgtcaattttcattttttaagtacaagctaatttatctaggcatcatatatttcttttatgacgaaatggtgcattctttgtttgcgatttgatttctcgatatgtttaagattgaagtatttccttgttgattccttactcacagctgaacaaaaaagactccgagatgctatattgagaacggcttgtctatatgatggaaggaatcactatatatgtgatgactgacttccaaatatgcattacctgtttctattgttgacccatgactggcttgtacaattagttcagctgaagttgtaaaacaattattacagtttcactccatatgtgtctataatcattttctgtgtaatctgtaagtattactatgccacttgtaagaaaaaaaaagtgatgtgactgtaaaaaataaaaccaatgcttaattcagctataaagacaaatagaattgcaccgtagcgtttagcacgggcatattactagtaaggagtaatggataaatgattgaggactgttcagaagccaaacagacgcgcgactcttctcgggaattcacttattgtgacttttgagctagcctatgtccagtaaactcccaagacctttcattcccatctaggagggttgttcctaatataaatatcccctatattttataatttagggacttttgacaatgagaatatgaacccctttgtttagctgtgtgctaacaaattcagagagagatctttacccctttgctcttttaatttccttatgagattatagaagcggcgttcgacgccacccaattggtgctcctggtccctttgaggatttttcctcaattgattctaggttgtgttggttgataacttagagtgtggttgggcgaaccctcgattcaagttgccgtaatagaggcggtatggtggttggcttcaagtacaattgtcggattgcactgttatcttggttgcttgcaggtagttatcttggtctctttga

SEQ ID NO: 62107 - DNA, 813 bp, Oryza sativa
aaagaaaatctttgtgtgtacaacatcataccaagaaagtacacaaataaaggtgctctctcacaacatcatatcaataatttaccatgagcagatctatattggctctctcaactttaattctatacaatacaacatgataccaagaaagtacacaaattcaaaacccgggcattattcttagcacaattgaagctcgttaccaaaagctaatcaacaggatgaaactcaccgttgcttgattcactcccttcacggcagtagtgcttccaggcgcccctccatgcctctgactgctggccgcagcggaggcagcggctcacgtagtacgaccggagcttctggcagccaagaacacgatcctgaaccaattccccattgacggacaggttgcggccgccatcggatgtgtccaagatggcaacttggtcgtctccgcaggtccatgagagggttggctcggagacggagtccaaagccagggaggaagagcacagaaggaggaggagagcagggaaaagaggaaaagatgccatcgatactgataaacaatcttcttgaccctttcgaattcacagagatatcatcttcggaatccacaaatcgaatgaaattaacgcgagcacaagattgctaactcgtgatctccttttccttacggaaatgaaaagaaaatcctagtcaagaacaagggggagaagaaagcaagggtgagcttagaattttgtggggaacgaactgcctgctagaacaccaccaaaccccgagaagcagaaaagggaatcgagggggaagatgaagacttggatttaa

SEQ ID NO: 62108 - DNA, 8049 bp, Oryza sativa
gggcccactgatttttgtttttgtttttgctgattaggctgccacgtgtatggctgtatgccatgtaggctgaaaacctctccagattgagttagggggatgattcatccggattgaagagtttaggctgtctaatatccggtattggagtttagagggtaattcgaacgaccgtaacagttaaggagggtaattcgtactttttcaaatatttaattcatccctgtaaacagaatcatcatccatcaacctccgtccgcatttcatccgagaagattgagcattcttcttctgatgcaacaacattggagatataaacagtgctttgtagtcgtttctgcccccacaaatatcagtgtattcataatactccggtactccctttgaagatttcgttctaagttaaacgtatttgaatttgacttaatttatcaaaaaaatatttagccatattttctaataccaaacaaatatattataaaaaaattcgattgtagatttaattaaattagtttggtgttgtagatattgatatattctttatataaactaggaaggtagcccgcgcattcgcacgggcatgcttgttatttcttttcgaaaacaggtctaacaaaatgaatttaaattaaagttatgtatttcccttcttaattgaatgctcattgtttattttttcttaaaaaatcttaagaaactttaatttctcataaatatagttttctaccatcctgctgtctttaatttattgattttgtattgataccttagaagcttatacatgcaagttgtggaatttagtaaattcgtttaattatcagtgacattcatttattgatgtgtcaaagcgaaatatggcttgtatgtagagaagcataaaaaaattaaaaaagaataaaatatcgttaggacataaaatgagttttttcccctatagccaagggagtagattgattcaatactacctttgcggattaagtgcttcactaaaatagttctctctataaaagtttcaatgctatcttgtgggttaagtactccactaaaatagttgtgtaaaaacattacaaaagttgtttctaaaggtgacccatgagtctgagccaagctcgtcacataggagggtgcacatttgaggaacatgtgaaaagaatgcccatggagatcatttgtttatgagtgcgatgaatacaattgttcattcaattaaaaagttggataagtggcttaaagttgacattttacattgattgattatgaaagtaatggtacatacaaatctttgtgcccgtataactatttgccaacgatcaatagaacttgatagttactttcggtgttccttttagtatgtagcaaattggctacatattttacaacttactgtatctttggtgagatgcacctgctatttttttctatatgttggctagattgtttcattgttattaatcgataccttgggtgcatgtgacactatatatatttcaaacaaaaaagccttctcgggtctaaattgattttgcagtgtgggagacaattcatttgttccgtgcactgtggtatgattgttgtcatgatttaaatatttttgctctaaaatttatgattaaacattagaaatttacgtgatccaaacgatcactgtttgtgattttatgttagctaacgtgcattgggcatttagtgacaatatttatattgcataatcttaaatgtgaagcctaccatgcttaccctattttatcttttttgtttgaaagaattagccatttatacaatcatggtagtttgaatactaaatagtttttatcttttaagtttctaaaataattggtagataaagctcttagctcggtcatctgtgatatacacctgtactcccaagctaatttggcccctatcacacatgtagtcacaagctaatttggcccccatgctgatggtgttcccattaatgtcgatgggggcaaaactgtgaccgataaggagtcttaagcgtttctaggatgttcacgtggtggcttgagagttcttttaggaggtttaatggacttttagtatataatagataaatataattatattattttgacttaccatagttttagaatgcggggaataattttttttaacaccactcatagttaagtttattttacttttaccgttgttgatctaatttaattattgtgaatacgttgataaaaatatatatgggtattttttcatattttttatatttatctaaatgacacatataaaagtcagaaattataaccaaaatgtgacttttttgaaagttgaaatataatgaatatgatctttaaccatatatttagtcataaattatctaacgatataaacagataaaaaatatcaatttagatttgtggtttctaaccaacattgcataaaaataggaataagagagggaacagataaagagaaaaagagggaccgcggataacataccgtacttacgactccatgcgcactaaaatttttaattacatgaaaagatatgtacttattatgagtattgtgcatatctaatgtgatgaaaagatatgttcgagagcgatgaattctagactaccaagagcgatgaattctaccaccatgcagaaagatgcggtgttttttttttctttttcatggagataattacaaataatccacaactttgcacgacaaaggcgcatgcacattattctggtgctcataacaatcatatgcgtatactgatagaatatgcaacaacagtagagctaattaagtcgttttaccggacagggagtcagcaatgcctttggcaacgcaatacgccacggactgtacggtgatcatggggttgatgcccactgcggtgggcagcacgctgtcattgcacacatacagctgctccgcctcccagctctcgccatgggcgtcgacggtgccgttgcccaccgtggtgcccatccggcagcaacccatgtggtgcatcgagcagaagaggccccacgtctcttttagagattgatctaatggttaaaaatattgggtccactggattaaatgaaattcaatagtttttgcctttttctaagagattttaagaatttctctaatttatcagagtgccacgtggtggcttaggagcatttatagggtatacgtggcagcttagaagcgtttctagaaagtttcatggacttttaatgtataatattatgtaccaaaacatggtcaatatggatcaaacaaaaaaaatcaaatatgttaaaaaatatttagccatctaattattgattttttttaactttttagctagaaaactgagagaggaagtgaggaaagcggagacttatcatctgttaggtcatatgcgtaattcatcaaaactacacttgtcatagatgatcttacttctttgatggattatccctacagacatatctcaaacattctacgttttgatccgttcattagtatgagagctatcataaatgatttgtcatggatggcttcgcttaagcgtgtcataaattgaatgtgtagattggcttaaaaaagtaattatttatttatgtcaccaagatcattcatatataaattaaagttccacgtaaaaatagatctaataatttttatagtaacaaattatggtgcataaccttaataaaaaaaataaaaaagaaagagaatactgagtgggaggagcagatgtggtggttcgtacgttttatacgtacctgtagctctaagataaaagggtgatcggatcggtggatttaatataatggttagtattaccgggtcaactgttttaacttaaaaataaacggttagatatttttctttttttctcagaaattattagagcgtcacgtggcggtttagaagcttttgtaggaatcccacgtggcggtttgagagtgtttgtagaaagtttaatcgacctttagtatataatatataataatatatttattttttggctagacgattcctcaaatttacattgcacgggctataatattgatactataggattcctcgacttatgagtgtttatagagtgccatgctaaatcatattggttgcttgcgttgtgaacaaaagttactcgatctaccttggtgcaagtgaacttaggggtcatccgatggcttagctgagcccttaattagttgatgtcgtttcatatcagaaacgaaacaacttggaagtttgaacgggatttttcttaaataaaaaacagcaaaagtagtttgcagatcaaagtttgaaccaaatcttaattgataaattgcaccggagcagtatatgtttggggactcaagagtttggatggatccacatcgatggactcatggcactcacggctgtttttgtggcgcagatcttctggtgcagggcgatcaccagtgaaagaggtcgacgtatatgtagtcgttgtttcgtcgcgcgtgcagaacgtaaggctcacgtagcacgttcttttttctatatataaatctaagcgattatcagggacaacagatcacggagggattactgtttctttttcataaatatgatccaacggtgtaaaataatgggtccaccagtttaagtgaaaaccgaaggctagatgttttgttttttattagaatttctagggatttctctaatttattagagcgccacttggcggtttaggagcgtttgtaggaagtttcatggacttttagtatataaagatttgacttaaaactaaaacatcttatattttcgactggatgaagtaacgctaaaaaattttcaggaaaattgatgcatcattgtactcgctaatccttgcaaccactgattcgttattcaatacaagcaactttatttctttagacaaggaatagctccaaaaatgaacccagccacgatcttgggtcacattcagcttgttcacatgcaccctgacgtttcctgcggggtgcacgtatcaatttgcccttcgttccccgcacaccggagccatcactttcaagaacggacggataatttccaccacgtcctcctctccacatccttttcatctcccacctcctcactcctcgtcagttcgtcacttgcttccaagaaccccgtgacaaggcgggaaggaatccgaatcgcagcgagatgatttgccgcagtctcctccttctcagatctaatgcggcctccaaggtgatgttgattaaattctgcatttcttggaggtttttactgcacctgcgtcactgcttgtaacaagaagtggaacggttttgatgtttccgtcttcttgttttttttgaatatttggaggtagtattgtatattttttgcactgtggaattgatttttgatccctataaaggctcaagaacaacagggtgttgctgttagtaagcactaagcagggttgggtgggtctgtttgattcgttttgcagccttagaaaggtgcagtcttttgttaatcgagaattggttaataattggagcagtcgtgtgtttgtgatttcatttattcttttttaatttgcctgctgcagatgttatgtttagtcagatttaagatgtttatgcttttttgagcaattatagagcaactctctaaaccctgctttcctgatcatttcgttgtgctgttatcagcaacttgccttcattctttgttttgtttaaaaaaaaaaccttgaatgtacagatttaagcagtaatggttttgctcaagattagagttttcttcaaaacagttgctctgagagtagctcgagtagtttgaagcgattttgaactcttaacattattctaaagtcagcatttcttacagctcatgtacctaaattctgcattcatctatttcctcacataggcaagcaacatagtaaaacatgtagctgccactggatgtttgccaaaatattcctcagaggcaccagccagatatttcagctctgaaccgtctcttcaggtcgactcgacagaagaaaatgggtatgttttatgtgcagaattatcacataattatgtgtatagacatatctagtctaaatttcttgttatctaccactgatgctgcaacattttttacctgtatcaggttcaaggggcatggcatgctggccccattcactgctggatggcagagcaccgatttgcatcctctggttattgacagatctgaggttctgcaatttggaattgtcttaaaatttttttccattgattctcagattatagcacaagatttagaacatgtagctttccatgttgacttctcttcataatgtggtggtttctagctttatcttatatcatattcaacgaattgcagggttcttacgtttatgatatcaatgggaagaagtacatagatgctcttgcaggattgtggtctacggcattgggtatgtgcaccagttcaagctgtattttcagatttttgtggtataccaaaaagttgttcctactttctagtaaaactcgtttcccgcatatgtaacaaatgtagtattgcatatatactaaactttgctattgtcctttgtatattgtcttgttttctttgcgtaattccctttgctttcaggtggtaatgagcctcgattgatcaaagctgcaactgatcaattgaacaaattacccttctaccactccttttggaaccgtactaccaaaccctcattggtaccttttttatctcactatctttacaggaatatagttaaaaccgtaggttgttgatgttatatttctaacagtgtgcttgttattttacttgataattcctagtttcaccatcttccaaataggaataaaatttgatgctacaattgattacatcacatttagtagttcccttgtttctgttaaaaattggtggtttctgaatcttgatgattatactgctaatttcaggatcttgctaatgaaattctcagcatgttcactgcaagggaaatgggaaaaatattctttacaaatagtggttcagaagcaaatgattctcaggtacaataattagtcaaaacaaataactatcattatttggagtttatactatacctgctctcattatgaacttttctgttcaagtttggttagtaaaaaattgcaaaaataaatgttgtgccacagaatataaaaacattgtggggttttatttactgaaaataaatagtgtatggtcccccagttgtgatattccacaaagtacaaaggtcagtcgtgatattcagaggattatggtggagtagaagtatggaagtattcagtattataacagtgttattctttacaggtaaagctagtttggtattataacaatgcattgggaagacctaacaagaagaaatttatcgcacgctcaaaatcgtacgattcattttactttacactttagccttttctcctaatgcaatagacgatttgttgatatgatttattttcatttatgattataattctcaattcattttgtcctgcatgtcagttgtatatttttacttgcagttctgtatataagtctttcacatgtcaataccagatgatggtgtcagtttatattatcatgctttttgtaatatttttgcgtcaaacttaacaacagatgaaatactctaagaattatttctaaatcaccgtccttgtatccaccagcattacctttcaatatcatttaagctccttaccttgattatttaagttctcgagccatttggatgttatacattcccagctattttatatttttacagatatcatggatcaacattagtgtcagccagtctatcagggtgagtaaatcatactccataacatcaatatttccttctgttagtccttaaatctatcaaataatattcatactagttacgaggtaattctataatcctaagtaatgctttcttctcttggtatatttagaataacttgctaattcctgcattgtttacagtcttcctgctcttcaccaaaagtttgatctgccagctccttttgttctgcacacagattgccctcctactgcgcttccatcttcctggtactcttgttg

SEQ ID NO: 62109 - DNA, 849 bp, Oryza sativa
agggcgaggtccgggacgcggagggaggcctcgaggaactcggcgaggacgagctcgtcggccgccgcggagcgcgcgccgcgcgccgtccggatcggggtcggcggcggcgcgcgcgcgggggcgcggacgcggggccgccgcggcgccctggacgtcgccgtcatgccgccggccgatcggcagatcaactcggctgcgagcccgcgacgcgacgtgctctcttgaggttgggtggtggttgcgtgggtgtaaagaaaaacgtggggacgggaggtgaccgtgggatgcgctggtggacggtccagatggagtccgtggtttggaatcgtgttaaattggtgggaaagtggaggcacgacggggcaggctggctggctgacgacttgacaagagagatgggaggcagtatggcgcaaaggtggcggtggccgactgaccggtggggtcacaggctcacagcctgaggcaatgtttggctaaattggaaatggaaatgatttcccacccacaaaaaggcatcttatatggtgtctgattcaagttggacggccggatcagattcacaatccatcgctatcgtcggattccgcgagataaactgacataagccagacaaatctggacaaaaaatgtaaaattcagttacagttttttaaaaagcttgaaccaaaagccaagcggtttggcccgatcagcagagtttcgtgcacaaagatggcctttagagttctggattttggtcaggaacgtacattgagcatccattgtgtttcacttggctgaatataaagaaaaagtaacatactcgggatttaggagaacatacgatgttgctctcacaagcat

SEQ ID NO: 62110 - DNA, 1092 bp, Oryza sativa
cggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgcccgaggccagatccggcaagcccaggccggatctggccacctcgccgccactccgacga

SEQ ID NO: 62111 - DNA, 677 bp, Oryza sativa
tgctgccttccacgccgcgacgccccagcaacacatcgctaccatgccatcgccgtacaaaccgggggcgcatcgtggcacccccggagcaaacaccgccgccgccattttagccgccgccgttgcatagccgtcgtcgcccgccgctttgccgccgtctcccattgcttccaccgccgccgcacgacgccgtgccaccgcccgccgtcgtctctctctctctctctctctcttcctcccggccgcctccctcttttgcctccccggccgccgccgttccattcccggcgtcgacctccggccgctgtcaccgacaagcaccagccgccggggctcctccctctcctctgctcacgccctctctccttctccctgtgtgcaagaagaaagaagagatgaagaggaggattaaaggaggaatagagctgaaaatccttcaggggcaaattagtcattttccccacatgtcagagctatggaactgttaagttctaacagaaggtggacggaatggcacacgggtcaacgaaagtttttctcatgacatacaggtgactctaaacttttttgtggcacacatgtaagtagtaacttttttttaagttgcataggggtcttggttctccttctcctcgcgccgcctctactcactctggctcaccgcccccctggatctg

SEQ ID NO: 62112 - DNA, 1527 bp, Oryza sativa
atagaagaaaatgagccgggcaacctctgtaacatgttacagtatgatatttgtgaattttcaaccaaattctgaaagttttcatcttaggggtatttttgtcattagaacaaaattgtatggtactaacggaggctaacttgacggcgatggtaaattatagaagttaaacaaaaagcgatggcatagtatggaactgaacaaagtcagtggcagattgtggttccagggcaaagtcagtgatacaggatagattttctcattgttttaagacaattcaacaggaatacagagtatctcgactacttaggtactgttaatacaatataaaagcatgtatacaaaccagaaatatttagggcctgtttagatctcctggcaaaagtttcatcctgccacatcgaatgtgtagacacatgcatggagtattaaatataaataaaaaataactaattacacaaattacgtgtaaattacgagacgaatcatttaagcctaattgctacatgatttgacaatgtggtgctacaataaacaattgttaatgacagattaattggacttaataaattcatctcgtagtttacaggtggaatctgtaatttgttatattattagtctacgtttaatactttaaatgtgtatctgtatatccctggatattattaatctgttatattattagtctacgtttaatacaggcggtctatatcctatgtgacacgtcgaaacttttcatccctggataaacagggccttactatatttgttaaatagtacataaggtgtatatttctatcctatgttggcaccatatcgacaccaggccatcagctaatgcctgttggtaccggatcttatactgattaaattacgaaattgctagaattgtatcgacacattttctcctccatcacagtcggcgttttgaagcgtccgatttcctttatcccgtgtcaatgcgatcctgtccgtgcatattgctatggcaggctaacgttgaggctgtcaacatgattaattgattaattaaagcttaacgtcttcattagttcaaggttttacacgcatgcatactatactttatacaaatttacaccccacttaaatcccacttacacaccacttacacatataattactgtgtaatttttagacttacatatgtaattttgaaacttacattataaatacactaaatttacatatgtaatttagggacttacaatgtaaatacatgctaattattttttgatgaaaaatatgacgtcacaaatatagctactcccttaaattaagaaaaactaaaacaccttactcgtggtcaggcaccaaaaggactcacacgagttggtgcacaagcacaactgcgcactgctgtaaggttcaggcatccgaagacattttgtgtctcctcagctaccgtaccgtgggtactttacttccccgtcacttgctaatttttacagctcgctcaacgctctttaaagtttacactccgactgttcaacggcggggagtgcaagt

SEQ ID NO: 62113 - DNA, 10948 bp, Oryza sativa
cagcttgttaatcgaccaggaacatgcaccgtctgtcgccgtacttccgggcgaggcctgcgcgcggcggcatgaacgctcgtaagcgtgaagcgtgggtgtacgtcgccaccgtcgccgccaccaaagctgctggagtgggtcgtccacgactatgagacctgatctagtctgtttagttgaaaccattcacaatccatgggttcaatctatggactgaatccatgttgtactcagaaaatcgtaaccatcaccaaaccaccccaaacctcttttctggtggatccaaaccaatcttcagtccaaccaaagcacacccagatacaaaaccaatccattcaacccattacttgctgcagttggctgccggtttgaacagccgcagccgcagctagtgcctccgaacaagtccattataagcaaaattaatttttcacattttcatgcaactttcctcgaatctctgccatgatttgcatgattttcacgtcgactagaaaaacaaaataatgagcccatacactcaagggttcacctttctgattgagcgtaggatctttgatccaagcgatatgataattttcgtcaaacttcaagaaacttctactctctccgtccgtgaatataagagattttgatattttgtttgcaccgtttgaccattcatcttttttttggaggttattcaaaaatttttgaaattattatttattttatttgtaacttactttattatccaaagtaatttaagcataatttttcattttttatatttatacaaatttttttaataagacaagtggtcaaacgttatattagaatagtgaatatcccttatactcacggatggagggagtatataatctatgtcgaatttgttatttcaaaattatattctcgaaaaccattcgaaatttccctccgaatcttctcccgttccaggtcgaaacctctaaattcgatccaattttgttaaaattttcacggtttcgaatcggttctcgcccaaacaaaaaccttcacatccacatccgcatccactcccagcctggccgaggaggcactgcgcggtgggccccacatggcagcgacgcccccctgaccccactccggaagacacgcgtccgctccacgagtcataggcgaggtctcctccctttttccgccgcgcgtcggccttttcctccttcctaacctagggctccgatttcgccaggtgttgcccatcgtgaccgtgccaccgccgccgacgtcgccaccgacaccgccgccgccaccgccaccggcacctggcggtaagcgagcggcgccaccctaaccctgaccccgtcgtccgtccggggtcgtcgggttcgttgttgattctattttatttatttttttatctcttctcttgcagttgtgtggggttttgggggggttttggcgatggagatggtgatcggtgcggttttgctttcctcgtgggggagggtttttttctttttttttattctgtggtttgcgatggattggtggtgatgttgatgttggaaggacgattttttgctcgttgatcgcgattccccgcgcactttgtgtttggatcaaacagaggcgggtctttgccctcgtactgttcgttcaccattcgctcgatcgacagaagaagaaaaaaagaagtgcagaaagcgatggatggaggaggggacaaggcagagacagagatagttctcatgtttcacttttaaaaaaaaagtattttcttttcctctagtggtgggaatccaattaatttcaatttcgatcgaaagtacacaaggatgatatgatcggtctttgtcaatcactaatcctgaacttagtcgtaaaagtatctgtttcgagaaatagaaaaaaaaagggactttctttcgtttgttcgttcaaaaataagatttcctttttcctggattaccgttcgtaaattcacatcgcttttgctttattcgaacaccaaactttcttaggttgaacagttattccatcaccttctctgcatatattgtagtgttaagaactcaagaggcatatgtgcaggttattaaatatgcctgttgaattacaattgcacagaacaaagcatatctgataaatctgttaaccagaatgagactatgagtgattttgtcacgtaggctaatgcaaaggtcatggattgtgcatggttctcatagtagctagtcaatccactagtttgttggaccagataatttatttatatcatgatgtggtgccctgtgcccacaccacatggctacatgtgattctgcacttcttcatgctccacaatgctgtatgagcacctgaatagctctgctctgcgccgctgcacgccatctgggaggcctacttttcatgcttttcactccgcaaaaactggcagatatgagtgatatgctgaattggtcttgggctgtacactttctctgacagtacaggtagagtttcatttgtttgtggattgcttgatgataaccaatggagggctcctgttgatccatggcagctgctatctttctttcattgatttctgccggataggactgagccttttctctgtgtgcattactgtagtattagtgtggcatagactgttattttacttatttggaaaaaaatggaggatggaacaatgaaatatattcagaaatatcactatttttgtataccgtacatttaatgctgtagcatcgttctgccttcatattatatatcgtagtttttgctcatttggtttcttgacttcatttatcactatatatcgaattatcactatcctgttgctctcgtagctggaagttgtaagcttggagtagttttatatagtaattcatgcaatacattgttggttagtctgtttacacattttccctcaatttctggaggtgcaacatttttcattctggatttgtgaagaaactggactttagtcgttttcactcacctgttatcatccttactgtattgtagttctaatgtttaaatttggacattgctgtattgttgaactgactagtttgttttccttctgtaaatgacagatcctacagcagttgcataggagtacatctttagaaatggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggagacgctgcagaggagcgacgtcgagccggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaatgagataaatcacattctgtgattacttattgtcgtagtgtggtttggttagcttgagtttggttggaaaaactttttttttccgtagactgtttttatgtttgttttgctgccttctggtagcgataggagggcgatccggtctgaaactgttggtagcattcatgatgaatttctcagtggttataatttatgaatcttagtaacagctgttgcaagaacaaatatttcctctggttagaattgttttttaatttccttttcttctttggtccggattaactgtatcgacgaaccattgaattatcatcggcgatatcttcctaataacgctggtttcgtttaattccgattaatggtttaggaaaaacaacagaaaagattaatggtttaagaaaaacaacaaaaacaatagtgctgaccaggttcaaaaacggggacagcattcgttttcgatttatcaagacagcgtttgctttgctttaaaaatgttggtttgcatacataggattcaacacaatatcaaaataaccaaagcatcaaggtcaatcggcaccatatcagaagcattctactatttgaaacccaacagtttacaagttcatactgataggttaagctgacagaggacatggattctacagcatcatttcagtatgaacttgaaataagcatttgaattatgcagtccttttctcttctcctttactggttaggctgacagaggacatggcatctacagcatcatttcatactgacaggggaaaaaaatgatgaatgaaccttactctagaactgatcatttacaagttcatctaggcctacacacagcagaatgtcacacctgctcactctcttgtcacacctgctcactctctgaatcagaaaccaaagaacaaaaaatgttcatatatagtatatctggcctacattgagaagactttcatggggaacattgaatatcacactgttctccctgcagatcttcctgaggaatgcaaacacataattcacagcaaccttcttgatgatccctgaatcagggcgcgcgtgaaccacagtgttccccaagatgtgcacgacaccagcgtccttgcaccggttcaggaactccaggttcaagaactccagttcatcgccgaacgtctggctcgagtaccttgtcaggctgttccctcttatgggtgacttggctggaacaatggagtcctgtgatgagtagctcaggtcaccagtggagcacattgtgttgctcccagcctttccagttagcagcagcgcattgcttgatccctgggtcttctcctccatcatggtgaagtcttcggagtccgaatagtcatccatcatgctctccagcctgacgaagagcaagagcctgtcaaggagcatcttctcgaagtcgtcatctctcttgtggatgtccttgtacccgtacctcgcgacacaacggaacatgtggaagttctttggcccgatcctcttcacgatgaacctttcttcggttgggactgtatatactgggaggtacttgacacaaacgaagacgacgaccgagtggatggcagggaggttggtgatgaaatgggagaagatatgaggcactccacttgccagctcggtgtacacgaagcctatcccaggcaccctgacgaggccgaggcttggtccgagtcctaaaatccaggccatggaaaccttgctgtgcatctcaaattcataccgcttcacggtgcagaaatgccacacatacatgatgatgaagcaggtagttgcaacaacaagtggaacccaaccaccttggtcaaccttgttaatgcaggctgtgaagtatgggagctccaccatcaacgagagcacgataaaaatgacaacaaggatccagtggcttttccatactaacagcattattgggaccatgagaaatgtcgtgaccagcataactatcaccactgcagttcctgttcaacgacatcataagaaaacaattagggtgacatctatggaatgcaaaatgcaacattaatgttcggtttgcagttatattttgagaacatcagttgtcaatttgcagtgtcctaaaaaaattgcatcgcgctgttttgataatgttctctatcagataatgctgacccactttacttcttatagaaagataagctcatttaaaacctgaagcatcatgcagtgtggtaagaaagtttatttaggatttaattattatccagctatcagttctcaattatattgcttcttttgtaccatagcaccagtcttttagaacctagacttggtagctgacaacacaccgcgcacatatcgtgacataaagctagaaaatacttatggaacaatgccaattttgttcggcttaaaatgaaaactatctgaagctatcccctattcagcagcagcgtaaaaaactgttgattgtctactttaagtgcattgaaagtatcagttacatgtttggagatggaaaagaaaagcttaccatatgcatttcctatctgactttggtttttgaatccagctgttactgcaatgcaaagaatcataagtacccagttgatgtcagggatgtaaatctgcccgagaaatttctttgaggtgtggacgacactgactcgaggaaaacagcccagtgcgagagcttgctttattatcgagtatgtagcagatatagtggcttgacttgcaactattgctgcaagagttgcaatgatgaatactggccagtatatggtatctgcagcaatcaggcatcacaccatgagtacataaatacatatagtgcatacagcactggtaaacaataagaatggtgggatatgcactttgccaagttgcacatgggatgcatttgcattttactttatgacagccaaatttgttagttcagaggggcagggacctggaatggagcgataaaaggcatcaactacatggtccttgttgctaataatgtacgcagcctgtccggtgtatgctaggagaaggcaagggaacaccactaacgtgaaagcaatctgcacagacattattagtttaccgacacaatttatcatgactgatttgtttgaagtgtttatacctgaatggccaagacagggaaatgacataagtcagcatataatgcttcagtccctgaagagagaaaatatataagtaattctgctgtatcttgtgatttatgaataatgcaattaatcaatgaaaggtacatgagaattgtgagtaacctgtgatgctaagcatgattcctccaagggaggtccagctctcagacttccctcgtcggaaataccgatagatatagactggattatatgcttttaggactgaactgttgtacttgtgtatgttcagtgccccaatagtcccaattaggataaaccaaaggagcactataggtgcaaagagccatccaactttatctgtaccatagtgttgcatgctgaataagccaattagtatgatcacagcaacgactacaaccacatctgccaggtattgaagcaataaacatcaaatgattttacaacaatgggagataacactacatagggaagaaagcttctcagtaaatcaaaggaagtgaacaatgcaacatagtggcccaagatcacaatatttgcgcacacaatatttaagataccgttgctggtttctttcattcactttggttaagttcacatccctgtatactagttacactatgttaagttcagttaagaattgaccagatttggccgtgtacatccttttgggtgtagaggccagattttaatccattttttttaaaaaaagagataattgaccagatttgacaacaccaatataaaaatacaaagagcagaattacctgtactcatcttctgattctgaactcttattccacctgatgcagagagaactgcagagcaaacaagtgtcacaatccaagttccaatcggttttaccaatgaaactactatgctgaatacctgatatagcaggagtaaggatcccatctccaatggctgtgcaggtaccaatgagaactagaataagaagacagttctttttatacacatgtccctctagccatctctttatttttgctgcaagtgaattctcttcataagtttgccgactatatgttgttaattcttcatctgtcttatgttggttgggaatagtgctgacctttgcatgccggcaaagtaaagaatagagagcgaatgtgccacctgtgaaaaaagtctaaaatttattatctaaaaaaatgtgcaaaatgcaaacaaactactcctatgtcaatttattgccaagtgactgtcagtaactgttctctgagcacaaaacggaatgaactcaggacatcaccttctacagatttcatgactagttcagtgctatctaccaatcattctggcatcactacgacaatgttctgttatttatgtgccaacctatcgaaatggtaaaattgcataatatttctatattctcatctcataccaaaatcttgttatatttgactaacatgagatatttcctaactgcatttttctattttttttcagatgataagtaaataaagaagcagcatatttggttaaacattggcagaatgtgatatctcaccttggccattatcatttgcccgcaagacaacaaaaacatacttcatcagaggaatgagggtgagggtgtaaatgatcaaggaaagagccccaataacatcctcatcatcatcgaccccatgagggaatatattgtagaagacatataatggagatgtacctaagtcaccgaagacaacaccaaggctctgaaacgcgagccgtaataacaaaatcgacgagaacttctgcatgaacaaaaacaaagcacattttagctccccatgagctaagaatatgatatttacgcattgccaaaatgacatagggagtacattatctttccacaccaacatcacttatgctgccagtgcctaacaatttgaggtgaaacgaataaagatactataaaatccgtatacagttcctgcatttggaaacctacagtaacagcacatccatcatacagtttcaaatcctttttatattgaaatggtccccaaaaccatgaggtcatacagaatcatccatgtcaaagaaacaatgtttttttttcttgttccaaatacaagcagacactaagctggaagcacgattgttacccagaaaaatatctagaaaaaaaatatccccatgagcaaggatcaatctctgaccttctctgtgtacatgttcttgagccggctagcctcctcatccatgggctgatcaaggttctgatccaaatcccatatgctcccatggttcgtcgtctcgctatccgaaatagacgccatgggtgggtctccttcaacctcgaatcctcacacgagggaactctccaagtggctgaaagcgacctttgctcgaaccagaaatggaagcttccagcttcccaaatggaactccagagcttctccaccgaagcaaagatcaaccacaactcgtagaactctctctcaccggaaaattccaacccgaatcctcaaatccaccaccaaaacctcttgtcactttggtctacgcaaaggctaatcttcgaagagataatccaagaacatgagcttgcataatccaaatcagaatgccacttcgaatcttgacacttaaactctttccaagatcgaactccctccctctttgatccccacaagaaccaaaaacgggagctttggtacaggagcgaagaaccaataatcacagctaaagaaaaataatctccaaatcagagcccagaaaatcggatttgggactgattgggcgagctacccggaaatatcaaccaagaaaacctcctctagaaccaagaaaaccaaccaaaatctcaatctttcctccccaaagcctccccaagatcaagctttgatgccacagtcgccaccaacagcacagccgccgaggtgggccgccgtccaattggcaaaagcgcagaaatcttgacagaagagagtgggaggatggggaaaaaaatgagaaatgatttatggtgcggagagagagagagagagagagagagagaggggggaagagaaggcaatatgcagagtcataaaagaagttgcaggaagagcatatgcctggactggatggtagtaggtggaggagcacacaaattggaattggaattgaaattaggccatctgaattgaaaattcaaacaaaaaaaagagtacctttttccaaccgaatttcttctgaaatcaaaagcggcagtcaagttttggtgctatggaaatgagaagtaaacgtttctctttggattcttgcccatgagtgtgtactgtctttcctcagctggcaagtccctggtcctgccactgctactattgtactagtaggagtaatcattttattatgttggtgattgtactgttgctaaatttgtttattccttcatctcagaagaaaaatgcctttgtttattgatgagatctagattttgttcttgactttgtttaagttattctgtttgttccccacagaactatctaggagtagtccctaacagtagtactaaggtttagagcagcatatgtgctatattatggccctgtttagttctaaagttttttttccaaacttccaactttccatcatatcaaatctttcatacacacacaacttttctatcacatcgtaccaatttcaaccaaacttccaaacttcagtgtgaactaaacacaaccaatatcatttccttacagataaaaatgttcagtaaaaattagatacgagatcatatcggtaataaaaggacaataggagtaagaatttatacattagagattttatctcaaatcatattggataattaaaactagatgctggaggccaagagttgattttccccattattaggctataatctttaactcaagattcctaacctctactcccttgttaccaatgcacacgttatagaaaagttattgtaaaagatcatattaatctatttttaaaatttttctaatctaatacttaattaatcatgtatgaatccgttgctccgttttacgtg

SEQ ID NO: 62114 - DNA, 1402 bp, Oryza sativa
ttttggaggctttcacacagattttaattattctaggcataatttagaggatgtattttagggtcgttttgggacgtgacagacactaattttgaggccctcagcccattggcatcatggttgggcccatttcgactccaactcctttctaaaagatttaaattaagcaagggtgagtacaaacgtactcagcaagccaccactacagaatgcatttagtgcacacaggggttcaaggatggcttggtttatttgcttaaagcttgttttcacaattcatttcacaaacctacgacttagcagttttaactgaaaacaacgttaagttggagttgtcattaatcatcgagggttcatccaccttccccaagcctcgctaggtcaggtttaccctcgcattctgttttatatcctctttcatcatatcgaccttcccgcacagtgggcaaggtcagatagtttgttccatctctaatcttaagcaaggtcacatagtcaagagtagtacaagtcttggcactcattatccacgagcacgtctatccgaatagattggtttactcacagtgcagtggatgtacgcctttaatcccgcactctgtgacttgcccaacacatgggcctagacctaacacatgagactcgtcacggcccggcttttcagtcattctcacattgcggcacccgctccaaggactatgagcccccattgcatctcgatacaccaaccctacctcgagccagaagtgaggggagtcatggcactcccgagagcagggaatatttaacatatatatatacttatagggtgcattttaggtttttaccagtattttccaatcatcaacacttcaacaacaacactatactcgtacagaacctaccatgactggggtgtcgccccacgagaacttcctagtccatcgagtctctacccacttgttgatgtgaaaacacggcagcttgggagatctgctcaggtccaaagctagcctcgagtgcgtcaagggcgtgccaactgatttgatcctgcaatcagcaagaaagaataaaagcagaatcagtcgaccaatagccaatcggccgatagcgtatcgttgatggtctcagcagatagagttaaaccaaattggctatggactggatatatcaaagaataataaactctcaacacgcccaaaaggctataatactgtatatggagtttaatagattgatttaagacaacattatgaaagtagacgatgagataatatttagagcatgaaaaataaagtactagctaatactctagtacaaatctatataaacaaattaatccatataaacatatcaaatagaaatcaggcatgaagggcaggagtctagccgacactgtctaaagcttgatatgcttatataa

SEQ ID NO: 62115 - DNA, 2860 bp, Oryza sativa
tatcgttgatggtctcagcagatagagttaaaccaaattggctatggactggatatatcaaagaataataaactctcaacacgcccaaaaggctataatactgtatatggagtttaatagattgatttaagacaacattatgaaagtagacgatgagataatatttagagcatgaaaaataaagtactagctaatactctagtacaaatctatataaacaaattaatccatataaacatatcaaatagaaatcaggcatgaagggcaggagtctagccgacactgtctaaagcttgatatgcttatataaaaggatctatctatataagtggggaatatacatgaaacagggagtgaaacatgcatattaggtaagattggctgaaaccccgatactatcgttattatgcctaattgcaggctagtttgcatggttctaagcacaactagggatgatgcatctcaaagtatgaaaaagaaacattcaatctagacaatcaagcaattagacacttttcaggatggtagatgcctcaactaatctcactcgccgcggtgtagcgtctgttgattaattgagataggggcaaattaatacttttctcgttgtttctctttcaatctgcactagatataataaaataaggggttcggtatccggtagctaattaccaggtttttgcggtatcctatagccaattcacgtatttgcagtgtctgacgggtaattacacatcttttaggtgtcctgtagcaaattttgccatcattattatgcctaattgcaggtgtttgcatggttctaagcacaactagggatgatgcatctcaaagtatgaaaagaaacatgcagtctagacaatcaagcaattagacacttttcaggatagtaaatgcctcatctaatctaatctagcatgccaatttaaccgaaaccaacataaaccctcaagcgagcagcagccaatagagctaaattgagaaggtaagattagattaactaagacatgctagcaaagactcgcgatatcgagcctaacacgtctaaagcgacatgttagccctgatagcgcaggccattgagacgggttacctcttgcgaagaactcgctagaaaacgagaaaaataaacgggtggcgatgcgtcgtagttgtgttggattggctctcctattacaatgctatggggttcatatttatgctccgagtacaaacttagtccattatggacacgactcaatcatttctaaagttaagatacaaacaagaccatatacagcagtctcttaccaaatctctaacaaaccgactcaatattctaactaatagatacaattgccttaattgagctctatctcttattggcaatggcaattatcccaatctaggcccatgctgagcccaagttatgttatatcggctgtattggctatcggcttcatcaaccttgatcaacttcatactttgttttctaccgatacggtattcagctgatgcacagtccaactccaagttcagttcaattcaattaccaaattcacttcgatcttcttccttctactctgaatctgatgacaaattccattgttaacacatgccccccccccaatttctgtttcagtagaaacatatccctttaggaaaatatatgtttggatcagtttatcaaacgctttagtctgcaacttgcaacatcttgaaagatgaggcaatcaactatggaggcccttggtggtttgtgcaattatggatcaatatgtataaaaggttagcagtagacatatcatcactagccttatatcagctttcccaacaattcatgctgatggtgaagaggctaacacaaggagatatatgtcttttggagaagcagttattgtatatcctggagagaaccaatcggttgatggcttcaaagactggttcttcatattctactagtgagcgtgcacgtgcaaggcacatttttcaccatttatgatcttctcaagctgaatttatcaattgtgtcaaattagaatcttaagatccatctaacatatgttgtttgtttccatctaaaatgttaatggaaaaaatagaatgtgccgtttccatctcaatttcaaaatagaaacataaaataaatactgagctcgtcttacctagcatgactcaaacctatcctatctttttgttattttctattttacaaatttttatgttgttttcaagtttataggatgcaattggaaagagaaatatacaatgtgatacaagttatctcagtggggggagagatgtctctacccccccccctcaagcttggctttcgctcaggatccttggtaaggattgaatcgctgaaagcggaaatatgcttgaaggtcatcatgctgttgctgcgtcatgttgttgatgttggcaaattgagcatcagcagtctgttgccattcttgcgtctgtgctatgtgttccatgaggttgtattagatctctcccgtttgcacattcaccattctcctagtgatttcacccaagtcccaacgagaggaacttgagcgccattcacctggagatggaggcataccacttgatctagggggttggttgtgcccccactgtatgtcatgaggcacattgtcgcgtcccaaaatgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaa

SEQ ID NO: 62116 - DNA, 950 bp, Oryza sativa
ttttagattcaccttgttcatcaaaaaggtaggggggcatgtgtttacactcaaatttggcacctaggaataaaatagggaaagttgccaaagtttggaagtctactggtgttttcctctggaggacggtctgaccgccgtgtataggcctgtcagaccaccgcttgaactccggtcagacaagtggtgtgtggtcggtctgaccggcagagtccaagtccaggactgtttcgtcgggtcacgaggtttccttgctcgggaaggcatatttcgggtttcctttggattctatcccgagttggacgtggaggagggcctatagagggcaagaccaacctatatttaagggacatggccggttcattgtaaaaatcaatcaactatcaatcaatcgaatcgttcttttacttttgcttctagttctagtttagtttgtccatctttgtcgatttgcgccgtaactcgtccgacgccgctgcgagattgcgacacctctttgtaggtttgtcctgaaaaccttcccacgagacgagtagctatccatcgttctacctagaatcggctccgctagccggtttagttatcaaaacccatcttggtttagctttggctagattgaggtggttggcgactctgagatcgccgcaaggcgtttaggtgctgcgatcgtgcttgtcaacttgtcacaaaaagttgccaacaactgcgccctacagctcgcagcagaatggcgtcgtcgagcgccgaaacgacatggtggtggtgacgacaaggagcatgctcaagttgaagggactgcccggatggttctagggagaggcggtaagcacagctgtgtatgtgctgaacaggtgttcgaccaagagcgtggacggcatgatccccttcgagacgtggcacaagaaagaagccggcagtacaccacctgcagatgttcggctgcatcatct

SEQ ID NO: 62117 - DNA, 10680 bp, Oryza sativa
aattatctcgttgcaaatattgactagatacaaaccaatacgcaagcatgcaacctatgcaaaaccgtcttcttggcacaaatggtaagccgattttgtctttgggtgcatacaagaaaaagtaaagtacaaaacagaaatgaagcattcatttgctcaactacaaaattcaagccagggggtacacaacctcaagacacgtacggttgagaacttgagacaaaggcagaacaaccacctcattggcatcatcgatgatcgatcgatagcgtgcgacacaaactcatgaaatgcagaaatgtgtgtgttgtattgttagaaaatgacatctccaccatcgattttaatttattagaaagatatacacgccatatactcttattaagtggttttacgagtgccgatattaactacaacagtatatatatagatcacaagactcatgaaaagcatcataaaatagggttaatatgtttttctgaaattaacacttatatatagcaattgataactcgggcatccgttgttatatcggagttttccttaatttacatgagaattaaaccgcttctaatttattaatattaattataaagatgcatataaataatttgttaatcgcgaatttgaagatgattctggcgttgttcgcggcgcctgtgtaccacgcagccgtcgtgtcacagccagctgcttctttacgcaaatgtgacagccgcagcagctgcctagtgcagccaaacggccaaacacatgccgtatgtgcaattttattttacttgatcaatcagaggcatgcaaagcatgtgtggtatatatatttgagtaaattaaccagctaacaaagaaattttcttaccgtatagtcattatcctcctctgatatattgttaactctagctataggtttctaggcttctagctaaacttgtcatattctttgtttcttgctagtaatggatatgctatttagatcctgtccacaatgcttgctgctgacttgttgagagttgattatggaactatatatatataatcttataccacactacattactactaacatttagtaacatatttaactgagtgacaacttttgatgatagtcaaatcgcattagaagaagaaagagatgccataaattaattgccactactgtagacaaggtacagcgtctctatccaagctgccaattaattttaagagaaaaccgaacgcatgcaggtgtgtgatcacgttttactcgatcggatttataattttctattctattactttaaccctctacatatggattggttaaccaaccgaagatctcgattaattaatagcatccataaagacaaaatctaaatagtatacataagcactatttaatcttaacgggtgcacactttgctacgtaagaaagtgccacttattatacaagtacatcaagataaatactctctccgaccgtttaacgagtgcacattgttctaatttatgatccgattacaccattatattcgttgtaataaaacatttataataagatctcacataattatgttctaatgagaaaatatatatgctataaattatttttatcatatatataaattactcttagatttgattaaattacttctgagatagttatgaaagtaacttcaataaaacctaaaagtaatctacataaatcataaaagtaactcaatacataataaaagtaagctgtcacgtcactaaaagtaaatccattgtggaggaaaaacacaagtctatcaaaaaactaaatttaatcatcatagattatagagctaactaaaacaacaataaaagtaaaaactcacaatattatgaatatctaaggagtaatttaattaaatctaaaagtaatttatatatatgataaaagtaatatatatatatatatatatatatataatatgtaatttattataaatacttaattacaataaataaaatggtataatcgggttgtagatccgataaataatttaaattaaaattgtatatgaagcttatagttattaggaatcttttctagtctttactattatatggatactttcacataggaaagtgatgcatgttatattttggtaactaattaagactaactagtgtacatgcacttcttagtggcgtccatctataaagctgtatggaaaggaggataaaattggagatgaaaaaagggggcaaatagtacttaaactgaaaggtattgtcttttttttcccctaaaaatactatttttagcttcactattcagtatcatagctaggaagatagtctttttaagaatgaagataatacaagctagacagcgaaatgtaaaaaaataagttccaacctaattcggcaacatatggacttagaatatatatatatatatatatatatatatatatatatatatatatataacgagtttaatgctctaagcatgatgctaattaaggtagcaacttagttcaatccgatccgggtaactttacattcaataaatgtgtagtgtgtagatatttatcttgctccccaacatataatctttattattgtgttgttacttttgtatggatatattagttgtttaataacacattgatgtttgaatcctattgtatctgtcactgctgatgtgcgtgtttcggataaaatgtaatgccaagtcatcaacggcgacatgttgcggaaaaaggttaacttgtttgactaaactaagataaagtgagagctcatatgaagcactatagacaaaaaagaagtttcaacatcttgtggatatttgcatgattgagcgaaaaaaatttcttaaaaatcatggtgtagtcttgaggctgtatcttgggaagttcatgaagacatgcaaccagaagtaaaatcaggggggcaaggatatgtatataatattgcaacgagaaaaacaataatataaacatgattaattaaaaatgagaagttatgcaggggagtgcctatctcaccttaaggaagtggctcttcgaccatccaataaacctttttttttggttctcaaaaaaaaataaaacccttttttttttttttgctatgggtagaaatcaaatttgtgggggcgttttgagatttataatagcacagcttgcagataaactccaagaaacagcaagtccatgaagagttgttctgatgcatatctcatgaaatatatatagctacttctgcgtgcaatttattcacctattttttatttcaatcaattacaaccttcgttcatttaattttaccccgctagctactccctcattcccaaaataagtactctctccatttcaatttataagacgttttgactttggttaaagtcaaactacttcgagtttgactaagtttgtagaagaaaataataatattttcaacccaatataaatttattatgaaaatatattcaattactgatttaatgaaatgaatttggcattataaatattactatatttgtctataaacttagtcaaacttgaagtagtttgactttgacctcaaaacgtcttatgacctgaaacggagggaatatttctagaaactcaaattttgtatacatttataagcatttcttagacattaatttaaatgcatattcctaatttctatttcctcgttttctgtgcgcacgctcctcaaatcgctaaatggtacattttttaaaaaaaatacataggaaaggtgctttaaaaatcatattaatcttttttaagtttgtcaaggttacggataaggtataccctctatccttggatatacggtgggtaccgatacagtatacccgcgcgtgtacgaatagtttccgtatacattaaagaaatctatcccgtgatagaaacggaatctacggatggaaggactcctactcggacgagactgggtctttaccatatcgtgaggagtccgatatctccaagtcctacttggagatcaactgacccgcggtataaaagggaccccctgggtaggacctaagacatcgaatctcaccgccaacacacccactacagcctgcgaagtcggagcttacaggagccaagtcgccgggagatctagtcggaccaactcgactatggtctcgtcggtattatcgagttcttctattccctttgtaatatgtggtttccatcatataatcacatatcaactggattagggctattacctgttaaggggcctgaaccagtataatccttgtcttttgtctgtttgatgtcgtactacgtaaatcctcgtatcaacggaccccagtaccctctatatccggtctacgggtatccaccgtcgacaaagtttttatagctaataattaattaattatgcactaataatccatcccgttttgcatgcatgggagagaagttcgcaactttctctggtaaacaaacccttaaatcttttttagggaaattaagaagcctaattcttgtactatgtattagacaaaaaaaaactttattccactatctaattaagaagtcagcggtcttgtgcccatgtatagaataaatttcacaaaatatctatattttggccaattaattagaaaattacaaatttaagtcacaccataataaaactacaaaatcaacactaaatttatcataaacttcattttagttaatgaatgtatcctaaaactacttattttaagtttagcattcgaggataaatcttagaaaaaaataattatggcaatacattaccaatcttggttaactaggatgattaaccaaaataaatctaaaaaatattgttatgacattcgaatgcatgattaactgtagaaaaactgttgcataggcagttaatcaactagaattcttattattacgaccatcaatttgactagaactatgtaatagtccgtacataatcatggcagacacataaatatatccgtgaaagatttgttggtagacgaaacatcatcaatggaatacccttcaaattagcacaggtattgtgatataaagtttaaaatttgtagtttagcaataatctatagttttgcgatacactgcttcactatgttgttttgagatattttctatgtttaatctgttcttttttgcaatttagtgacttaaatttacagttttatgatcattgtcaaaaggccgtatttagttccccctctaatttttttttcgtatacggacacacatttcaagtattaagcgtagactaataacaaaataaattacagattccgcctgcaaactgcgagacgaatttattaagcctaattaatccgtcgttagcaaatgtgtttactgtaacatcacattgtcaaatcatagcgtaattaggctcaaaagattcgtctcgcaatttacatgcaaaatgtgcaattggttttttcatctatatttaatacttaatgcatgtgtctaaatatttaatgtgacggaatttttgaaagtttgaagggaactaaacacaaccaaaatctctatgcaattgctatcaagtagttgggaactaaacacaaccaaaatctctatgcaattgctatcaagtagttggggtgtaaaggacggtcctgtctctgaaaatttgcttcctgacaataagacagttgggccctccccccacccccacacatccccactaacatattcttatagtttgttatttcgtaaagaaaaattgatgatagacaaaccagtctttctctgccctcattgactgctaaaccaacaaggatgacaggatatggaagtactccctagcatcccagaaaattgtaaaccctagtatcccaagaaaattttaaagagagaaacaaaataccacaatacctttaattaatgtgaaagttgtgtattgatgggtagatgagaggtattgaagtaatgaagttcctcattttatgaattggtggtagataagaatatagaagttgatttattttggaacaaattttaaactctagaagttggtttattttggcacggagggagtaattttgtaagggatggtgaagagatagggtacacatgatttccttcagtcgggtgtactctatctgtctcagaatttgtacgtgaatttggatattacctatagcctatgtttagattcatatatgaagttgatttcttctgagacagatggagtatatcatatatagagtaataaaaaacaagaatttttaaaacatatacctgcacaataatattggacccggctaaccttgttgccttgttggtccatctctgcggtgtttcaattatcttcttggtctggaccaggatttggccagtatgacgatgatatttaaataaaagtttaatatatcctagatacggtagcgctaaatcatatacaacagcacgctacgatatatcacgcgccctagacaaaaaatatgtgtagccatcgtattataaaaattcgtactgcagtaagcaatgagattttcagaagactagcttggttaattgagaaatttatcaatcttttcaccaggtatctatattgtctacttatttatcattgagaccagatcgagggtggatatgccaccggtgcatcactactttgctcctatcataattcatgcatgcttcaaacattattgaaatgagatcatcaatagttttttttaagttaatgcttaactaatcatgtgctaatccataattttgttttgcgggttgaaggaagggttcctaagggtgtgttcgggaggaggacctctcctctccggcacatattagcgtatgattaattaataattagcttaaagactttaaaaacatattaaaatgattttaaaaataatttctatatatatttttttgtgaaaagtacatcgttttagcagtttaaaatacgtacacgtgaaaaacgagagagttgaagttgggaacacaacctccccccaaacggacccagggtacaattagtctggctattagggcctcgaatgcatggtacaattagtcgctctcccattgttttattttctttagcaaatatttgttgagccgtgttatatttatttatcactaccatttttttttaatttttccttttcattgtaactcaacaactttattttttgtcttgtatgggaggatcggatggccacattttttttaaaaaaaagaaagaaagaaagaaagagccaaagaggtgtgtaccatatgcaggatcaagtagtgcatattggtcattgtctataataagtacgcaattagagttgttgcttacatataataattaagaaacaaagcagttgttgcttacatacgattagtagatcactccatttgaattagagtatgtgcaatttggtatgcaagagtataccccacaacaatctttgactagctagctaatagtacaacacaaaacatcaatcgttgatcccggcatatgtaaaacaaaacgatgaacaggtgttgatcaattatgcaaaaatcatgattaatttgagcaacaatcctttctcaaaataagataaacaaatgtatgcttatgctacgaatctgtccggatatttttgaccgacaactgatgccacaagactccaaaatgtgtacaaaaataaaaagatatgatgtatagtataaatatatcaaatgaagcaagagtgagagctgggagaatgataatcagaattacacacccatatatgggtcccaatattcagatggccttttgttttccttgtctggacagtaggcaccagtttgctttgcagtagcatccttgtactgtatacctactatttccgttttaatgtaataagcttgtgcacaaatttttttaagatgttttatttttggtcttgaagactaattgatttttatttcggtgtagtgcatgggtggacgaggttgtccaatttgtcggtattcctctgcatattctttcggttacaaccttgactatctatttaacatgtgagaatggtgtgaagctatcatgcatcttccccagtccccacgtttaatttcttttttttttcttttgcgatagggctgattatcaagttaaggctcctctgaaatgcagacctgagaaaatagaaaaatcataggattttaatataaatattagtgcagaatagatgattaatttctaaaacagaagaaaaaatataaaatataggaataaccgtttgattagactataaaaaatgcatgaaattgagaattgataaatacttaaagcaaactttccatagggttggatctcatgttaaattttctccaaaacttacatggattgagacattccataggaattttatatgatttaatagtgtccaatcctttgtttcaaaggtccatatttcaggggaattattatgtttttcattcaaatcaaagtgggccttaacatcaacattctatttttgggctcatttggaacacactagacactacttttgtacggacctttttttttttaacagaagttcatcgagaattaatctgtttatacacgatcaggtcttagtattgtaacagagctctcttgtatttggtgcatgcatcaggttagtcacttgtcatttcctatggattctagtttattttcagttccgttcttatacataatcctcctatgtattcgtgagaaaagctatgtaacatagatgagaattgtcacacgaaattaccatcttggtgaattttgttatttgttctctggaggcaggttcctatgttcctgcttttcagtcccctgcttcccagaatttgctaaaatgctaaatgcatgagccatgaaactcgattcgcatttcgccagcacagttcttgtggtgaagtctgatcctacttaacacgcattcgaccatgctcattataaaattataaataagtaactcaagatttataggatgcaacaaagaaactactgtcgatatcaatggtaggtcttagctactctcattccaaaatgttggaggaacctgagcaaatattggatacaggtaaaagcgatcacttctttttcaacttgaaatgattaaaagaagtgtatgtcctgatacggattctacccattttaactctcctagtggtacggattctacccatttttactctcctagtggaaatcgtagtagaagtaatcgtaattgtttttaactctcctagtgggaatcatagtagaagtaatcgtaattgtttgtgttttcagataaacaatgtgttggtacaacaaaggattgttcttcaatatgctggtcctccaggactgctttaagagcataatgaactaaggttgtcatcgtgaggatattccttatttagtacagactgtctatattagtcctatcaatttaattaagagatgtttgaggaactgaataacacgtattacttaccataatatggtgataacaagatgaaggaagattttagagaaagtaggagcatatggtagataacgatctagagatcgatcaagcaaacttgccggtccaacagttttgaacggataagtgtaagtataacattaatattgaacactactctatatacacacacacagagactctatgacttctgggatgtttttttttctcttacgatgaagcatatgaaacatatttagaaaaggataaaaaaaatcatggatctactagatatattgaatgcttacgcattgttgcagttgctccgcgtaacaaaaaggcacacaattaccacatgttaaaatatattgaacacattcaaagaaatcctctgatggctttgatacaggaaacttgttttacaaaattgcaaaaatatatccttttaattggcggctatcaaatagatcagaaaatgttacgagatttagattaattgaatttagtataagttcaaggcatattagagctctaactaatattgctgtgattggtttaataggtgttttcttttacggttcatattctggattgggttcatctctatagtaattggagggaccagattgtacatatgaaaaaatatgaacttagcgggtccttaccccttttatcggattagagcggaaaggacccgcggaattcttactcttataaccctatgaatctttttttttgaccggacctatgaatcttttttcttcctattaacattgatttgggattggacggtttagaaaacaaactatgttttgatacaggaaatcttgtttttacagtagaacattgatttgggattggacggtttggaaaacaaactatgtacgcagcattttccagctatgtatagttgattaattgggtgaggtggttaaatccaccttcacaagttttactcaattgtataaattttctcggctattaccatcctcacaaacaattatcaattcaagtagcatccattttggaatggtgtgcacaaataatgtttagaatttttaatggcatatcaaaataatatgcagggccacaaattgtatacataaattaagttgctcttttgcagtttgttacatgttgggagcaccaaccgtagttcacggcatggttaccatgattaattccaggactattataaaaaaattctctaagatacaaagtggccagcaagctttataaaatgagaaattctcagatgatgtgaatgtaatctacaggtttgtatacaaaagttaaatggaacattttttgggttttggtatctc

SEQ ID NO: 62118 - DNA, 585 bp, Oryza sativa
cgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatgatgaacaattgcgacgttcgctttcgagcgggcaggtccatggagtgtaacaatgagagaataaaaatcgacagtgtaaggcaggaaggcgacgcgttactgtgcacgatgcggacctcgaaacgctctagtacacagcacacgca

SEQ ID NO: 62119 - DNA, 32553 bp, Oryza sativa
ccccacccccccccccccccgtgtctgcctactcatcctattcttcagtggatggtgaacgacctgctaacaatcaattttatgtctggttagttgctaaatgaatcaattttatttctggattttgtgatgcttgtggccttagcagcaccagttgaaggagatgcaatgcgggatgagttggtggtgatgatggggctggcgcgggagttgacggccatgcagcgagctcgagcaatgacttgatgacatcatcgttgcaatgcttaatagcgtagctcaatggcggccctcgctcgcctaatatcacgcccagaaattcacgagtaattttcgaactaatttgtacattaaatccttgtccaggaatcagcccaggtacacaaactgacaatttaatatacagattcatcaaaataactaaaacgataaatacttacataaaaggcacttagtcctcatcacgaagaaaactgcaacggaaaacaaaatctagcgaagcttcagctccactcccacaggcagctcaactgggatctaagccaaaggtcttctccttctggatcctttttcttcaactgagatttgatgattattgcaaggtgagtaaatgacatactccgcaagccacacagcaagtatgcaagtgcataggaataccaaaggatggcataatatagggttcatttgcgaaagcagcatttagcaaagatttaagagtagtaaaactgtagaataattaatcatcaatattaatcaatcactgaacagcacacccaatgctgcacaggcccaaccaaacctgaacaaccaactccggtcgtacagatcaaacctccaaaccaggaattagccattccaaaccaggagccaaattaactttcacattattatcattgatgagtagtgtgggactaatcacgaaaaatattgttagacccgcccataaccacgggcacggctattcgaatagttttactctggccagaggtgtaccactgtacccacaagacataacctcaacatcatgtctaccatgcgtcgccatactggaaagtacccgaatagaggctgtgacaatactccacacaacacaactcaccacagtgcaccgttcctgtatcataatcaccccctcaataaccagaggcatggactccccagcgacccccacggacttttcgccgcttctcagtctggcaccccgtaatgaaccatgctatacaaaaggtaaagccgttgcccatgctgacttatggttggcatggtaaatgtttcacaatagtagcttgcgaaccagtccttaattgccatgagcacgaccatcaaaaccatgtgctcacaacccaccattaagtaggttttaattatcaattaattatcttaacacgattaaccatcgtgagctaccattaaatataaccataaataaatatagtatgattcatcccattaatgatctaatgtttctaagcatggctaagcaattatatatatagcatttagctgaaccaaaccaatatataaggttctaactaataaaattattacccataggaaaaaaaagtcatcttcggccataattaaatgggaaaggctcaccacccggtgacattcgaaaataatgcataagttgagataaaacattagctttaaacgggttcaacatgttcaaagggttgtttgggatctgtgtgacttgccttgcaaacaagcgtcttcaatacatcttcaggaacttctccaccgaacaaacgctgcttcgaaacgacaaaaactaaacctaaaacgcaaaacgagaaaaaacactaataaaaaccaaataaacagtacaattaaagttcataaatgggtagagcttgaatttagatgaattatgagacttgaacaaccttaatccgagttcgtatgaattagttatgaattaatgaagttttaatcaattaaaacctataaaagaaaacaacctaaacaatttatgacatcatatttaattaatgttgcactgaaaagggtagaagacgacatcagccctaggattagagaaaaagagctggtgatactgataaacgggacccacctgtcatagagacaggaggtagcttgatccaccatagactcagttcacagagagttccataagatggatgactaggattagattaaccagagttgaccatgatccaacggacgagatcaaatccgatctagggtttaggatagcggccacatggcaacacgtggcgctgacgtggacgccacaaggacagccacgtcgacacggcgccggcgagcactggatggcgacgaccacggcaaacagcggcacgacggtggacactgaggacaccaacgcgaagagaagatcagcacggtccttaccggcacttacacgatgacgggcgatgaaaacagcggccggcgacgagatggggaggatggtggcggcgactttacggcgaataccggcagagaaggggtggacggccttcggcttggcgctgcgatgcccacggaggaaacggcgaggttcggcgaccacaggagaagcggcaaagcttcgccggagatcaaaacatggcgacgattcggccttcgcggtgacggcgacttccagcggggtttggcgcaaaggaacgggtggccggggtagctctcacccttgcgaagccgatggaggtggcggcgcaagtcggcgatgaccagagaagtgacagacgacggctggagcgatggtctgcggcggagagagaagccgaacgtggggaggtggcttgggctagggaaaaattcgggaaaaagggaaaaacggaagaggaggccgaggggctgctatttatagccggaagaggaagagatcgactcgggaacagtggcagagccagctgttaaaacctgtggggtcaaactggtaaaattgtttaagttttctaatattgcaacgcaaatatcaataatttttgggctgttttgtaaaaacctgtggggtcagctgaccccccagattacacttacctccgccactgctcgggaacggatggaatcggcgacggattagttagggttcgccggaaaaacggagctcgaaacggcgtcgaattcacgcgatatataacgggattcaaaggggtttcttagggataaggtagaggagatcgaggggaatctgtttttgcaaccaattttgagaggggagcaacggatgcgacggattttgcggaggaagcggcggcgcacgcacacggctcgggctctgaacaggctcggcttggggagcaacaatagactttcctttctttcatgggctggtaggaggagggatccaaatcggacttcagccaagagaaagagggagagtgggctgctgcgggctaaggaaaggagagaggagagggaatgggctgaattcggtccagacaaaggagaggatttaaattactttttaatttaaataaatactgaaatgatctctcatttattaaaaatactttcaatgctcaaataaatccaagaaaaatactgaaaatacttggacacacaaagtacttaatgaaattttatctagctcaagttaatgttcaaatttttcatagattttattcacacacttactttaatcattaaataatttctaaaaattccattttaacaacgatttataattttgcgattttcagggtgtgacacctaaccagcttgacaggctcgatgtcggccgtgtcgtgagcctgtcgcatacaccggatgcccgaatcttattgttgcaatcggcggagaggccagagcgccggatcttgttatcacggatggagggaggcggcggagggagcagggagctcgttccccggtgagggcgcggtgcctgtggaggtgaggactgtggttagggcgcttaggtgtcgtgccgtcgaccgccgttcccccgctcgatctcgtcggcgtcggcgtcggcgctgccgtcctctcccgcctccttgccggccattgagctgcccgttgccgctctggaacccgccgtcagctctagcccgccgccgcgccacttcagccgtactccccgcgggcggccgaaggagagagaaagagaaagaaagagagaagggaggaagaagaaagagagagaggaggacatgtggggcgacatgtcagtgggccccatattttttatgtgtgtgagtgacaaatgggtcccacgtatatgtttttaattcaaatgtcacgcaagcgccacgtcaaccccatagactaggtcaacaccgccatggcagcgccacgtcaccaaaaccgcccttcaaaaccaccaagggagtcaaattgcaccggttttaatagttcgggggtcgagatatccggttttgcggtttaaagtcatggattagattgggttcacttttaagggagtgaaagtgaacttattcctttgtctaaacaccaaaccgcaccgaaatgggcgaatttcggaaaaattccagggttctgggattcaattacagaaaaatttcgggcctcaccgaaatgggcgaatttcggaaatttcggacaaaatttaaccgaatttgttgcaaaatttaaacaaacatttgtaaatttgaggcaatttgttaacaaacatcagcaaatataggtaaaatgtttaggcaatcatataagcatcagcacacaaggagaattacagcattggcacatcccaagcactagcgaagaatacacgcgttgcagctccggtcggagcatagcatcagcaatgctaggcagttgcattacccctattactcactgacgcagttgccttcaccgccggcgcctgtgttgcgcacacggccgccgccgatttggccacatgagagcatcaccaagaatgagtattgtggaccaggggagaagatggtggaggggggagatagatgcctaggattcaggtgttgcggaatggaggaggaggacggcgacgcactgctccgacgctggtggcggcttgcatctcgcagctccatctaacagctgccgccaagggaggggacaaggagtcaaggaggagaaaagtgaatgaattctagagtggactttgaacttttatacccaggaacgatatttgttggcttgtttggtgtttgggctggcctgaaaatttaaattaggccgaaataatttggccggtttagtattgtctcgggctgcaccgatatggacgaaattcaccgaatttcggcccactcggtccgaatcccagaacctaccaacaacccatttctccccatccagaccagctccatttaaagaaccaaaccatttggcacatcatcatcatcatcatcatcatcatcatcatcatcatcatcatcattattattattattattatcagtagagtaaatttcacaaaactacaagtattttgtataatctatcacaaaacaacatatttagaaacttgtttcacagaactatagatttaatatattagtttatcacagaactacacatttagtgtcttcatttatcacaaaactataaatttagtgtctccattatcacaaaactacaggttttaataatgctgaaacctgtagttttatgataaaacctatagttctatgataatggagactctaaacatgtacttttgtgataaatgaagatattaaatatgtagttctgtgaaacaagttcttaaatctatagttttgtgatatattgtgcaaagtacctatagttttgtgataaacgaagatattgaatctgtagttttatgaaataagttcttaaatctgtagttttgtgatagatcatgcaaagtatatgtagttttatgaaatttactcttattattattattattattattattattattattattattattattattattattattattattattattattattattattattattattattattattattattattattattattaatgaatagtgtggagctaatcaggaaaaacattgttagtcttgttcataaccgcgcacacggctattagaatatttttagtctagcgagaggtgtacaaatttacccacaagatttagcctcaacatcatattgaccatgcatagcgatactggaaaagtacccgaatggagactgtgacaagacacttcgcataacacaattcaaagcattgcaccttcccgaatcatagtcgccccactttaaaccaatgtatagactcccagcgaccccgtgggcttatctccgtcacttctcagtctagcagtccacaatgaaccatgctatacaatgcatccggttgttgtccacgctagctcatagttattatggttaacgtttcagaacagtagctcgtgaaccggttcttaattgtcatgagcacgactatcaaaaccatgtgctcataacccaccataatcaagttttagttggcaaatttattatttaagcaaacatgactgaccatcgtgagctcctattaattagatgacaataagtgatagtgaagcataagttatccccttaatgagctaatgtttctaagcatgactaagcatcatgatagctttagctaaaatcatataatgttctagctaatcatattattaacctatttacaaaggacaagtaatcaatgtcaaaggggcataacaaagcatataggtcaaccctccggtgacactcgaaaataattcaacagttgaatagaaacaatagctttaaacaagttcaacatgctgaaaggggtgttttagaatctgtgactttccttgctgttcttcataggcttccaaaccttcttcatcataaacggtctcttcggaacgtcggaagctaaagcaaatgaacaaaatcaacaaaacagtaccaagcataaacaatacatatggatatttttaacaaatagatcttgattttatatgaatttagagactgaaccacctaaatccatgttacggtgaattagttatgaattttctaagtttaataggatttaatccattaacagacaatgtttaagatttatgaagaattatttttaaaaaggaaaagggaattattgtgtcatcatggatcgggtccacattagaccgggtgcacagaagcggtccacgaacagctcagattagatcggcttgccacgcaagcagacgatgaggtgaactggttgggcgacgtggcgctgacatcatcgatgacatcatcgcctgcggcgactactcgggaccctgtggtcaccggcaatctagggcacggcgttgaaaacggaaggcgccgacatgacaagcgtgacggggaacccaccggtgtgcggcgcgacggcaaatggcgacagacagcgacggcgacaaggttggagcgacggcttggctcggatcatcggtggcggcggcgttccagcggtagtcaatggcgtcgggccggtgtatggggtgcgtctcctccttgcaatcccaaagaaggcaacgggaagcggaggcggcggcgcggtgacggcggcgctagggtttgcagtggcggcggcgctaggagcgacggcgacggacggggcttgggaggatcggtagagtgcgattagggctacctatttataggcacagagggagagattgagcccaacacgatcgcggtggcgccgggaaaacctagggttcggtttggagagataaggttgaatccgagctcgattccacgtcggattcaaagggataagagccgattcttggggtaaacgggagaggaggataaggggaagatttcccctcaccgaatcggactcggggcaaaaggtgacggcagatttaagagaaaatcgacggtgagattagacggtgccatgtggcagccaaggagcgtttgtaggaataccacatgacagcttaaaagcgtttatagaaagtttaatgaattttagtatatagtagatagtgtgctaaagttagtgtagagacgatatattatacacattaacccttagcttatatggataaaatataaaaattgaacatgtttttgccggtattttggtacgttgtccatgtatgagtcgatttttaagttcgtttgtttttttaaaatacatattcgtatttgagtcggtttttaagtttgttcgcttttggtgcttttggtaatacagaaggaatcgtataagaaatctcacagtgaatttcatcttaactaaactatataacaataataagattaaaataaacttcacccgttgtaaagtacgggtattttttctagtatggataaaattaaaggtggtaattacctcttctataaaatttgctccaagtcctctagtaagccggccgggctgcaggactgtagttagccttgatatgccataattgtgttttacgaattgttacaagctttggctgtttgcgtgaatatgtttctttcaacgggttcacgttccaatcttatctaataaaccgatttcagggttagaactctagttcttgattgggacaggtggcaccaatcttagaacaccgatcgaattcttggctggagaagcgcaccacgtatcccacccctccagcagcggtacgatagcatatcgacggtgaaaaagacgtcttgcggacttaaatgtatattgaaacttttaagaggtcttttttacaaaatgcgtgatctcatctagaacagcccggaagtagaccaaaatatcctctgagaaaaaaaagaatctaataaaaaaatcaacaagcggttagccccatcacgtggcctaattccatatatagttttgtcactacgcatagccatttgattaaaaatctggcaaaaaaaaaaaaactgcccccattgcaatctttgagtctttgttcgaattgaagataaatctggaattaatacaaatgaaaagatccgaaaatgtggtgcggattgtaaagaaaataaggataaaaataaaaaagccaatcctgcccacgagccgctgccatctcccctcccacaagacgctatcgtcaaccaccggattcgtccgtcactcaccgtgagatggtgctgtcctgctgagccgtcaaatccgaggaagtcgacgcggagcttcgctgcaggaggtgaaggtggagaatattagagagaaatgagcagctcaacatctgcctgcatgcctgtgggcagcggggagaaaagaagcaaaggaaaggaagaagaaaggtagaagaatgacagcgtcttctctctgtccgcccgtgaggccgtgacgacagaaaaaaaaagaggaaattaggaagagcggtgaaaaatgcatcaggaggactgagtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccatgcctaacgggccgtgccgaaacgggccgtgccggacccgtgcccgtgccgtgccgggccgggccgcccgtttggccacctctaggactgaggggagcacagctgtccactggattgctcgatgcactggtcactgggcagaggataagactatactgttgatgagtatcaataaatacataaatagtaaagaaagttagtactaataaattactcattgctggtttagattggtaccatcttaaagcatattattttgtgccaaaatttataaatatgtggatgcatttagttttgttactaaatattagtgatgcatagggaattttggttacaacacatttagcctatcctactaaaacttaaaattattgccaatttatcaaattattaacattacaaaatttttgacaggttcgtttgggcactaatctaaacatgcctttaacttttaaattacaatgttttaatggatgcaaaatagttataattagcgtaaaaaatattttacaatatttatataacttaagcaaattgcggttaaagtttatacctaaacaacaaaaggtagtatcaaataaaaaagaaacagtggagtagtagggttgattgttacatccaatttggccacatcatctgcttattagtttatacaatgtattgcatctaaaacattatctccaatacattataattatttaattagcttattcatttttatcctatacatattactctccaatttgctaccttgaagtttgtaaagaggtttctccttgtataaaggcctgaagggtgactctttctctttctctttctcctctcctctccctcccacctcacccattttcttaaaacacacacagtacatgtatgcactcacaaagtgcacacaatcatctctatgaacctctatgaatacacacaagcacaccacaatcctatgaatacctctttgttgatggatatatcgctatcactgaaaaataattagctaaacccagtggactggttctaccacaaggaacttgccaagttgagctacgctcacctcgcctccacctcaccaattaatcttacgtggcaccttgcagcttatgcttggatgttttatagtacttgctctaaaaggtttgttacgtactccctctgccgcagaagaacatcaccttttgaccaatcaaactaaggtatacacatttaattggaattttagaaaaaaaaaggaatcgataaggacgtcagtggtatttctcctcactactaatttgtaggagaatcgttataaataaatttgtctggggtggaaggaatagaacaatagggattttgttttagttggtgagaaaagctctgtcattataaggtggcataggcattaagagactatgtgactaagtggacaaattaaataagatatattatgattgtttgagataagagagtaggtactcaattgctatattttgctatattgtaagacaacttttaaatgttagaaattgctatatttgaaatgaagggagaatgtttttttattaacgatcttttttacgtaaaaaacactacggtcgttatttaaaaatatctattttgcaaaacctatttacaaatggaccatggtttatttagctgaagatgaggcttgataattaatgctttaaaaataagtatatttcaaacaaagtacacttacataaaaactccttttaataactccagcataaatagatgaaaatatgataattttaaattaaataactccacatattgaattaagaatgtaatggaatcgagctaatcctactcaaaatctctcgaaatttctaagttgatatatttataaggatgggttaaaaaggacgcgccaaatggcgcgctaattttctagtgctttctgtttggaaatagtatttcttcttagctgtcagttgacggttactacgtccatgtgctatgataatcacagagtatgtattattaatttggttgctactagcagaatagaaggattgctaggtaaaaaaaaagtaaagtgcacggacggtccctaaacttacgtgggtgtgttacttaggtccctaaactctcaaaatgaatttttgggtccctcaacttgtctcgggtgtcatataagtctaaacgggttcaacccactctgtgtgttgatgtggcatgtcatgatggcgcctacgtgttagcagaaactatatgtcagccacatatagaaaaaaaaattaagaacatgttttttccctcctcttttttcatttatttttcaaaattaaaaatatcattttctcctctctctctctctcctcttttcttaaattttattttcttcatatgagtgacatgtggatcccactgacatgtaatcgtcaccgtggcatgtcacgtcatctcacagagcgggttgaagctcgtttggacctatatgacactcatgataagtttggagactcaaaaatacatttcgaaagtttagggatctagatgacacatccgtacaagtttaagaaccgcccgtgcaattcactcaaaaaaaaagaatagaaggattggttctctttattttgttaggtgccattggaattaagtttcctgatatcactgttaatcccgttcttatcagatgatatgtcaggatgacgagaattcctgtatatagcaatggttgatgagcaatgattacgttcaaactatttcagaattgattttgtggtaatttgaggtttgtagaaatcatacaagtaaagcaaaaagttctatctgttgttcctcctggttgaacagagattatggaatacttggtttccctttcaatgatcaacccacttaaccatgaatagttggcagtagtctgattgttcaatctcgaaaaagtgttcttctatctgatttaaaattctgagcaaatggtgaggaaaaaaatgttttttctcaaagggttaatataacaaaaaaaatgaatttctatattcttgtcacaacgtacggataatttgctagcatatactccctctgttttcaaatatttgacgccgttgaattttttaaacatgtctgaccgatcatcttttttcctatcatttgattcattgttaaatatacttttatgtatatatatagttttacatatttcacgaaagattttaaataagacgaacagttcatgtactaaaaaatcaacggtatcaaatatttagaaacggagggagtacataataataacccaagtcactttgcaccaaacctgacttttttggtaactgggagtttagatatggtaagattaagtggcaatttgatttttagtcttgtttggtaagggtatgtacaaccgtctttattagtggctttctctattaacatgcaaataaacttggtgatgtgcaagaaagggaaaaaagagaaaaatagttgttacgcacgataacggctcagagtcgactcttagtatttattagaaaatattttgttgcatggggttgaaagaaaggaaagaattgggaaaaaatatttttttcgtaaaatatatatcgagaggcctctcgatctggtcctatcgcgtgacgtatccagggacatcatgcacgggagaagtctactacatgcatgttttttaatagatatgtatgtcttttttctcttcaaacaaagttttctctcaaattacttatccgatctacaatccgattataccattgtgttcgttataattaaatcttcagaacaagatctgacatgattacattacgatgaaaaaaaattatagttgtaaattacttttattacatatataagttactgttatcatatacataaaagtatacttttagatttgactaaattacttcttagatatataaaagtaaattttataaagtctaaaagtaatttacatatattataaaaataacttaaaacaaaacggaagtaactttgtcacggcattaaaagtaaattcgttgtaggaataaaaatatgactttatctagaaattaaatttaatcagcataaatcaacacacgtaagtttaacaatttttaaaagtaacttcaatgttaattggaagtaacttttgtatggttaagaagtaactctctataaatctgtttaatcaccgattgtttttttcctttcatttttgcttttcatgtagaatgagaaaagaagataaaaccttcgatggattgtaaataacattgatggaataactaatgagaattagttaggtataagatgtaatagttacttcctgataacctttctaatatgtaataaattacttttaaattaataaaatatttgaatatattcaatatgaatcttgatttgttacatattttgagtggagtacaatgatgcaaatagatcttaaaaatgatatgtgatttaaaagatataagttattaaagagattaaaaatatatatactattgtatttttcaagttgaaaggagacactagatggatcacaaaccagctacccgtcacgtccaacgaaaaaaaggcatgtattagagttactttcattttattataagttattttataatatatgtaaattacttttaggctttgttgaatttacttttatatgtctaagaagtaatttagtgaaatataaaagtaatttagatatattataaaagtaatttataatttttcatcaaaatataattatgtgagatcttgttataaagatttaattgttacaaacacaacggtgtaatcggatagtagatcggatgagtagtgtaagagaaaattttatttgaagtatagatggatagggtctctcatagatggagtgatacctagtttagacaaaccagctatcattagctgtctagtcacgtcctatttttttatattaatggttagagaccatattgacttttaaatggtacagttttgtacatacgctaaacgctaaaggtagtgggaactgaaagtagatgttaaatgaaaatacatccgtttccgtttcgttctgttctgttctgttgtttctgcccgaggtcggcgaggcaggcagaacacgcaagacgcaagacgccgatccatgggggcagagaacacgcaagacgcaacgcctaaccgcatcctttaaccatgtatagtactagttgcgcttaagagggtagacgtacgatcgactgcgtctcgttcgatcgctcaccggccgcgcgtcgacttgggcttcgctccggtaattagttgaaaaaccattcggccggctggtcaccgtacttaatttgctgatccattaattcttttttacctttaatttggacgcagatcgatgatgccggccgtcgactagccgcgcgcggccggccagaaaccaccaggcgccagccaattaaccctggtgaggctggcttctccctcgaaaccattgcatattcatcgatcgctagctcttctgttcaccacaataacgtatattcctcttcaagcctaaacgccgcccgccaaaagcccctgtgctgctgctgtgccgccatctcaccggatctcgacgccgttgctggagctccacgtacgagcctggcttctccgccgaaccacgtgacggggtaagcagcaggctcatccaccctactcctccctcccttccttccttccttcttacccagttcgcgagctaccaagaggtaaaaggtaaaacaatgtgaacgaaaccgttgatatatcataactgatggtattggagtaattatctaataaaacatgggtattttgggttaatcaaataccgaattgttcagcattatctggtagaaaaaattgtcaatcttccgaggctgtctccaatacattttttatcgttcggtggagaaaaatgtaaatcttcccgtacattttgtttcccaaataaattttatcattttctaacatttgaatgtatttttgtgtagttttcatgcatcacaattttatcattttgtaatatttgaatgtattttttgggtagttttcatgcatcacaagtctaaaattaagtggaaatgcgtgtttgtatatataaagtagcatatatacatggcagctaaattagcccctaaattttagcatgcgtacatgcatgcatgatgattaagttagaaaccataatggccaaattagcccctaacttttagcatgcttaactccagtcaacgcaagttaattattagctagcaagttcaaatctttggaacgaagatgggagaataggatctaacattgttttttctttttattactgtagaattaaagagaaaacatctttttaaaaagaatttcctcaatagtagcgattgcactttgatcaacacaataataaaaaaagacactttttttttgcgccaaacaacatggctgcatgataaaaacacaaatccattccttcttcacttaccatcgtatgttgtactttgatctttataagactttgtatctatgttcatgttcattggggggagaatatgtaaatatagcgtattgacgatgaattacattttaacctgcaaaccagtgatttaccgaggttacatgttctttgtgataaaatataaatcttaaaataaccgcgcaaacattcagacatattttatcctatggtatcattaggaacataatatcaaccttaaaaaaactacaatcaagttcttagggagaaaatgtaaatctaaaagaatacgtaaatatcgtaacggaggattaccggcgatcatgttcttaggaaaagagtgtaaatctaaaaagagaacacgtaaataaagtatggaaaatcatcgaacatattggagatgaggtacccttctctatcgcttagaaaaattatttttttacccttattacctaattacatgtgtcgatattaaatatcttttgagtgatacttttattatgtacagttagattttaattttgattttaatttttttaatgcaaacaccgtaaaatctctcttatacctagtgtttaagcctctgttagcacagtcgttgtcgctatggccgccaccgtgctcatctgccactagtacaataatgatttttccgtgtggtcagaatcggttttcgcgtgcggatctttcacatgtctggaacaaggtgtctgcgaaaatccaattttttcgtgcgagtgatgcacccgcacgggaaaataaaaaatcgaaacaaaataaatcaaaagccgctctcgaaccctaatctagcctctgtcaccaccgtcatcatcctcgcggtcgccggcgacgaatccggcctcctcgcggtggcaggcgacggatccggtctccccgtggtggctggcgaggcggcgatggttctggcttccccgcagtcaccggcgacggatccggcctccctgcggtggcaggcgacggatccggcctccctgcggtggttggagatggatccgctccgccgccaccaccctagccacactcgctgatgtcgccgctgcctccgccgctctaaccgatgccgccgcctccgccgccctagccgaagccgccgccgtcgccgggattgggagattggaggagggggaggaggaggggagagggagagggagagggagatgggagtgcgggagtgacggatctgagagggagagtgtgtgggacagtgggagtgggcgtcgccgtcgattaaaagggggtgggctatttttgtgtgcgggtcacttaacaggtcagcacgcgctgatctttccgtgtggtcattttaaagagccgcacgtgaaaatggagcacgatttttgcagacgcgaacacttacgatccgtctgcaatctaaaattagtcagtgtgctctgcatttcaccggggcaaatatcctttgctccgctcaacgctggcgacctcaaaccgctgcccctccacgtgtctatagaggtctttttttttatagaggatgtctttagaggtcttaaacaaatgtctttttatttttgtctgaaaggaattaaaatgttcgtttacgctttcagccgttatataggaagccgtcgtttagcttattttaagcataagcgaaacagcatattttaaaaaaaataatttatgaataaaatttttatatatgtgttcttagcgatctaaaagcaaaggctgaaaaataaactttgatgaaaaaacctcaaaatcaacttcaaatttaaggttgaaaatttaaattttggctgataagcataagcataaacgaaaagacgagactgatagggttaacctccaaatgcattaataggttccgctttcacttgggaggacacgtaaatcatctagtatatgccaacagggttaaagccctgtttcttgcagcttggaattattataatccagattattgggagtaagctgaaagaaacagacaacttattgaagtagcttattataatctggagcccagcttattataatctgataagcttatttaggtaagctttttccagattattgggtgaaaaattacccaccatgccaccccactccctctttagactttgccccaataatctaggctctaataatctaggaaagaaacaactaaccgcttattatactacagattataacaatctagtttataataatctgactcaataatttagattataataatcccaaactgaaagaaatagggcctaaataaacgtaaaatctaatcggcgcatgcgcggctgctttcactgtaactgttacgaggaaacctacatgtaataatttttctattttttaattcataaaaaatgatactattattgaagctcaccaatcattttaaatttcatgttctatgtgctcatgtgtggtggcatttttatttgggtgcaagacgggaccatcacataggaaaaatgcgccctaactgttgctagttaaaactaattagtatacgcacgcgtcggcctatatagtcgtgtccttaaataaatcataacccagtacacagctgaaaaatgaagatctcttttccaaacgatatttcttaaaaataataagcttacctcctctatactctagtggtgatactaatcaatttgctcttttgcactttacagcaaggcaaacaggtagctactattcaagatggctgcccagcatgatatggtgtcaaagtttggtgctgctgccattgtggttatgctcatgcttgtcgtccctaacagcggcagcggcgaagatgcagggcatgacaaggatcaattggctcctatgtcaagcgaagcagaatttggattttctctcccaattgttcacgggcgtccaccggcacccggtatggatgacgagaagtttgtgactccatttagaatttatgaggatgttgtctatcttgctgaaatggagattggtgagcggcaacagaagcaatacctcctgatcgacacaggcagctctttggtctggacacagtgcgacgaatgcccgcattgtcacattggcgatgtgccaccatatggaagatcccaatctcgaacattccaggaagtgagctgtggtgatgatgatgacaatgataaagaagaagcaattgctagttactgtccagcaaaaccgccgggatatatcactttgtgcgtcaatgggaggtgtatgttcaaggcgctatataatttgaccgggcaaggcgagactgttcaaggatacatgtcaatggatacatttcacttcattgatgacaggagatttgactaccaagctaagttccggatggtttttgggtgtgcacaccaagagaatatcgttcttacagctgtcaaggaatgcactggcatattgggattaggtatgggcgatgcatcgtttttgaggcagaccggaataactaagttctcgtactgtgttccacctcggatgccaggttactcatataggagacacagttggctccgttttggctcacatgcacagatttcggggaagaaggttccactggtgatgcggtggggtaagtactatttgccgctaacagccatcacttacacatacaatgagcttatgtctcctgtgcctattattgcctataagagccaagaagactatctacacatgatggtagatacaggaacctccttgctaagtctcccgacctctttgcacgatgatctgatcaaagaaatggaggcaataattaagtcagaaaatattatggaaggggccactagatggcccaagcactgttataaacgcaccatggatgaagtcaaggacattaccgtcacacttagttttgatggaggtttggatatagaactcttcacatccgcactcttcataaaaacagaaactacaaaaggacctgctgtctgcttagcggtgaatcgtgttgacgattcgtctaaggcaatcctaggtatgtttgcccagaccaacatcaatgttgggtatgacttgctaagtcgtgagatagccatggatccgattcgttgtgcctgataaagtacgcagcttgttaaattgattaggagcatggcgttattggacgcattgattcatgcgtggttgttttagtttattggttatgttaccaatttgcatcttcacggctgtcttagtttactattgatgactgctgaaatggacctgctacttcgttgagttcgtttactattggtaactgttgtaatgaacctgctatttcatttgagttagtttactattggtaactgttgtaatgaacctgctacctcatttgagtgctgtaatggacatgctacttcattaagtactacaatattattttttatctgtctagacttgtctacatttatgttccactctaccgtaattaacaatcaccacttctccttcgtcgtttgtttacatgcagcaagtaaataaaattctgattgtctgctactccttcaatgaaaaatctcaaaaattttgtgattctctcagggcgacattttggaaaagacaatccttataaacccatttctttgtaagtacgttgctgtcagattacaatagtgcataaaccacctttcaggatacaggctaagggaaaacttatttgaaccaaaaaaatcgaatggcctcagtagcctagtacaaatatatctatatcacgcacacaacatacacatactcgggctgtgcagcccacagcatctgagaaggaaatccttacaactgcaacattggaaaaattttactacgcatccttcgaatgcttgggcatatgttcttgattcggcaaaggcgctgtcaattcaaaatagtcatcaaacacgctgtatccagacacgctgttggagcatgctgcatgcgctgaatgcttgcagttgagttcccaaattgggaaaaggttgtctatacaagagctttaactgcatcacaaaatatatggtttattaagcaagtcgataagaacccaaactatcagaatggtcacaatctaagctgtaagttcagtaaccacgttccaacaaaagatagctggcaaatattagttttctagcctttcaagcaaagctgacatcttaacagctgacagaatatgagattgtactagatgcaatgaaaagtgagagatactcacaatctgttcatgcactcctctttttagcaactctaacttggaggatcagatggacatctcgcttgaatatggacctcaattcttcattggcttcaataccaattctcctgaaacagttgtcacaaatgagataacgcattaatagtttaccaatcatgcacaagaataactgtcggaacgagattgattggagaagtgaactgcaaatgcactccataaaaggaaccaccatctgccagggtgaccagttttttctttttttaagatggtggagagcagtttcttcataagagaatgtgttacccgattttggagccatttttcccaacaagaatctgtcgttggctttgctttggtgcaatgaagtgttgttccaccctaagagaaccatcttttagctccttccagtccatcagacgatggtcaattacataaggaatttcctgcatacatttacccgaacataccatagcagacaattccatcagaatcaagagaaaattaacaatatgccactccatagaggtggctttaacaatatgccacccaataggatgtccttataaagatgccactccatagagcatacccctaaataaaatgccacttttggctgtttagaggttttgattactttgtttatattattttatcagactcctcacgcgaaatgaccgaaatgcccctttcatatcgtttagatccagagtcagattctttctcttctctctctcgatacttctctctcggccggcccgggcatgcggggttgtcgccgccggttccacgccgcccctccggtcaccccctccctgttatggtcacccgtccgtgccccccaccaggcgtcggcgtgcacccggcccagcgtcgcctccccgccgcccccctctgctaggtacaagtcgctgcccccccccccctctcaccacctcgccgccctcccttcccccactcccgccgccccgccgctccccctggtaggtagaagtcgccgccctcccttcccccactcccgccgctcctctgcctccaatgtaacctcggcctctttctcctctcagacagtaaatagaaggttgacaacatgagctcgaaggatttgtcctcgaggtaaaatctttcatatcgctgtacattttatattttcatcgagttagatttctaactcgcttttttctcttgtcgattcaaatcgtttaggttggattcagaactgtctagagtagagatgcagttggttgaatatgggacaagttccatttcagcagtttcagttctagcttcagaatgtctagatagttgtacaagtgtgcctttatgccttgagtatggggtgatttcagaaccagcagctccaactgttggtgtagaacagcaaccttttcagtatgttgattgggataacttggagatagatgaaacgttagatgatgagggaaggattcaggtcatgaatgatgaccaattatacgtactcctaggcttgagggatgaggaaagggcaaaaaaatcggcgcatgctgctggagcgaatggttcaagtaatgctgctggagctgatgattcaagtaatgctgctgaagctgctggagtcactgacggcatcgagggtgcagcaattcctgttgatgattcagtaccgggtgagcttgttataagctatgacaagaataacccttgtatggatcgatacactaagtacccctcaatgaaggaattcagattggctgtaagacagtttgctatcaagaaggaatttgagctaggcaaagtgaaaactgacccggagaggtatagggtaaaatgcgctattgaaggatgtgcatggagtcttgttgggcgtaggcagaatgataaaactataatggtactaacccaaaacataatttttttgacattacttctagcgtgcctagaattgtttgcatggttttaatggattacctttcattgctattgcaggtcacagttcataacaaagaccatacttgtacatctagcatgaggataagaactactacaccgtcacaaggttgggttgctgatagggctgttgatatccttaagactacaccaaacatgtcttgcatagacttgatgaaaaggttgcaggatgatcacaaggtaactctctcttaccatacagtttggcatggaatggagaaagcaaagaaagaattgtatggatgttgggaggaaagttttcaattgttgtatagttggaaggaagaggtccttaagagatcacctggaagtgttatagaaattgacatcaagatagttgatgggagggcatactttcataggttttttgctgcatttagtccttgcatcaaggggtttgtggctggttgtagaccataccttagtgtagatgctacccatttaaatggcaagtggcatggttttttgccatcagctacagcaatagatgggcataattgaatgtatccagttgcatttgggtttatagactccgagaccgaggacaactgggtttggttcatgactcagcttcatagggcaataggagacctagaacctcttgctatttgttcagatgcatgtaaggggttagagaatgcagtcaataaggtgttccctgctgctgaacgaagggaatgtttttggcatcttacgcaaaaattttctaagaagttccatggtgagacttttggtaatatgtaccctgcagcaagagcctatagggaagaggtgttccagaagcacatgttccctattattaatggaactcctgaagtttggaaatatttgacaatatatcataacctaaagtggatgaggtgtggcttcaaccccgcaattaagtgtgattatattacaaataatattgcagaggttttcaatgcatggatttctgatatcaaggatttgccaattgttgacctagttgacaagcttagagagaaggtgatggttctatgggataagagaaggagaattggagaaaggcttaatggtaagattctaccagctgtaatgcaccaattgaaggcaagaacaagaggattaggccacttgaaagttatcacagctagcttacatactgcagaggtgcatgactatgtcaaagaatttggaagacacgttgtttcaatagtggcaaacacatgcacatgtgaggagtggcaacacaccgggcagccctgtgggcatccattggcctttttaacaactcagagaaatgttgacttggaagggtatgttgatatggtttactcagtggagaaattcagggctgcatatgagagagataccggcaatgccagacaagtcacattggccaaaggtgaaaatgcctttcgatttgggcgcaccactagagaagaggagtgttgggagacaggaaattgaggatcaaaggatgccttgagactggtagcaagagtagtgcaaagagtgatggcaagaacaagaaaatcataagaggtccagttacatgcaaaagatgtggtgagaaaggtcataggcaagctagctataagtgcccactgaatggtacaaaaaaaaggtattaatatttctgtttttttcactttacatccttttaaatttgtggtacttcatcctatatgtataaatatatgcaggaaaaggaagcctaggaaaaacaacaaaaagaaccttccacctgaaccttccacaccacaaagaacaaccaatgaagctacaataatgcaagaaagcccgggaatggttacaaggaggtaagttgatggtcaaatgacaagttagaattattctccttgctgtgcatgcttcaaatcaattgtgtgtgtaacttggcttttgggtatacatgcataggcgacttgcaatgcttttgggagtgaccagtacttctggagtggaaggggctagagagccgagagagatggctagtacttctgcagaccatccaagaaaaaatgactcccaagaaaatgaagtcaacctaatgtattttagttgtcaaatgtgaactactgtaatgtatttgtcaagctactgaactactgaatttgttaggcttgtgaactgtatttcttttgggtctctttgatgcttcatgtaaccaatatgctatgtgctatgtgctggaatgctatgtgctatgtgctgcaatactatgcctatatgtgctgctggagacctctgtgctgctgtgtgcttgctgcaatttatttgtttatgtgctgcaaatgcttcactgttgtgtgcgctgcaatttgagggagcacagatcgtgctatggtgtatgggctgcaaatgctatactgatgtgtgctgcaaatgctttactattgtgtgctaaatgcacaatttatttgtatggtggacttctgtgtgctaaacgaggtggtaactgatttgcaatttatgctgtgtggtagtaactgatttgtatttgatgctgctgtaatttgagggagaaatctgacccgaacattgcaaaaaggagctaggggtacttttgtcatttcgcgtgtcatttctgtcaaaaaacctctaaacagattaaggggtatgctctatggagtggcatctttataaggacatccaatagggtggcatattgttaattttctctcagaatcaaatagtaccaattacacagtagcaatatgtccaagaattaggccctgttctatactccaactataaacttcaacttcctcattttccgttagcacgcttcccaaactactaaacggtgtatttcttacaaaaaatttctatatagaagttgtttaaaaaatcaaataaatcaatttttcaagtttacaataattaatatttaattaatcatgtgctaatgagttttctcgttttgcgtgcactggaaatatttttccctgggcatgaaacaaacgaagccttacttggtggatgtgatccagcatcttctcccgcacaacctccaatgagatggttttcatgacctcttcagtcattgtagttggttcctcatcccaaggtcttctcactgcctacatagcacatagacgtgatttaaatattgatcaaaagaaaccaagttcgacgtcacagcacgcaacagagataacatccattgaatagtttataaactaaaatacctgttccatcaagaactgtacaaggtctttgacccctttgccttttagtccagataccatgaagtacctaacattccaagaaattgttttatgaggcagatgaaatggtaggaaggcaatgcaagtacacctgcagactaaggggaacctttcatatgcaggaagatcttcaaattcctttgcaactttaagcaagtcttttttgtcttccacaaggtcgaccttattcatgcataatatacgcttctgatttgggtttacctcagcacccaaccgtttgattaacttgacaactcgcgtgtcagggctgcatacacgaagaaattgattagaggtgtgcttatcatggtctctacataaaataagaactgcatttcattgattgacagacaatactgaggaaaggaaggataaaaataaatatttgccaaggcttacgttttaagatgcctgttgacatcaaacaagactattaataaatcataaaggttaattgagctccaggcactctctacacgaacagtgacatccctatgaggtaatccatggtggcctaacatgagccctggggtgtcaaaaaagcactgcagtgcagagaatattatcagtgaaaacaactaaaagttaattaaagaaaaaattgtagatgacacccataggcaccaatttttgtagcagctccttaattacgagctatgcatttgacattttttacagacaaacccaatcagcacagttttttaatacgaagtccattactttgaattatatatctatgagatagatacaatcaggccatggggcacaatgtgcttgcactgactgatttgaacatctctcttaatgtaatcagtaatggtagaaataaatcacaatgtactctgttttatgatatgtaatatattcatcattgtccagaattcagtatttgcaaatgaaatacagacaagcatcgttagacaggatttttagaaatccataacggtaccatcaaaaattgaaaatatgaattcacttcatactagcacaagcagatattggtaacagaacatactatttgagttatcccttttgtcagcacgcccaaaatttcatgagttgtagtatttgtcttgcgggacactgcagccacttttgttccaacctgtagcaaaaatataaatatggaacattaggctccactacaaccagttctcctccctttttttgttaagaaatggcagggttgccatttgatttagttaatgaggaaaggttccaaaattataaggaaaaagaccagggcctaaacaaaaggcatagtttacatttgtcgtctttgccactattaactatttagtctctacaaatgatgctaagccagacgcatacaacagccagctggtaagtctacctgcttactaaactatacttaacccaaagaagccattatatcaacagaattccaaaaaatgaactccaatcagacccagaaaatggtatactctatatttattgatgtttaggtattgtagtaataaaaacccaaatctgcaattgggcaactgcacaattctgttaaatttttcatacagaacaggataccattgaggcaacgatttgcaacaactcatggccatgcccagaccttctgaaataattcaacatcaagctagaggaacattggtggtctcagggaacataatcgaaattccttattatttaagcctcactggaaacagtcccaaaaaaatggttcaggatgtaataactagcgtaggtaatcttaacctaggcaggctagcttacacagttatttctgtctctgacaacacacaggttagcttttccagttttttttgtctctgacaacacaactagttgacctaaactacagcttgattagatcaggagcatctgtatttgtagtgcagaatggtcgttcctgttgtatgttgattaatctaaacataagtttagcaaagttagaatttttcacctggataaattagccaaataaccatggttgcagagatcagtgagagaatgtgagtttaagaaggatgtctagaaattaacaacactaagttacaaaagcaacacaatttctgtaagcattttagcaaacatccatgatacaaacaaatatagggtgctctaaggaatgctacaacaaaataaccatttccatgtcacaaaattttcaatgctgtgacatgaaaatacgtaccatggtgtttgttaaacctacaaagaaatataggattatactatgatcactgtaaagtgtcaaaacacacaactgcacttcaaactcctaatgctcctctaagaaatgttacaacgagctaaaccaaaccatttccatgtcacaagatttttgttctttcaatgcgtgaacacacgtaccatggtgtttgtgagcgaggacttgccggcgttgggggcgccgacgatgccgacggacagcgacatctggtcctcctccctgacctcgccagggcccaagtcgtcgtcgggcggctcgagcgcggcctcgagcagggccagcgcaacctcccgcgaccgctcctcctccaccgcatcgtccaccccacccctctccttcccgaacagcgcctcgtcggcgcgcgcgcggagggaggggtcgaaccggagcttccggagcgcggagaccgggttgcgcgcctgctgcggcggcggcggcggcgtcggccccgagggcggcagcgcgaactccgagctgtcgaagtcggcgtccggggcggcggcggagtcggagtccgatgaggaggcggcggcggaggcggaggaagaggaggccgaggcggtggagaggacgcggagcgccgtcgggatggggctgagggttagggtgcggagcgggcggagggccccgacgaagcggcgcatggcggcgacaagccgcggccggcggcggcggcggcggagggtttaaggcggggggggggtattttggggagagaaatgcggagagggaggaagcgaggaggtttgcaggcgtgtgaaagggggaggaggcctttttgggccgtccggccctccaagttggcccggttggtctgttgactagtatgggcccatgaatggttgcctctacatgtacatgtactagtagcttgttggttttcaagaacacaaaaggcacaccctatttcgtggatgtgactcctttgtaataacgaacaaatttgacatatatttttggatggataaattgaagtcatttatatgaaaatcatacaaattattgcgttccatatctggagtagtcatttatatttgtcgacaaattttctcctagaaatttgacagatgtaattatagtacaagcgtgatgtaatttatatataacttgtatgtaactttcaaaaatctctaactaagatgctatttcggtgaaatggaggtcgtgggaacgaatcatctcatatatgtgcgcgaaatgacttttttccttcacttgcacaaatattgaaacaatttaatggttcaaaattatgggcaagttacattgtagttacattcaagttacagtgtaattacactacgattgtactataattacatttgttaaatttttagaagaaaatttgtcgacaaatatatagcaaaattgtttagtcccaacaaaattatatcagttttagatttggagccctgccaaaaacctcctaaatgtccataagttagtatccgtgttcaccaattgtaggagtacactgtgaaaaaaccgcgtgaacgatttttccttgtatctttcagtagatcatgttcatgcaccgccgaggatacctatgcgtgtgtggtagtgtgtgttcgtttccgcatcctcctgtacaagagaggaaaagaaaacagagaagcatcctgttctgtcctgcaacccattggacggtgcagggccgcaggggcctcatgccatggttgcgttctcctcatgctttcgttctctgcatctttgccttttgatctcagcatggtccagtttaatcccttttgcatatattctctgccagttaaacaattctgcagggaagaacaacgcggcaaatcaaaagaatgtttctgttacttcagcattgttctgtttaaaacagagaatcaaatcaaaccatacattcagtggcaacagtttaaactatcagtgtcaggtttcagaggtttctggaataaaattcaggtttcaggtgagccacacaagcggtatatatttctgaaacaaattgcagatttcatcaggaataagaagctacagttttgcatttctgaaagactagagaaaaaggagacaacgctggggattatttgattcttcactgaacaagtgaacaaacttcacagagctcttgtcatacaaaaaggatttaccctagctgagaatctgtacattgacattgactccaaaaggaggtcatcatttttatacaaagcttttggacttgaagagaaaatctgttcaaggaccactacctcgactaacccatttgattcttgttcacttcatttggtgctatactggtggaagcacaccatttgcccaagaatcagatttgtcctgaacttttgacttgtgtactcatgtcagtaaactctaaactttcggtcgtattcaggccatctttttctccaattctggttgatggagattctacaaaagctggttgcagtaatgctatgacaacatcaaaccctgtcagctacaaactaagctcagggtgtctttttcagagacaatattcaaaaatttgcagctcttggttgctctgaagatctcatgcccatatggcaagcagagacatcatcccagcgccgaggaagagggcgaggtatactgccagctgaagctttgtgtttgtttgaagcttcggattgttgaaatctgcagcgaggagatcgaccagggacatgtagatcagtatccctgctgcagcagagttgaagactccctcgacgacaagtgcggtcgagctgtgcttgctatagctggatgagattgcgatccccagtgcaatgcccaccggagcagtgagggagaagaaagtcgccatgatcactgttgctttcgccttaaaatttgcctgtgtaagaaaatgtgacacaaagtatgtcaaattattgtctcatacgagaaactttaaagtctgtccctttttcatttttatggaaagtagcttatggtggaatggattttcacctaattgaatgaactaaagtaaactgctgaaattgtggttcttctcagacatagtaatatctgcgtggatattgatcagcactggatagtggatacagtatactgataacaattgaaaatggttgagaatcctggccagtgttacatgacaaaccagtctcaacccatttctgaaaacgcggtatttttaggtatatgctaaatctgaagtccagttttaaaagcatctgggaaaacagaagggcaaaaaatgacgcagcaattcctgtttgtgtatcctgaaaaaaaaaactggcattgagaagctgggagcttgtttgagcttgtcagttagtgaaggatttctgaaccatagtggaacggaatcaattattgatggtcctacttcaagtttgctttgtacagtatagtcgtgtagctagtgataagttctatcatttgagctataaatatctctgtctatactctatatgtcgtttttcgcacgcttttgctaatggagcatgcccttctgtttctgtcatgagcccaggtgccttttacctgattttcacgtgtagatattttatcaatttgccatgtaacaatgtaggtaaacaagcgcacagctatagtttcaacccttctatgtcgaattgtcgattatcttataccgcggtatgaatgtaatgtgagatgttcatgttaatcatggctgtaaaatgttattgtgatatacctgaacaatgcagccaccaaggccaatgccttcaaagaactggtggaagctgagggctccgacgagtggcctgattgacgacggcctcagtgatgcgcctagcgaaaccccgatgatcaccgagtgcaccaggattcccagctccagaacctgcacaatcacaattcttttgtcagttattcttcgaaaag

SEQ ID NO: 62120 - DNA, 4039 bp, Oryza sativa
gtccacacgtgaaagaacctaatgaatatcgaagactgctactgagttgacaccattccaagaattgaattcattccgcaaaccaggacctatatcattaccaactccagacagtcttgcagaaactattaggggatttcaactaatcctcacaatatcggttgtgccccacgcgcccatatgatatcgatataggagatcgttttaaatctaatcggagccacaacttaataagattgactagtcttttaggtaagttatattctactttctccgtttttaatagatgacaccgttaaattttgaacatgaccactcgttttattcaaaaatttatacaaatatataagatatatatcatacttaaaatactttgagtgataaaacaactcacaacaaaataaagtataattacgtaatttttttaataagatgaacgatcaaacgtgtgataaaaaattaacaatgttatctattaaaaaaacagatataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttacacacgcccagcactatataaccagctcccaagcgagccgggagtagtagccaacgagcttatagaacacaagtacaagaagctatcagaaatcagaaacgctagctagcagtaggaacaaacaatgaggtcgtccccgatcatcttcctgctcctggccgccgccgccgccatcgccgctccgtggcaggttgcgcacgccgcgggcaagtgcggcaagacgccggcggagaaggtggcgctgaagctggcgccgtgcgcgaaggcggcgcaggaccccggggcccggccgccggccgcgtgctgcgcggccgtgcgcgacatcggcacgcaccagagccacgcgtgcctgtgcgccgtgctgctgtccagcaccgtgaggcgctccggcgtcaagccggaggtggccatcaccatccccaagcgctgcaaactcgccaaccgccccgtcggctacaagtgcggcggtacgtacgtattgcgtgcgaagagctttggttagcttcatattataccgtttcatattacaagtcagactttttaaaagtttgattaaatttatagaaagattacaattatatcattaaattagttttattaaatctaatattgaatatgttttgataatttattcattttatattaaaaatattactatattttttataaactcgatcgaagctaaataaatttgatttttaaaaaaatcaaagtgataacagatgtagtatataatatctctgtcgtagaatataaacatttttgcgtatttttcgaaacatatttggacatctatatatccggatacagttcaagaaacacatagaaatgattatattttaaaaccaagtatatgacaagtgtgatggttctctgccttttgtagcttacacgctgcccagcctgcagggctgatgacgacgtacgacggccttgtttaggctctggcgccactaaaagctacctacagatcgcttacagcatactactcctataatactgttgcttaagtgtgctagctataccctgcactgctgatgaataagtatgatcgagctagcaaagcaactctacatggttgggacgtcaacactggttaatctcgtgcgctgcaaatggtctgctagtgtaatcctgtccgcatatgctgcttgaggttgtaatgagaatggacaaagtttactatccgcccgactgatacgtataccgaacatttacgtagcaatgagcgtatgcagatacgccacacaaaactatagactggcatggcatggcatgttgtctgtgttgttgtcacactgttgcgtgtgtcagatgcaggaaaatacatagtgaaaacctaaaaattactaattgaaaactaaaagtccaagatttattacgtcaccatagagtgaaattttctctcaataaaagttttactcatgagtaaatctacgagtgaaattcttactcgtgatgatgtgtacgaatctcaaacattcatttttcaattcaacggtagttctctagtttctgccgtatattttcccatcagacgccggtgctccctgctccgtggcgccgcaacgggctacttgtcacgtgctcccgcctcacgtttgccacctcatgggctgggcttcctcccgcaaccaagcccagaaactcaccaacgccgtggcaaacgctcaatctcagccgtccatcacgagcatatcgcccgtgaataccaccaccaccagcaaaccaggcggctcgatctccctatcccctgattcccctccagcctctgcgtccccattcacctctcctcctcctcttcttctacctcgcgctcgctcgcttccctcgtaaaccatccgcgcgcgtggtccttccatggcggccggggctctcctcctcgccaaccccgccgcgcccacggcgaggcaccagcaccggttgctgcagcagcggaggcagccgcggctcctcgcctcctctcggcctccccggtggcggctctccgccgtgcaggagaccaaggagggggaggcccagacggccgaggagatcaccgagaagtacggcctcgagttcggcctctggaaagtaagcacgcggcgcaggcagctatatttgtcgagttggagagcaaatcgatcgtgagcgcaatcgaatttgccgcaggtgttcagctccaaggaagggga

SEQ ID NO: 62121 - DNA, 637 bp, Oryza sativa
gatgatgcattagcaggtccatgtttgagggggagggcaacggctcaacctaaatccgaatagtctcgtcactaagagtgggtttagcagggaccaaaccaactgatctatcatccacctttgtatttttgccggtgtagttagcacgtaactggggtggcgatggagcatgacacgaaccaaaaaggatgggtgctcacatcacattcgacacaaaatacttttagaacgaggtatccatcagtgtgcttctagaaggccggagttaattaagtttagcaagaacccttgtgcatgtcactgggagtgacagggtaaattaagctcacgaagtgacagggtgataagtgacatggacgtcgcacaagtgcagaacagaccggccagtaggggattaggtcccgtgtccctttgtgtaggcctataaatggtgcgcgaattgcgtatgggtttggggggcaatcggtccagcccggtctaagtttcgcccgagattgcgaaagatcaacagtccaaccggcgaccggtcgattgcttgcgcagcgcgctcggagcaactttgggttgggtccagattagagaaacactttcgatcattccatcgatcggcgacgtgcaaccaacctcgcatgcacgt

SEQ ID NO: 62122 - DNA, 1390 bp, Oryza sativa
ccccgggacgccctgtgatttatggccgagtttagtttctaacttttttaaaaaatttctaatttttttatcacatcaaaactttcctacacacataaacttctaacttttttttcaaactttaaattttaacgtgaaactaaacacaacctatgccaatatgccatgtagcggctactgtagcaatcgataccgtgcaatgctgtcgcattgattgctcggctagatcagatggctgtggccggcacatgcatggatggccggctaggggaggaatgcagattttctcgcacaaaggtccacacaactgtctcgtaaaaatggatcatgggcaaacagatggtagatttgtagtaccacttgtactaaatctaggcgtccagcgcgcaatgctgttcgattgggtaaatttaagcctttagaattgcaggttatatatgatcatagccagggttaggtggggaaaaaaaactgtcacaaccaacaagctgttaaaccgtgttaaactccccccggtttgaagaacttcaagaattccacccatcgaaaatgacctatacctaatccttctatgggtattaacgccaatgattgttgtacacttgcacgtaggatgtctgtactagagctatgacggtactttaataaataggagtattatggaaatatgggcagtccttccggctgcacgctgcgaactaaagtactaaacttcctgaatgctcgtcacacaaatgaggaaaaggacttgtggagttcagaaggtagcaagagtgtgacacagtaatactattatgttcagctggactgcctggacctggacacaataatactatgttcagctggctgatggaagggaattcttgaagattcaaccaagaggaagaaaaatgggtaaaaacagagcgggcttgtttggtttagtaccctaccaatatattgttagtgccaaactctaggcaagttaaatgagtgtctttggattgatgccaattgagagccaaattttaaattgtggtgaagaacattctagaattgtgctaaattgagtataggcattaccaaatatttggctttaaaccaaatcatcacatttactatttaaactaccaaaacattggtatggcaatattttgatatcaaaccaaaacggcgcagctttaccaacaagaacctcatcttggaacaaaaattaatatttcgttaattcggttcaaaggttcaaaactgagtgacaggtcctctcctttccctcaacaatttgatgggctaaccagcgtgggtttgaggacttactcattttatttatttgataggaaaaaatgatattaggtaattttttaatatttgcatttttaacctgctctatgttttaccattccaaggatta

SEQ ID NO: 62123 - DNA, 501 bp, Oryza sativa
tcccctaaatcatacagctgcccaatttcaaccaatgttttacctcatgcaaacctctccagaattgagagcatccctcagtactagactggaaaaagcctcccccgaagcagataaagattaagttgatatacgtaaaacgagaaaactattagcatagaattaattaatttttaatattacaaacttaataaatgtatatttttctcacgtagtaatggtgttagatattgcaacaattttataatccattgcaacaaatagaaatccttgtagtgaaaacaatttctatatagaaagttttcacaggaaacataacatttattagtttaaaaaacgtgctaacagaatcttaattgatgtaatgtgtatgtgaccaggccgattgatccctgtcgcggatgttactcatcctgcatgcgctgccgatcgatcgacgagcgtaggtacgttctctacgtcgttgcctcgtcgctgtttgttctccatcgatcgggttca

SEQ ID NO: 62124 - DNA, 1144 bp, Oryza sativa
taatggtttgatcagtcaccagttcagtttctacctgaggagaatcaatcaccgatctgcagactgcagccatggccatgagggcaatcacgctgtcccactcgcagagcgcctcgtttgggcaccaccaccaccaaaccatgccgtcctccttcaggccaagcactgcctccaccagatcagtaaggtctacgcaaaggaagatgaggagaagggcagcaagcagtcattgttcgggagcatcaccgaggcgctggacttctcgcaggccggtcggagaaggacgcggagcttctgtatgaagccagagaggccacaaaggatggaggaaggatgacaaaggagcaggtatccattgaactactgatccgcacaaaaaattgtcgatcaatggtgttatttagtttagtagtaacttagtactgactatacacggcatggattttctatggtctgacaagttaatttgatttgcaatgaagtatggagcacttcggaggaagatcggtggcacctacaaggatttcttcaagtcatatgtggatggtactacctcatatatgctttacttgcagaatcctaaaattacttctgatccaaaaagattatactagtaggagtatcgcacagtcctaactgtttctgaattctgcttgcagttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtcacacattttccttcttcaattgatccatttactcacgaacaaagcaatgacttaacagacctgaacgactgaaaatgttaaatattacatcaagtattacagagcaagttaatacactaatctatctattagcttatgcccctggtctaatataagaggagctcaacagaaactcaagtcaaaag

SEQ ID NO: 62125 - DNA, 588 bp, Oryza sativa
ggagcctctttttttgcttccataagccatttttcatatggagggttggataaagagctgcttgggatgctctaagtacctgtgtgggtaaggactgatcacccgttacttgggtaggggacagtcgttgttgagcagtgtacaaccatctgtgatgagaaataaattaataaataagttaatgatagatactcctaataatagtgattataataataataatcttattaattagcgtctaacactcataatgaccgtccaccctcaagcacagggtgaccaaattaggcggcccatttggtcatgaacgccatctttagtaacaaagagcttatgtggacaccataaccggatcatgccggatcaaactcggtttatttaaatttttagaggcactatgagcaacttccataaaatggcccaataagtggctcagatgaattttaggaattcttataaaaaatcgtgctcctagagactctctaactggatggccaagacataccgatggataaaactgagatgccgctagacaaaattattcagtaaagtccgctggtcattcgatcatgcagtgggacccatgtt

SEQ ID NO: 62126 - DNA, 622 bp, Oryza sativa
atatatatatatatatatatatatatatatatatatatatatatatatatatatatagttagcacatttctttggtgcaccatggtgcccaggctccatggccatccacaatccaaatgctttaagatctgtgcaatgcactataggatactataacctattagcgggtctaacacgataagatattgcatgcatatactttccatagaacatgcatgcaggtaatttccatttcgaagtataacgtgcttgtgtttccaaaattgatgcccaccaattatgattagtactttccaacatcaatgccttggtgtggaatgaaacactttgagtgattcgagagaatcaattgaggagtacagtaaaagtttataaacatcaaagaaaaccccaaggtggtagacacttcaaggttcacagacacatgtatatcttgaaatattttgcgtgtcatatcattgagcagaaagtcattactctagtcgacccatgagctttactcggggatgagtaatggataactgtgggggtgttgttgacggtcgttaagtacaaactttaatcgtcaagtcctgcataagaaacgtcaaatataataccaaaacttagtggtaggagttta

SEQ ID NO: 62127 - DNA, 1176 bp, Oryza sativa
ccttacaatgcgaaagtctatggccaagtctttccccacaaaaatgggggggacacgagctcatgacctctggtcttcaagcttgccaatgatgaggcagagcaatggaacattgtgaaacacattgtttttgtgaaagtagcatgacttctaaggacaataccacacagtacagactcccctaatgctaagcaagcgatagcaaagaagatgactacgagacgtgatggaaatggacacgcatccttgcgataatccagtacccaatcgagagcacgcacgtaccgggtcgaccaatgatctgaagcttggggcagttgggattgggatgggcgctgggctaaggctccggaacctggaatccgaccgcgcgaaccgaattccctccgaggatgccagcttctggcacacagagagaaaccaaaccacccatcagcgaaccccaaaaacagatttcagaaccaccctccccgaaatgctcaattcgaagccgcagccacgcagattgccaaaacccgcggttaccttgtgcggaagctcgtcgagcgacatggcggcgcgatccggcggttggctcaccctcacctcgtcgtcgtcgcaccaaaaaggaaattccggcctcggctcgggttgggtttggggaggggaggggagggagagaggtgggtggtggactggtggttgggtggtgagaggcgacgccgacgcgaggcgacgctgttgaggaggaggagcaccacctccacctcctccccccgattcggttatttatcggcgaagcaggaggccaccgggagttgacaccaacggggggctgacaggtggggccagggggtgggtgggtcccggtcgcagtgaggctacgactgacgcgtgcgctgatgccgctttgggttggggtgtggggtgtgcgtggcgtgtgaaaccgagcgctttcgtggttactgctgccggcaagcagcaagctaaaccggtttgtttggttggttggttggtgggtctgttccctttccttttcccgttcccgttttcatcccatcatataccagaatatttctgtcacttggttagttattatttcaattttgaaattttataacttaatattatcttaaacaccagttgtttcagtagatatcttgtttgatttcatataagaaaaaaaagggtaatgtt

SEQ ID NO: 62128 - DNA, 5690 bp, Oryza sativa
ctataggtatttatagcaggagagagccgtacctcgagattcttatattttacactatttttcttaaaattatcctagaaaaacttgtagctctaatatctttttaaggactacaaaatcattaaaaccggtaaacatattttatagtactttgcggaatcctttggtttgcatttcagcagcgtggaatcgatagtcactcggcgtgccccttttgcgtttaggccatttccaacccaatgactaggatagtgtctatagcattaaataagctaccacctaggatgaaaaatgatgtggcaagtgaataaatgagaaaagagaaggaaacaatggtttctacacaatatccaaggcatcatgtgagataaatagcattaaatctaagtatggaatagtggtatttgcattggaagagtagtgtctagtactagtttcttgatgatgtggagtttatggaaactatgtctagtgtcatgggttgggaatggccttaggatcttgagacggtgaaacacatcctcctcgactatgtgtttgctcggcaggtctggttgcgtgtgctatcgcctccctggctgggctgctatctcttccccatggcagctggttccagaattggtggctgtccttcagggcctgcttagttgagcatctccatgctggctttgacttcctagtgctcttgatcgcttggcagttgtggaaggaacgaaacactagggttttcgactctgcgctctcttcaatctcagtggttctgaaaatccatccactcagagggtcatacgtggtctttaactagcattgccgcttttggagacttgttgggagtgtagcgtggctcgggcccttcctgctacttggagtttgtgtttagctgccgtagttttataagcttcagctttttattttactttttctctcttctcctggcataagccggtctagctaattgtgttgtgtaactataactcttttcttctaatatattgacgtgcgatttttttgcgcgttcgcggaaaaaaaatgttccaagatgagagacaacatttttacatagctgcgtagtaagtatatttcgttggcttatgttagatttgcatcggatctgaagctttagaattctcttgtctcgaccaatattccgtgtataaagatacccttgacgagtacagtgacttgcctttgtattttggggcactcaaagttgctttcattctgaactagcgttggattaggtagccaccaaacgtacaagtatacatctcagtcgttatctgaaaaattcatcagtgaagctgggagtattcgtcaaatgtcaaatgacatgaaccgctaaaagaagctacatttccactgatttgaacttgccccattgatagcgacaaccaagaaagaattcatgtctcaggatgcttatttctaaagacttgactgacaaattctatgtgtgttcttttttttgcaaaaaatatgtattgcattcatgatccattgatgcacatttctccatgaaatttaacaagattaccacccattatctccaaaaagaaaaaaaatcaccagtagcagtcaacagctgaaaatatcagaacaccattatatatatttatattgcaaagaggcaggcgtaatattgaaaagcaatagtatatggcagagtcttggtcgtcggctacgaaaggtcgccgcggacaaaatcttgtgcgattgcagtatagtgggggagtggttggcatggcaacaacatgcatgcgaatgcgcaggtatgagtgtatgaccgccccaagtcttggccactccagggacatgaaaaatgagcagttacaattcgcttggactcgctgaaaagtaacgagcttttgttaagctttgctcgaattcaggcgcatcagaacaaaagcgtttcagaccagagacacacgactgttcaaagttaaatttttttcttcagcgaatcgactgttcaaagttgagagtccaagccgtccttcaagcacagttccagttgatttctggaaacaagaaaggtagccattgttgtattccagtcttcaacaagggtagcccaggaaagtagtcgaaatgtgagataggggggtgtttagacctaggtatgtaaagttttagcgtgttacatcagttatttatataaggtgttgtatagtatgttcgggtactaattaaaaaaactaattacagaatccgtcagtaagccacgagatgaatttattaagcctaattaatccgtcattagcaatgtttattgtagcaccacattgtcaaatcgtggagcaattaggcttaaaagattcgttccgcaaattagtcgtaatctgtgtaattagttgttttaaacctatatttaatactttatacatgtgttcaaacgttcgattttataaagtaaaatttttatgtgggaagtaaacatggcatatagatgacgctgactgctgcattgtttccgttgcttacgatactctcaaccaccaggaagcgatggtgtgtttcttactactatacccacatgatgggtacgccgcgtgttaccagtcaggggcagatcgaggaggacgacggtgtcaacgcgaagaagggtgaggaggtttgggttgggcggcgcggtgagaaacggggtggaggtcgtgcaggcacggcttcggctttctgactttgggcggttggcagcagaaaagaagaaaacgccgcatttggtgtggtgttggtggtcagccgcgcgcgcgagacgcgtccgttgaagcgtccctccaaagaagaacgcagccgttgccgccagcaaagtcagccgatcgcgcgagcccaacacacatgtacgatcgcgctcgcgcacgggagaccggagactgcggaaaatgcgttgcgatcggagatgggaccgaatcgggcggatcgaatcgcggaggcgcgcgcgcacgcggcgcggcggctcgatctggccgggcgggggtaggtggttggtggttccgctccgatagacctgcgtacgtctcgcgtgcacgcgacaagtccccatgatcgtcaagcgcagcagattttgcggtcacgagtactagcatgcggcgtttctcttccaccggcaggcgcaaccaaacccaacccccaccggccggcacaacccaaccccagccacgtttttcacccgctagattattactacccccatctttttcacaactatatactatactatatactccctccgtatacattattttaatgtatgacgccgttgattttttaaccaacgtttgaccattcgtcttattcaatttttttatataaatataaaaatacttatgtcatacttaaagaacatttgatgataaattaagtcacaataaaataaatgataattacataaattttttaaataagacgaaaggtcaaacgtttatcaaaaagtcaacgacgtcatacattaaaatacggagggagtattacttacgcaacatagaagtgattgacaagagatgtactttacagtgcattagcaaggagtatgtgattttgaccctaagttaccatgttcaaatcccatcacacttacaatttttcttaaaaaatatttggagtaacgtctctttctctaaatctcatttttttaagtaactgacaaaaatatttagagtaagaatcatactaataaggtacatgcacgcacgctacgtggtggagaatcagattcggtgcagacttgtcagttgttatatgatcaacactagcctcgtcgacggtcgttatacatctgtcccaaatctaccaattcagcagtgaagcgctcaagaccggaagaggactggtcgtcgactggacgttggacgaggtaccatcgtcaggttagatggcggttggcttcgcctctcctcacctgttcttttccccaagtatttccggttcatcttggagctcatggaaaatactccctccgtattttattttaacgtatgacgccattgattttttgacaaacgacctttcgtcttatttaaaaaatttatgttattatcatttattttattgtgacttgatttatcatcaaatgttctttaagtatgacataagtatttttatatttgcataaaaaatttaaataagacaaatggtcaaatgttagttaaaaagtcaacggtatcatacattaaaatgcggagagagtaacatagaatcagtcaatggatggtagtagtagataggtccaaggactaacatgagctctcggaactgacaatgaccaataataacagatccattgtattgtcgttacgtgccacctgccaatggattagacatgggaaaaaaggcatcattagtattaggaatactagaattactgcatatcgatttccctaaccacgtagtgcttacaacacttcagtgagttggtgtgtgatcagcttagattgaatcatcctacttatttgtgagcaacttgctggtgcactagctatcttgtgttagtaactagtagtacgtagtacactaaacattcactggttcaaccaatacagagaaatgcctttgtttgactatattcatattcagagggtcgtaactgtttactggctggcatagcacgagctctaaccaataaccactctgaccgttcacaacggtcaagaacacaagtaatctgtgtcaactaaagtttaaagggaggagaccaaaacagagacatttttttttcttttagaaaaaccgagttggtccagaagggtgaggtggtaagctttttagtcagaacttacaccttacatttttacaactattatttttaactcagttttgtagaacaaatcttcaattcaaactgccgagctgatatgataaaatcgaaaatgaccctgcccaatgtggagcaaatcaaagagggaaacagcttgtttgtagtcagtgtataactacaaaagaaagtataataaattgcttgtgtaattttcatatgattaaatttttaaaaagcatataatcattagtcgttttgaccagcaagtgaatatcagcatccatgaacctacatgttcaaccaaatcaacaattcaacgcacaagtgaaccattaacaagacaaaaacataccttgagcctttgagcacctcacgtaagcattgttgcacttgtagacagaatgataagacagtgttgtagctgcaatcccacattctaaaggctactaaactcctcagcttcaaacatagattttaggaaagatgtgtagcgaattgatgaacttaaatagggctgccttttggtgaagaaagctttgggtgaggatgctacactagtatctagctccggccttaaggatgctatacgagtttctgatgctttaaaaaatggaaatagcaataagggactgttttcatcatcccatttaagattgtcccaccatgttttctcccccatgacactctttaatttgacaattgcatgcccaaaaggcagccttctcagcttcggacaagcaaacacatcaaagtattccaaagaaggaaggtctaggctaaagttacagaagttttccaagcttggcaacgaattcaattgcaaaattctcagtcgtcgaaatccctggattggcatttcatcttgtacttcagtattgattttattctttatatggacaagctgtttcattttattgcagaaagacacatccaattcggt

SEQ ID NO: 62129 - DNA, 10614 bp, Oryza sativa
atctccataacactgtggcttgtttgtgacagagaactcctttaattctgaacagtccgttatattaagaacaaggacactatctggtatagtgagcgcaagagatgtctcgccactcaatttatatagaccaagcaatctcatgtgacttccatgaatatcaaggagcttcttcaaggtactcactttcttgattgttattcccagagcttttagttctctagttaagcaagataactcttctattctaaactcatcataatccatgtgacttcttgaatgaaacccctcttcacagccagcatacctgctaccatataagtccaacacttgtagctttgataaatttggaataacaccatagggtatcttctccaagaaatccatgtagctcaaatttaggtacttcaactttgttaattggccaatcgccacaggcaatgatttaatgagtgtttggttcagtttgagacattggagttcaactaatgcgccgatttcttctggaagttctttgatgggaatccaagacaagtccaagtatgtaacagacgataagcatttaaaaagagaaggtgggatcacattcaaccaaaagttttgctgcagtgacagatattggagattgtaacagctgatagcatgaggaagttcactgatataattgcacatgagcgatatctttctggctgacctccatttctcaatatccctgctatcaattttatgaattccaacccctgcctgaacaatccaattcatgctttggtcaacacagccagaagatattgacagtgccatatctcggataatgtcatgtattctcacctccctatcttccaagtagccagcctccaataagcaagcatttttcaagtactcaatgatggagtggcccttgtcatatgcttcctctatagtatcatactctatcaaacccatccccatccaacagtctatcagtgcaactttccaaattgagtagccttcaggccacagagaacagcataagaaacaatatttgatctgtttatcctgcagataatcataacttaattttagcctagtgtatatgtgactagtatttcccatatttgggatctcatgaatgcgggacttcttcagatatgacagtgcaagtgcccattcatgacgagtcctctttgtggacattgcacgaccaagagttgcaagagcaaggggcaaacccccacattcttctgcaacttcctttgctaggctttcaatcctaacatctgaactaataacttcttctgttgctttttctttgaataatcgccaagctttttcttggtccaagcattccatgaagatcgtcttgtgagctcccatatgcccacaaacactctcagaacgtgttgccagaactactttctgcttatttaggccattaggatatggaatgccagcttcagctaaatcaaaataaccccataaatcatctatcagaagtaagaatttctttctccttaaaaaacttaacaaaaatgaagcccgtatattaatgctacaacctggtttcaggaacagcccgatcctttcagcaatatctgcttgaagctgacctattccactggctgtagatgccacgacataaacaacaaggtcgaatccataattttctttggttacacctaagaagtgattgttgatttttctgagcaaggtggtcttaccaactcctcccattccccatatccctaaaattccaacattgtcatctttgaggtactgcagaacttctttcaaattacactctgtttcttcagttgaaggtatggtgggcacttcttgcacgaaatatggtggtacctcaaatgatacctctttgaatgcacctttttcatgcaacatttcagcttccttcagtttcttcgcagcctgcatgccaatttcgtactttgaccaataactgaataattgctttctcttcctctgcacattttttatctcattcacctcagtttccatcgctgctaccttttgtagccattctgtaacttcaggattacatgtttcttgcttcccctcagagatactaagccggatttggatttcatttttcctaacttctaggtttttgatagtgttgtccagctttccaatattttcttccatctctattagatatctgaggcgtgcgaccaaaggattccataagtgggatgccaaagtactagatatggaatcaatcagcattggaacatacatgtgtaacaggaaaacgaggtgacaaatagggcaatgttttgaaccagctgttgcttcaattaacgagacaaaggatgtcgaaattgggagctgaactgcatatgagaaagtgcaatttataataagtgtgcgaatatgcatgtctttatgcctgtactttctaccatgtacacataatttgaacaggcatgtaaagcccaatacatgttgtactctttttttaatccctgtagtaaagcactaaaattatgtatcttatttctgatatatgtagttcaacctagacgacaaatcgaagttaaagatttatatgatgaatattttattgaagctataaaactattttaggatgaaatcctacaaaaacaggaagaagatcattatagtcatcatgtcatcagcatccttaataagttgatgtcatctatttccataacttactagtaattccagttaaacctaaataggagaagccaagcactgctatgcgccaacaacaccagattgaatgacctccttcggtcattccggcaaaaaaaaacctaaataggaacagatagagctaaaagatcatattgatattgactagggaacctaaaacttcatcagcaattgatagggcacatgaaaggcgtctcaacgcacattatacacctatcttgaatgcatgggtgatgagatgtcaagtggacgttgtgaagcaaaatcaagagaagaacagatggcacgacaatttgtcagatcaattatgcatcgtcctaataaaaatattcagaatcaaattggtcacccaaagaggaaacgaaagggatatcagtacttacagtcacggatagaaggtctcgacacgacgagaggatgctgaattaggccactagaggagatctcagcacaatgtggccatcagcttagctcgagctgcaagagaagtttcaggaaacagggaaagagaggcagaccgtagacactgtacaggaaggaaaccacaaaatggttgcgtgatttagttgtgattcggagggggggaacttcactgggaattgcagacacggcgacatttccagcaggatcttcagtcgaaattcccagcgttgacttggcggaaaactgccccctgctagtctgctacctgcttgcgctgacctagtttgcgtcgacgagctgcaacgaccaccccgatttcgccaacggcgacttcgcgaggcttcagaacggccatcagatctcatcaggcaaaggctaggtggcaaaatgggccgggccttcccgtgccggcccagtcaagcccgtttggacatgggccatgctgacacgacccaaggaacgaatgaatcgaggaagccactagctcaggccggagaaaccggtggtggtggtggccgcggcgctcgccgacttaggcctacaaggcagcacggtggtgcggccagccccatccacgggcatagtagtcgagcacgtcagagactctccgtctaagggcagggaaagggtgacggtggccgaaccatcgccaatgccctatctatggtccacggcgcaccagtccaccaccatcgtgaacaatacatatatttatattatattcagttttattgtgtcacatcagatattatataggctgtttagatattaataaaaaaactaattacaaaattagtcattaacccgcgagacgaatttattaagcctaattaatccatcacctttgcatttgctgtatataacgataaagcaatataatactccctttgtttcataagttaataatttgcaggattcaatttttgcgcgtgtaaggaacatgcacgtgaaaaaggaagtaaaaaatttaagaaaaaagaaagaaaatatctcacgttaagaccttttgtttaatcgataagagataaggaatggaggagattgagagaacaacaccacattataatatggatgagtctacggtggaaaaaaaataaaccgaattcccttaataggggttttcaaaatatatgcggttttttttctgcaacattagatatatatatagtgaaacattgtgagtacattatgtgaaacattttttgtggaaaaaaaaccaaattccttaatatatggtttctaaaatatgtgggtgatttgttgcaatgaagttgtgtgtggataagtggcagatggggacatgggatatgtggtggggcccaggtgcacatgtgatggggggagggggagcgaccgatttttttcccctcctatcgtgcgtccgtcgttgagtattctcgttataacatatgtggaataaatactttttaaatcccagcaagtataataacatattataagtagctataagcacatatggaggagataaaagatgagagagaagatccgtcccaaaaaaactcaactcttggagtttgaattttatcaaaaaaaaccaacttctaccatcctacctaccctcagcacgtaaaatgaaaaattttattcctttggtaccctttacctacctatcaccattactattttttttaataatgagggatattttagccattttcacttttcgctaattttatattgggatgctagggttggattttatatgggacaaagggagtacatatttgtaaccagtaagctgtcacacggactataatatgttgtgtgtatatacacatatatatatatatatatattattaatgacgtagtatgtctgtataaattggttattaaattaattatagataatttgaaactggtagtcgactgtgctattaatcttgttcttatcccctcgtaggggattaaacgaaccaggctttaagggaaaaaagaaaaatagaaaacccttttggtcgtgaactgtgtcgtctagcctcccactaatcccggtgccttcttgatcccaccgatccccgtgctttcttctcttcggcatcgccacgaagcggagggtgccatcgcagcagccatcgccgacgagcggctcacggtcactgcggcctcggcaacgtccggcgatcgtcgtcgatccttaccttactccctcacgccccctaggtatgaagccgccgtactccaacccaacttctatcgcctttgaaaccctaggcaggtaggcggttgctttgccttcggtgcggttgttgtgctgactctctcctcgccctcgccctcgccctcgccctcaccctcgtcgccggcgattcctccgccgtactccaaccctagctgtcgcctttgaaaccctaagtaggcacctaattaagtgctaactctttctgaatgtaatatcacaaatctttcccaactaattcagtagcattcggttaagcccaacaccatacagttgttggtactgaaacttttttcccccttttccgttatcttcagaagtaacaatcagtcagttacttcagtaacctgacacttgtgttctgattgcctgatccaagttgtgatcttagttatctgcttcttagcttgtgaatacgagtaagtagtagtaaaattggtgtgttttggtagattttgcttgtaattcctagcggttggtaacttggtatattcataattcggctaaggtttgataaaagctgcagtgctgcacatcagcctttttttccctgtgcacatttgcttttcttgtgtttatgctacttgcttgatttattgctattgttcctttgctcctggaggtggccaggggtagcctgcctgcctgcctcattcatgttttctatcatttagtggctattcgctttgaagaaattaatgatttatgcagctgttcctttaaataattattggttaatcccttgaatttatagctgtctcctcgagaagaatcctgcttaagttgatttacctccgggtgtttacggtctttcaaattgctaagcataatcttgaactttccaagaaaaaaaacaggcctgcattaactagtgccagggcagcaataatggatttgtgcgacgacactcatttcccatgggaggtaatttttttaaaaccagaatcagccaagcgccaaatttatgataattattcttcgcatatgtataattttgttccttgcaggggtcccatactattgttggcagcaagcggaaagctaaggatttaatggcaaaaatctgaacttgtttaatggaacttataagatggtggaaaccacagttgatgttatgataagaaaaggaacaaacatgagactcgaaagctacgagtttttgagtgatttcaagcatggcaacgctgtggtactcctggactacacagagtccggaaacaaggggagtttcatcgtcacacaagttgatgggtcattcactgcctggtttgaaacaggtggaaaagagctctgctttgactcatctggtcatattactcagttatttaaagacatgattgtgtgagtatctttattgttgtccatatttttaactttcttcttgttatgttctctgaaatcatttttatttgtgtgaagcgatttttacgatctgacctggagtttgcacaagaggcacttagtcatgcagaattttgtaaaggaaaatatatacgtcaaaatctttgatggcgtacccaaacttatgattctactaactgaaggtatatatttgttgctagtaacttaatggaagttcacagttttttttttatatataaacaatggcaatataacttgtacactggattgaaaatgcgatttaaattttgtacagttaaattggttgatcagctagggccattcaaacaggactggagtcatgtccaaggcctcatgacttggtgtaaagaacaatctggtttaaaaatggactttcttaccaagagtttctatgatttcatcggatctaccgactgcacagtaatcaagctgagaaactaccctgatgattgggatgaaaaaaagaaaggtgattatttgctcacactcgcagaagtaaaccacggagttcttaaagataagttgaagagtagggatgattttcattggccgtttgtgaagctgcctaagctggagcagaacttaccaccaatgttacagcaaattcttagtggggagagacagatgaaaagaaagttcgacgtgacattcttttgtgattatatcaacctcttgagaaactcctacaagaaattcaatgaattaccagaaaatgttaaggtaattgcttaagatgtttccagattgaataataccttcttttactgcaggatttgttgtattcaaacatcttatgttttgacaggctttatgcataaaccaggatggcttcattaaactgatagatgggtggtctcctgagttttggaccaagatctacgagaaaattggtaaaaacagtctgtgcctttggttttaggccttcgtttgactgtgctctttttggaataggggatttatgacggtgttctctttttgcagggtggccagattataatatctggaagtggccttgtaaaaaatagctttagtgctttgcatttgaccagtgagtactgcattaatacttaatgtatgattcctgtacgctttcagttcaagatataaccttagttatcattgttctatgtttgagtaccttattagattgctgcatttatatagcttgtttgggatatggatttccatccctcaaggggatgtcccctcgttgattgtatgtcatctaaatagttataaaaaaatttaaaaaaattgacaacatagattaatatgaaatatatcatgagaactgtggtgctcaattgttaagaggtaatgatctccttgtgagggctaattttgtgccggtttggtcgttgctgtgtagtggtaggaggttgtgggtggcaagctgttatgaaactcagatgttttttttcttccttttcagtcttttgtatcagactctgtaattcctgcttcaggtccttgatctaaaaaaaaagttcaatgggctttggaaaaatctaatactttctccgtttcacaatgtaagtcattctagcattttctatattcatattgatgttaatgaatctagatagatatatatgtctaggttcattaacatcaaaatgaatgtgggaaatgttagaatgacttacattgtgaaacggagtgagtaactgctactcaaattctatgcacaaagatttgtactgtccagatgaaaaaaagggaacttggtgtgttttgtgctctaatcctgaaaaaatgttcagcacattctctatgaatgtcctgttgcaaaattcacctggtgtgtttcccgtgatgcttgtggctggagttttctcccctctgcttttgaatcttgtaatttctggagtagttgggctagccggctccaaaaggaacagaatcaaaatcctttgctttgctgctgtttgtttatcaactttggctgatgggcaacgatatgttttttcaaacaaaaactgttatctactcccccctgactttgattttccgtgtcatttcctccttgtttaggaacactgcttgatctcaatgatggcgatgccggtgcccgcgctgacattctcaggacatatggtgctgttctgcaggtccgatccttagatggctcctgttaggagtttttggttcttagaattatgttagatgctatctcgaaactctcaagtaattttttgtcctcctgcatgaagcaaaacttagtgtattggttgaaaatctggcatgattgaatggagaactatcgagattcattactgtgagtccatgcacttttagaccttttagataatgatgcacttctagaccttgtttggatgggcctcaattccggccagcgcaagtggatgtgtatgaattcaggctcgtcaaatgatacgtggcctgaatcaatataaacacatgctgagttgtgttggtggatgccgagtacaacaaattaagtgagcgtgcataattattattcttagtcggtgttgctgaccatgtatttgtgttgtttaagtttttcgactttgttgtgtttgttgcgtgtgtaacgtcgaatgcaccaaggtctagtttgcgttgggccatcgacatactggcatgtttttgcgccctttgaactcatccaccaagatggctagggaatcgaaggtcatctacactgccttcccttgcattgaaggcttgaaccaccactccgtgtgaaggtgccgtcgatgaaataggatttggttcagggtggtgaaggtgccgtcgatgaaataggattcggttcaggtgcagtcagtcacactaggaccatccaagttgtatctaaggactgagattctcggagcaccgttcacataaaaaaaaatattgtacaactattgtagcaatggtactgtagcacttgatctacatccttgatctgaaaaataaatggagcatgggcgccacttaggggtgtttagatccaggatagtaaagttttggtgtcatatcagctattatataggatgtcgcataaggtatttgggagctaatctatctatctatccgccagctgattagtggagatgacggcttgtatttttctgacacgtggcacgaaccaacatcgtatagatgattctctccagcgcggctgctgtttttctcgatacatcgcatacgtacgcgttcatctgggcctaaagcacctcctgcataagaagcccattagctagccaccctgcgctatggaaaggaataagatcactttgactccctcaactgaccaccgaatctaaatcatatccctcaaccgtaatactgaaattttgactctcgaactgtcactcccttggtggttttttagggtggtttcgctgacgtggcgtacacgtggcagtgttgacttggtcttcatcccacgtgacattgacgtgacgcttatatgccattaaaatttaaaaaatatatatggagctcatttgtcattaaaaaaaaaattgtgggtcccacagacatgtgggtactacatgtcatcttctctctctacccttcttcctcctctctcccttatctctctctccccttgacatgagccagcagctggcaggggctcaagtggaggcggcagcaggagggtgcgcggtggacctcgggcgacgggcgcgggagcagctcctccttgcggatgcagagcgggcgctcaaggtgcgcaagagcctgcaccatgactgccaccagcgagctcctagcatggcatggggcgacgtcctccgtcgacctccacctgaagcttcccgacgaagacctccttgcgcgcccgcgtgttgaaggtgagcggtttggcctgaatcggccggggtgagcgactgagcgcccgacgacgccgccgccgttggtggctgcttcatggagtgttccctgctcagcctgaatccgttccggttcaagccgatt

SEQ ID NO: 62130 - DNA, 659 bp, Oryza sativa
cggtggggtagacgtagaagatttcgggctcgtggtccgtggtgcggaaggggcgcgagagatcggggttgaacacctgccagaacgactgctgggtgtagccgacccagaccgaatccttgcggccggagctggagtcggtcagcaggccggaggcgatcttggtgcgtgccgacagctggatgcgcatttcctgcggctggtagtcgcgcaccggggcgggctccttgccgggctgctgggctgctggttgatgtggtcgctgcgcagcaccgacaccgacagtggcttgtagccgcggaaggtgaaggtgccgcagtcgctgccgggctccagctcgaaaaagcgcgagatctcgctgtagcgcggatcgcggcagccgccgttggtgggcaccaggccctggccgggcagcacgtcggcctgcaccatgggggcgttggcggcctgctgcagcacggcctcgggctgctgctggcactggccgccggggcctgccaggtgctggccgggggcggggtcaggggttgctgttgctgcgcccaggtgtcaaaacaggccaggcgggcctggttgtcggtggtggcggcgcattggcgccaggcctcctcgcgcacggcgccgggcgcctgggcctgggcggcgggcagggcggtgag

SEQ ID NO: 62131 - DNA, 13002 bp, Oryza sativa
ttctctgggctttagtcatcacatatggagcatgtggagcagtgcatgttgaattcccatcatccttcaagtgtaaatttttccttatgcccatatcttctaaatcgagcctcgcagtaacagagtcctttgacttgcctgcgatgtcgagaaatgtaccaagaagggcctcacatatatttttctcgatatgcataacatcaagattgtgtcgtagctttaaattagaccaatatggcaaatcccacagagtcgacctgcgcttccagcattgaccttcttctaccctctttctctttttgttattaggatggttcccaggtcttacatgttccaccctcgccaattgctgcatcaactcatcctgagtaaattcttccggttgcgcacgttcttcagtctgaccattaaaatctttctttctcctccaaatatggtccactggaagaaaacggcgatggccaatgtagcaaatcttgttcctaagtcttttgtagcaaggatttttatcacaacaaacgcaagcatagtagcctctagttactctacctgaaagtgtgctcaatgctggataatcatgaatgcaccatatgattgcagcgtgaagatcaaattctttgccggtcaatgcatccaaagtagggacaccactccaaagatttaacaattcttcaaccagtggctgcaggaagagatccatatcctttccagggcatgtcggaccaagaataagtaggcacatcatgaagttggattgctccatacattgccacggaggaaagttgtaagggataagaaatactggccacatgctatatgaggagctcatcttcccaaatggattaaacccatcagtagcgaggccaagtcggacattccgtgcatcatttgcaaaccattcatactttctatcaaaatctttccatgcctcaccatcagcaggatggctaagctcattgtccactggtttcctcttcaacttgtgccattgtgcctcagctgaaagttctttcgatccaaacatcctcttcaaccttggaatcaaaggaaaatgccttagaaccttttctggaatcttccttcggctatctgcatccttccatcttgaagcaccacatattgggcatgcatcctttttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtcaaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgactttgttcttggtccatgattttgatctgggtacagatcctgtaccatacggtacatttgatcatcttctgggtcatccggaggctcattcgtctcaaattcaacattgcagctaacatcttcattcaaatgctcaacattgcagccaatatcttcattcaaatgctcaacatttccagtgacaatgaccaatggttctccatgatgtatccaccgagtgtatgtgttagacatcccgtacataagtaagtcatcctccacacgtcctttatattgatgtaaccgattcaaacacttacgacatgggcataatatcttctgactgccactcaaatttttacaaacaaagtccatgaactcagtgaccccctcccgatgctccttgctaaacaacttacaattcatccaagttctttccatctgttacatattgaaataagacaagcattgaatcaatgactgatcattgcccagactgctattttcctatttctatcacttcaaatctatggtttcagttcaaaatttaaaaccaaaacataagttcttctcatatgtacctttccttcctaattgaaggggatggggcagtctctggtcgacctcacccgccgtcggcagtgatcccaggctagagctcttgggggcttcctagcggttgagcccgtgaagcccagcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggatggggtggggcttgggatccagccggcggtgccgggctccagaagccgcgttgggcgaagggcgacggcgtcgagctccaacagccgggcgctacgttggggacagggtggggctacagcctgcggcgttgggctccagcgggagcaatgggaaagggcggcggcgtcgggtccagcaggcgcgatggggaaagggcagtggcggcggcgtcgggtccagcagccgcgatggggaaagggcagcggcgttggtctttgctagatgtgcgttgggattcttatgtctcccagcaatagtctacaagatgaaaagaatcaaagattagctcagtggtttgtctgttacctgggatgccagaggtcgtgtgttcgatccctcctcattgcaagaagcgctacatttttagtcttttcaagttaatattctaacttacacatgggtcccacatgtccacctagacatgctcacgtggctgtgccaaggtgttcttttttaaaaaacaaatgatttttaaattatgacaatcatatttattcacttttgtcatgaactattgtcacaaagaatgggaaaggcacatggtgacattttcttatgactaaattacaacttagtcacaaacgcttgtcatccaaagaaaaattgtcataaaggcatcactactgtgactaaaatgtgttttgtcatatgaattttgtcatagaaggccaaatttcttgtagtggcagggggcggcgactccgggttggcgaggctcgcgacgaggccgactttgccaggcgcggcatcgaggtagggcatcgggcagaggcggcctcggctttgtgcagccttgcagcgggatttgcgggcagggtggcgttgtcggcttggaagcgacgacctcggtctcgcatgctaggtacttgttgaaaagtccagaagggagagagaggaagaggagagaaaactgagattttgagggaaaattttggaataattacattgctccaaagcttgtgcaaattttactggagcttaatgtggtcatttactttatttggtgattttctgggatttttcgcatgtgtagattattttttgaaaattgaaagaagttttacgatttttatttcaatttgaacaaattttgatgttttctcctttttatttgagatgcagataactgattggttttttttgttctatatatatatatatatatatatatatatatatatatatatatatatatatatatatatatatatatacctaataaaaaaaatacgtaaggcttccttcattatttttggtccgtcgccgatttcccacacacgcatgcccccacccaaaaaaattcccaatcggaattcaatcatcttcacaatgggaattcaatgaaaccccccgaatcccaatcgcactaagaatcggatacgggacacaccttccaacatcggcacacccaaatcgcatgaacacaccgcaagaaaaattcaaccaatctttatccccaaaaaaatcatcccacatacatacatcacaaaactacacaccctcggccgtcgccgctgtcggcggatccatccgcggccgccaccgacgccgccactgccgacggatccatcgccgccggatctagggcgggagggaggcgacaggggaggagggagccaccgccggccatcagccgccgccaccgctgacggacccacctgccgacgccgccgacaccgccatcgccgccggatctggggcaggaaggagtcgagaggtgagaagggagccgccgccgccggatccacccgcggctaccgccgccgccgccaccaccggcggatctgccgcaggagggaggctagagggggtggagggaaccgccgccgacgccgcccctaccctcggatccgccgcaaccgccaccaaccggccgccgccgacccgagagggagaggaggagggggggcgccgccgccgtcgctttgagagaggggatcgggggcgccgctcgccggtcgctgctcagcgccaccgcagccgctcgggggaagaaggggggggcggcggcgccgccgtcgtcgctcggcgagggggggggagggacggggggaggggggaaatgaatcctagggttagggtttgggtatttttatttagcttaggattaatctggactgtccattcgatcggacggctccagctgctcccacgtcgggccgccggcctattgggccaccgaatggaggacgcaaaatagacttcaatggagaaagaaaacaggccagacacatagaatagacaaaagggagggaatataaacttttctatattcggcccaaacatagaaaggaggattttgatttttttttccaattaaataatttgttaaatgatttttgtattattaaaaattagcaattaagctctgataattccaataaattccaaagagcataactaatcatggagaatttaatcaaattaaatttaaccatgtcattttatttttcacacttgctttacttgtaaattgatttaattatacacctacctacttaaaaataccaaatattttaatgaattacataatgtaaattttttttaactttttctcaatttttttgttctgtacacttcccgttgcaacgcacgggcacctttgctagtatatatatatatatatatacacacacaaacacatatacacatgttttgtttttctcaattttaatttaaatatgcaaaaatgcaatgatgcgtagaaaatccaaaaaaaacaaccaaaataaattttcaccacaataaatataaatgaaaaatctcattatattgactttctaaggtttttgttttcacaatttgggtttgttacagcttggctgatcggcgagctatctaacgctaacgccttctctcctattctcccttaccctcgtctccagccttgctccctgctggtgctgtgggcatcgcgttgctactatcgtgaccagcgtaggacctccttgcatcccaaccaccggtgccaccatctcctactagcactgttgcctctcttcgcatcggctggtgtggctctgctcaaggtacggagcacgtgtgtgtcgtgaggaggaagcgcacacctacataatcgtcaatgaacaccgcatgagttaacttctgtggcaaactttattttttttatagtagtatataataagataagataaatcctacttcctccatttcaggttacaggacgttttaactttggttaaagttaaactacttcaagtttaactaaacttatagataaatataatatttataatatcaaattagttttattaaatcaatgattaaatatatttttataataaatttatcttgtgttgaaaatgttactcactccgtttcgaaatgtttgataccgttgatttttttagcacatgtttgactgttcgtcttattcaaaaaattttgtgaaatatataaaactatatgtatacataaaaatatatttaacaatgaatcaaatgatagaaaaataattaataattacttaatttttttaataagatgaatggttaaacatataataaaaagtcaatagtgtcaaacatttcgaaacggatggagtattatttttttaaagccagctcaaaacgtcttaaaacgaagggagtattctatccccccccccccccccccggcgcccccccccccccccctatcttgtacatgagttacctacatctcccgtgccccgcatcaattgtctcgtctacgagcggcaccggacgacaagcagggcggtccagtggcctcctctcgccgccgccgtcaacgactccttcccaatcccggccttctctctccctggtatgcacagggcacagcagcagtgccggcccggctctcaattctaattttgcccctgtctcctctttcctgcctccctcaaggttgctagctaatcgagattgatccaggaacggcccggggcggagaattttggagccatgggttttccttccagtttcacggcattggtgttcgccctactgcttaccttcctacagttttctaaggctgcaaacagccactatcttttcaacaaaaccagtgctttggaggcggccgacgtcaatggcaacaatagtgcggaaatcttggctgctccactgtacccggtgagtcatagttacctattggagattgctgttgggtctctgggcaaaactagacttgtcagcttcgacacagccgtcaacatggtatggctgcagtgttcagattattgtagggattgcaatccctcccaagttggtactagtactacgtattacaatgctagcatgtctataagctacaatcctctgtcttgcgatcacccactctgcggtgccggtgacaaccatgaccaacaagtattagctgagtgcatggatggcacatgtactttcaaagtcgattccttggacaataacggcggctgggtacaaggcattctagggtctgataggatatctatttcagaccatttcttcttcctttttgacaccaacatcatctttggttgtgccacggtagaccactcaaaatataccttagatcaatatggtagtagtggtgtggttggcctgggcctaggtaaatactcactcccacagcagatctctgttacgagattctcctactgcttgccatcctgggttaagaacgagcttttctcacctccctacgtgctatttgggagcaacgcggtgctgcagggcgatatgacaccgttcctcccagggtttcccaagtactacctcaagctcgaagggatctcctatggaattgttcgtcttgacatattcggcagcaatgccgctgccgccgaccaatatcatcagcaggcacaattttgtcgtggaccttaccttccagatgctcagttctatgccatgtcagtcgagtcggcaacatttccgctcatgctgccgagtcgcgcatacgagctgcttgaaaaggaatttgagcaagacaatcctcttcttatcaagtctcgcctccaacccatgaacacttgctacaaaggcagtgtcgacgatattgctgacaatgccactataacgctgcatttccatggtggcattgatttgcagttgtccaggaatgccacctttatggagatcacctccatgaatggcgaccaagaggagcgctatgtgtgccttatcgttgacaagacggtggatgggacagcggtactgggcttatcaccccaacttgaccacaacataggatttgatctggagaacaagcagatctcaatttatcgcaagatatgttagtttgtccccttattaattacattgttaattttcttctactagctaattagactcattgttactgtacttttctgcaagcaccattcatatctaatatatgcatgctgatgaaatgtaataatgactatgactctcgtagcttttatttttttattaatatcacatagcttgccaattcatgctgggcaagacatgcaggttgttacacgcattgttgcatattgtactacacaaacccatttgatactggatgaatttgatttgtgtggtgaattgagaaatccaaaaaaactctcacaatctttacagctgctgatgagcagtcaaaaacatacatagaagcttcttatgttttcaaccataaatcaagctcattatttcattaatagtaagaaggatatatatattctgtgtaactcaaaagcagcaaaacatatatggataaataatgcagcaacttatgcaggtctttgcaacatttatctgttaagtagagagacaagaaaaatattattgcgctactttatgcgtaagggcattgattatttgaactggaagcatgaacacagtgaaacactgggtttgttcatgcaagcaaaagacgtataccttaatttgctgcatggccacattcacatggaactcaaaacctcattcactgtgccgcatgaactccctgttcttcttcatcttctctagcaggtagggagccacctcattatcgaactgcctgatcgccctgtcatatatagcagcgatgatggccgctagtccgccaccaccggtgcatcgccgccggagcttctctatgaaggccatggccgcggtgtagccgtgtaggatgttagagttaatcttgttgttttgcatatttgtgagtcggtcgtatccagcattggtttgtgcaagttgtgtacgtgctcattatctcacattggttagtggccaagagaggcagccatgatgtgagtgtttgtgcgaccaggtgcttggtcaattcgtggagagtgcttaggagcaaatcagccgatgcatgcattagttagtttgatcacacgttggcttggagttatggccaagtcaagcgaatgagtcatggcgagaagagtggatcagatagctcatgcatgtagtgattggtggtgatctgcatgtagagataggtgctttgagtgtagaaaagtgaatagtggccacgggagaatttggccgagtcgtgcagccaaacgtggcaaaacctgtgcgtgtgtgtttattatttaaacgatgtaatcagaggtgggattaaggagtgtggtgaagaggtgggattaaagagtgtggtgaatagaagtgcagcagtgtgcgtgtgtacatttgctgctggtgtgcagtgccgagacaaatacttccattgtgtgtgtgtgatcttgtgttcgagctaacataggagactgcattgtatcctcaaacccgtgggatgccgtaggtttggtgttagatctcgtttttgccccagagtctcacgttgaactgtggatcatcaatagggcgacgtcgagaggtacaggcagggtttgatctatcggaaagaggaaaattttaagggtcagcgaaattacgaaatttctaaaattttggattttttttccggaaatttcatacgaaatttcaaacaaaatttgaatttgcacataaaaaaaattggggaaaattgacctacacctcaatggagtagcagagcgataaagggaacataggagaatgaaacagcgagatgcatgatgcgaggtcccgcccagcttggactgccgttatcatcgatgcaatgcgccggagagtgcatccgccgctgttcaagccaacgggcggtagagtgctgttgttgcacgttgccagatcgagagccgctgctgtcttcgagccggagcaagcctgctaatggtcttgaatccactccatatccaaacctaaccattcgaatcacagctgcttccccagaccaaaccaatccacccaccgtgttctgaaacccaaaccaattcaaccaaaataacatttcccccaaaccgaaccaacccattttatatttttggctgaaaccatttccaaaaaccaatccaactatcggaggcgctgccgtcggcgctcgctcatcctattgatgttgatcatcagacaaagaaaggaatgaaaattgatgaattgagttacatgtatgagttgtttccggacggcctgaaactcgtcgttccttgatgagcagagcatggttgagcaactcctttgctcgcatatcatccatcatattatctttgtcttgctctagcttcttctccacattgtcttggtcgagctgcttcgacgtcgcgccaagctccggcatcttctaagtggcagcgatggccgagctccggcatcttctcggcggcggtgatggcagccttggcagggatgcggctcctgctcattgggtagtaccagcggcaacgacggcaaactgtgttgagttgtaatccaaattcatttgcacttaataaagaccagcttctgccgtagtggagcggaggcccgtcgccgggaggcttgggccggagcaaaacggatcgtcatcccttttagggttccaccatatatatacctcttgtaagccgccgtgcggcgtggtaacctcaccccagatatagtgaagatattttgctggctggcgtccgtggttttttctctcctactttgggagggttttccacgttaaatctcgtgtcttctgtgattgatctattgttttctttatcgtttgttcgcttatcgtttcctaacaagtggtatcagagcttgttcccacattagggtttcacgatggcatcgatgaagtatgatctaccgctgctagactacaagacgagattctcgctgtggcaagtcaagatgcgggctgttctggcgcaaacttcggatcttgatgaggcgctggaaagtttcgggaagaagaaatcgactgaatggaccgctgaggagaagcggaaagatcgtaaggctctgtcgctgatccaacttcatctatctaatgatattttgcaagaagtgttgcaggaaaagactgctgcagaactttggctcaaactggaatcgatctgcatgtctaaagatctaaccagtaagatgcatatcaagatgaagttgttctcgcacaagttgcaggagagtggttctgtgttgaaccacatatcggtctttaaggagatcgttgccgacctaccgtcgatggaggtacagtttgatgatgaagatttaggtcttttactgttatgctcactgcctagttcatatgcaaattttcgtaacaccatacttttaagccgtaatgaactaaccctagcggaagttgatgaggcactccaaaacagggagaagatgaaaggtatggttcagtctgatgtgtcgtcctctaagggcgaagcattgcaggtcagaggcatatctgagcagagaacctacaacgatagcaataatcatgacaagagccagagtagaggccgttccaagtccagaggtaaaaagttctgtaagtattgcaaaaagaaaaatcatttcattgaagaatgttggaagctgcagaataaggagaaaaggaaatctgatggtaaggcttctgttgttaccagtgctgaaaactctgattcaggatattgtcttatcgtttttgctggttgtgttgctagtcatgatgaatggattcttgatactgcatgttcgtttcatatctgcattaacagagattggtttaattcttacaagtctgtgcagaatggagatgttgtgcgcatgggagatgataacccacgtgagattgtgggtattggctccgtacagatcaagacacatgatggcatgacacgcacgctgaaagatgtgagacacataccagggatggcgagaaatctcatctctctcagcacacttgatgctggaggatacaaatactccggttcaggtggagttgtaaaggtatctaaaggttctctcgtttatatgattggtgatataaattctgcaaacttatatgtccttagaggaagtacattacatagttctgttaccgctgctgttgtttctaaatatgaacctagtaagactaacctgtggcatatgcgtcttggacatatgagtgaacttggtatggcagaattgatgaagaggaacctgttggatggctgcactcagggtaacatgaagttttgtgagcactgtgtttttagtaagcacaagagggtaaagttcaatacctcagttcatcgcaccaaaggtatacttgattatgtacatgctgatttgtgggggccttctcgtaagccctctcttggtggtgctcgttatatgcttaccattattgatgattactctagaaaagtgtagccttatttcctgaaacataaagatgatacatttgctgcttttaaagagtggaaagtcatgatagaaaggcaaactgaaaaggaggtaaaagtacttcgcactgacaatggtggtgaattttgttcggatgcttttgatgattactgcaagaaggaaggcatcgttaggcatcacaccatcccgtacactccacagcagaatagtgtggctgagcgcatgaacagaaccatcatctccaaggctcgttgtatgctgtccaatgctcgcatgaacaagcgattttgggcagaggctgctaacaccgcctgctacttgattaacaggtcgccttctatcccacttaataagaaaactcccattgaggtatggtctggtatgcctgctgattattcacagttgagagtttttggatgcactgcttatgctcatgttgataatggaaaattagagcctaattctattcattgcttctatatctggtgggaggcgcgacttacaggtcatgagttatagaataccgacctgctgaacattctgagcatgagtgtggtgtcaatgaatccgttatgtttacccgacaggcttgcccacagattcataccaatgcgttctgataccgagcctgatcatgggagctatcctgcgtaaccgtggatgatcaggaaactgaaattgttggtaatgatgttaatgatactgtttagcactcacctcctgttttgcagccacaagatgaacctattgcacatcgcagaacaaagaggagttgtggagctccagtccgccttattgaggaatgtgatatggtttattatgcttttagttgtgctgaacaggtggagaatactcttgagccagccacatacactgaagctgttgtttctggagaccgtgagaagtggatctcagctatgcaggaggagatgcaatctcttggaagaatggcacatgggagcttgtgcacttgccaaaacagaagaagcctgttcgttgtaaatggatcttcaagagaaaggagggtttatctcctagcgaacctcc

SEQ ID NO: 62132 - DNA, 1125 bp, Oryza sativa
tgcatcgaatagcagaagtagctagcacccggagagcaggaaagctaatatgaggcagttggtggcaagttagaagtaaaagacaagcatgatattctcatgatgacaagcatggtatcctagtaatgacgagctgatctcgacgcataacgtgaaatgggtaacttctatgaggttgacgccaaaaatataaactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcatgctagcctcctcgaatctcggggacgagattcttgtaaggggggtggatttgtcacgtcctgataaattcatcccgaattaaaaatcattcgctaaaaggaataatagaattaattaaaattcggaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgtttttataaaaagaaaaaccctaaaaagttccctttccctccccctccccctcttgggccggctcggcccagctccctccctctctcccctcttccccgcggcccatccggccttcccccgcgcgcgcgccgctgacgggcgggcccgcccgccaccctcgctgacgggtggggcccacccgtcatcccctacctcccgccgctcccgccgcctcgcccgtgccctagcgccgccgccgccgcaaatcccgccgctcccgccgcccccgcgtgcaataaagtggggggaatcattccccgtgattccctctccctttccccccatttttccctctctctctcgcgttcaaacgggcggatttgcccccgcaaatctcgccggcgccattgatggagcccgagatcgccgcgccggtttccttc

SEQ ID NO: 62133 - DNA, 730 bp, Oryza sativa
ctgggtggcttgggacgagctgggacccaaggtcggggtgcccagttcggtctgaatcatcgtaggcctggggtaaggcaggttcgtgtgggttcacgcccttgaatactaatactgtgtagctctaggatcgtctttataaaatggctttgggcaactaagtgacttttaaatgctgtttactgcaaaacttaaccccgatattattaccccttgtacccccttgcattaatcatgcatctgccagtgtggcttgctgagtactgtggttgtactcattcttgctctatctttctccccccttcagtaagagaagcttcggagaagatgtcttaggtggagtcttggcttataccccagttgagcgcctgtgaagatggagccgtaggcccgctagtccgctgctgtttatttttgattgtcaggcctgaagtgcctttgtaataatgtaaatattgtcgatataataaagatgtgccttttatatcatgtttgtttggtgtaccccggcttttcctgggacggggattaatacactagcgttcgggaaaaggcaattttctcggtcgcgacaagatggtatcagagccatctcgactgtaggataagccaagtggataaaacctaaggacatattttataaataaaactatttgcgaaagttccttttttctccttcccctaatgctatttgcaaaaggtttactcccttcttccttattcggatttc

SEQ ID NO: 62134 - DNA, 2594 bp, Oryza sativa
tttaagaatggtacacagtgataaatagtccaaaacatgtaaaagtgagatcagtgatcagattgcaattccactatatatgttttaccttgttttctgaagttagcaagcttaacggtggacggttgaagatacaaaatcgaatcccaattgagattaccatgatacagtttgttcttcctcaagaagtcaagcccctcaatgacttgcctgagaaaagattcagcacaaaataaataactaaacaaataagatacatgcacagcagttatcattgcagacttgcggttataattggattattgctaccttaataaggactggagtaatggtgaaggaatgtggtttattctgtcaccccagcaatcatgtttaaaacaaagtgatgataacagtccagtgtaaggctctacaaatgctgctaaggatgaggggccattgctctcaaccttgtccctggatagggctttcattgagagaatgtttcggtgatttagcgtaagcattatgcaatgcacatgatcattatctgccatctccctcttcagacagacaaggggataactgttaacgcttctgcatatcttctttgaggacgaaggtttgataacccttaaggaatacttctttttaccagggactctctcctgaagcactttaaagggaatctccacttgatctagagcaaaaagaaaatgagaatggcatatgttttagtaaaatgttaaccatcaagactgaaatgaattactagaagcaagttggaaacatagtgaagctacagcaagcctgcaacacctcactatttcactttcagatcctacttgccctacttgccagatatccatataatactgttaaacaatcggcacaacttaaatacattttagcttgctatggcttcgaagaagatgagatactatactacttagaaaaccactgaggagatgaagacctttatatgagagaatagattaattcatacatcttgcttgccccacataaactgctgaatgctcctcatatttctatatggccagcccctaagaaccaaataactcaaagatctcaaacctaacagcaaaatcattaatcgatctcgatcttccaactatataactaggctataggtatcaatatcatgtgtagtgtgcttttgatcagcaccatgggcccatacagaagttgccatgtgctgccggccagccattgtacagccatatgctcatgagccatgaaactagtattgatattgagaatatagagaactgttgaatggaaatttacatacctgggtccattttgatgaatatagcctttgcagctgccttgtttgttatcagaatatcaaggagcttactgccaacaatgtacaataaacaaattttagtatgcaagaagttgtgtttgctgacatatatacaatgggtaaataatagcacatcttaacaaaaggagataaatgatacttttttctttcctctcttgcattgtcacaataattcgacaagccaagaatcccgtccttgttacataacagctacaaaccagtaataatgtcttgcatcttatagcgcaaaagggttcaattgacaagttgtttcatattcaaacaagctatcctatgaattgttgcaattatgcagtatcatctggagtatctattaacaagttgttgtatgttttacctaatgttccattcttcctgttaactacaggtttccagggtacttcaagcgtaccacctatcagcaaaagagtcaacctgtgcagcacgtgtaatgtctctagactctcggattgaagaagcacttggatcatgcttgcaacaatcattgcagcttatacctgcaaggctgcaaaccgtgctgtcgatatggagatatggctccagtgatgcggtgacttctagccaggaactgagttgagaaggtgaatgtttctctaattctctccctgggatttgaccatcatttgggctctgattagtttatggatcgtgtggagactgaccaaccaagtaaagttactcctactattaaattcccagaagctactactctttacagagcagtgaaccataaatctagtgctgcaaaagaggctgccacgagcgcatagcccaagacagcacggcatggttgagcccacaggaccagaattctggaagtcacagaaaaaggaatacccaatacatccaggaaagaacgagcaaacaagaggaaatggaggcttgagaagaagacgacaatgcaaagtgaaactttgagcagaagccaacacacattctgtgagattaccagcatgtaatatacacctctaaatatcttactagtagtacaaactaatcaattaataccacttcataacagatgaagaacgcgtggggccgggggggggggggggttgaatatttgtcactattagaagtggcaactctctaaatgccacttttaggtttgtccttgtaatttttgccactggtgagatattatgcactaatattttgccactgtggagtgccacctaggatggccagcatggacaaggcagttgaccaatccgcccctccatttctctggtgatgaagacag

SEQ ID NO: 62135 - DNA, 5000 bp, Oryza sativa
gtgcatcgcatccatgggcagaccgaatagactggcacctaaatacatctgttcgcaactgagcatgcaagctccaacctgtttggttctataatgactataagtggtactttcagattcagcatatgcagagacttataacagcaggctagtatcggtctgaaattcatttcctattgatccccaacgagcagaaaagagcaggctggtactttcagattcagcatatgcagagacttaaacgctacgacggtggctgcgagcggagaagggtagtcggcgatgaggggctcgaccccgtcgcaactcctcccgagcggcacgaagggcggagacggagcagcggcggcaggcgtagttcatatatgatatggctcagcgaggattaaaacctaagtgatttccctgaacatcacaactgtaacgtctaagcaagcattttgtcgaacaccttttgggcatggggagcattagcgtattacctgcagcttgcatttatttgcatttatgtagttgcatcgggctagcgagggagctccagtggaagagggcgggatcggcgacgaggtggagtcccgagctgtgccaacgagcacggcggcctcaatcccgagcaccgcggagtagcgcagcgtggcgatgggggcgccggcggtggaggcgtggcggggcgcggcgaagaggtgggaggagtggcgtcggcggttggatagcgagcgcgagcgatgcgggggaggaaagcggagggagcgaccgagggagggggctgcggcgacgtggatcgaggggttgaggaggggagatgcggagggagcgaccgagagagggggaagacgcgtgcgctgatgcggcggcgtgtggagggcgcgacgagtggtggaggcgcgatggcacggcgtaggggtacggaggcggaggcggcggcggggtgggggtgtgcgagagagagagagagagaggaggggcacaacgacggggcgattggggggcgccatttttctcgtctactgcggatccggagaagcgtccgatctctgatcccacggttgataggtcacacgtctacgttggcttcaccatcaccactacggattattttttaagtagtagagattagcttcaagatacatttgtggcgtgtctaaggtctaaagttgcggctgttaagtgttaatccccccaacaagcagcataatttaacccaacctgaagcctttatacctggcaaaacactaaacaaacctacccttctaatttcacactgttaattaggctagttttggctaattaattagcttaaaagctagctaacattgctatcttcagctttcaatgcaagccctgcagtgtagtaagtagctcacacgaattttcagagcgtgttgtcttaactggttttcttgtattgacagggttgatatacatgagattgggtgcttttgtgaggtatgttctgcctagagtttctattgtttatgtcctgcctaaattaattgttcttgagtttcgataatgttctgttaaacagtgctcagatttatatagtactacctctgtcccaaaatacttgtcgctttgagtttttgtttgtaacttttgatcattcgtcttattcaaaaaattatagaattattatttattttgtttgtaacttgctttattatcaaaaatactttacgtatgacttatccgtttttatatttgcactaatttttcaaataagacaaatggtcaaacattgcaagaaaagagccaaaatgaccactaatttgggacagaggtagtactaagttttaagttttactactgtccctgggtgctcagatttgctctgcattagttctagagaatggcatatatgcatttgtaatagagaatgacatgtgtttgttcagagtcattagctgaaataggacagcaagtatattctagtcagttagcatagaatctggtattgttctgattttgtttctgttttgtttttttccctttaattctggtagtttgagtgtctatcaactgctttggccattggatttgttaatacaacacgtgttccacgaaagatgaagatgattattgattcccatgaccctgtaattctgtaaaggatgccatcatttttaggaatttaggatgccccttgtgaaatgcgtccttcactgtggaaatggatcaaaggaatatcacatctccctcttaacagcttcccaggaatatgcaattcttttggttttaaaaacaaacaagagtaggaacatcaattccatctatacactctgaatgtgcttgtgtttcttacccactgactgcattagtgcagtgtatatgttggggacctgctgaaattgagctcaattctgaattctaaaattctgaaattatggttcaggttgctgaaatttagctagaaaattcagtctcagatcatgtgcaggtttgggagtttcagttctctgaaactgattttttttactttgatgaagagtacaactgtagattgtgccatttttcctttcaatgtgctttttttgattaattcatagaccaacaccagatctttagaagtgtataaatagagaaatcatgcagttgatgttattcccgtaattagacactttttaggtgcctgtcatgcagttgatgttttcgatatatgaattgtctattggacgtagtttttattaacctgtagcttctgttgactgctgctagttaagctatttcaatggggcttaaacatgtggtttagcaactattggttataggagtagctattatatgttgttgttgtgacacaatattcttcttttttgtacataatacatcaacatgtgtataccatagactgatctgtatagtgaggatgatgtattctttcccttttgcaggtaattggaaatgttcacagtgaaacctgaattattcatggaacttattgaacctctggaactaaataacctaaaactttctcgttattggaaatatgtggctgttgaccatataggggcatattgatcagctatttttcggcctttgaattgtgcagttttctttcaagtgataatccgtctcatatgttttttcagggacttctgtttgctgcaccaagaatgttattgtgatgtacctgagaaatatgctgttctgttaattgaggaactttacaagtagatattaatgatttagcttcaatttatgtaatttaatccctgctacttattactgtaatagagatctacatgtgtgaatctataatcttagtgtgcactaatattctaatatgaattgacatttttttctagactttgtaataatcacgacataaattgtacagccagtcttcgttattttcccttttttgtttttttttctcattttttctcatttttagatttttttgggtggtgttttgaattttctgcaattttgttggtgacaatttaaaatttatgtaatgaaatctttaaaccttagtccaaataaatcaatcccaccaatcccttacctgtccaaacaaaccaaatgataatcccgtggtgaaagggattgggtgggggattgggtggtgggaggggatgaacccaatcccctccggtgaccgttttacctgggtataattatcccttggtgccgaacgaggcctgagtttaaatgctgattgtgcttctccgatcgatgctcacccgttgatatagagatggcgcgagggctggacaccgggcagggcgaggcggctgtcgtggcggcggtggagggcagcggcttcgggcaccgcgctctgcacatggcggcctctggagggagcgtggacgtcctcaggtacctcgtggaggacctctgcctcggcgtcaaccagttcaatggcaaaggtcttgcgctctttgccttgcctctcttccgttctatttttcagctcgctcttatacgaatcaagatgcattgagtattctttttctcaagaatgatacaataattcatgctttgaatagtcctcgtgcaagcattgaacatcccctcttttgtgtacattgaaaaaccacaatttagattgatatcaaactccaaattcggtggcttcaatttattattaagaaagattatttaataggacagtccctactgaactatctcgtggaaaaaacttgtcatagcaattaacaaattaaccaaaaatgaaacaaattgctcaacccctcaccccattcaaccacacaatcatcacacagaacgagaacccaaaacatatcacgtaattaagcaacgcggagagtcttgtcaatgtgggtgctggaggtcaccactttgtggaccagaagctggcatggaggagcaatggtaggagaagagctgtaatgtgtttgagaagtagggtgactggggaggccatgtcttgcacagacagcagttgcagaagtggtggtaccgtggtggagatgcgtgacagcgtgagaggctagagagttgacatgggttgggtttgactgtgtgagggtgttcgtgattgtgtaacaccgcagataactggtttcctgtttatatataccttctctgagatttggacttgaattgtcaattccaatccctgatggcagacaacaaccttgtcaatggaattggaatgtgttccttggacttggaagtattctgagcagtaattgtgcattctaatttcctattttccttgcttcccatacttttcacggtaatcatttatcacaaggagtcactggtactacattagcactagccagtccagttgcacattttatctttttaacaaggagtctacttaaccccctgaagaaaaaaaaggtacatatcatgtgccctgaagtatttaaaaatgtacaaataacaccctgaggtggtttcgccatggtaaacaatatgactagtgggtagtgatgtgatgatgacttagcagatgaatataaatctgtagtaaatgccccacttcttgaaacaatgtttcattcagtacttaaattgaactttga

SEQ ID NO: 62136 - DNA, 1072 bp, Oryza sativa
  unsure (1)..(1072): unsure at all n locations
tacggctccatcttcacaggcgctcaactggagtataagccaggactccacctaagacatctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccaactcgtcccaagccaacccaggccaaccattccatattttagttgttgagcaaattttaagaattataacactgacctgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgagccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccaccacaaggggatcctctagagtcgaccttagtcagcgagctagagangtctcaannnnaacccccc

SEQ ID NO: 62137 - DNA, 2520 bp, Oryza sativa
cttggtgcgaggaggctggtttagcgatgtctgccctgttaaaccaaatgaaggggcttctctggcatatacccatggacaattcagggcatagtgtccttgttctctacaatcgtgacaaaaggggacatcctcttctggcattggaagttcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggagacatacccgctgacattctttcctttttctctgttaaacatctgttacaggaattgaggtgagagaggaaacaagctaggaaagaatagaccagaactagagataggaccttaaaggaactaactcttcttgttgatgtgttgtttgttttgcttattctgcaagttgattaagcaaacaacctagcatggttacatcacaacccaccgatgcaaaccacgcgctacacacacaagcaagaaacacacgactaacgacactaccctagagggtggcttaggttctgcgacgggttctccaagatcttcactgcttccttcactttactagcggatcctgcagccttctggaatttcgacaaacaactgacgatgtcttcttcttcactgacctgaccatctagtactagttgaaatccgaagaaggaagaagggagtaaaccttttgcagatagcacaggggaaaggagaaaaaaggaactttcacaaatagttttatttataaaataggtccttaggttatatccacttggcttatcctacagtcgagatggctcagataccagcttgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaattggggtataagccaggactccacctaagacatcttctccaaagcttctcttactgaaggggggagaaagatagagcaagaatgagtacaaccacagtactcagcaagacacaccggagaatgcatgattaatgcaagggagtacaaggagataataatacaggggttcagttttgcagtaaacagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccaacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataaaccaacaattccatagtgtccaaatgatatgagaatccccaaagtctaaagttataaaaccacctaatgttgcctaattaatcagcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaggatgatgtgacttgccttgctcagagagaacggacttccgatccttcggcgacgaccgcgaaccacgcttcgggaacctccggaacgacaga

SEQ ID NO: 62138 - DNA, 713 bp, Oryza sativa
tatcaagtaatacttgagaggtatcacctgataccagttagatattaggtcatgatacctaaaagatatcaagaactgatacatatttctgtccaaacgggatatggtcttgtacaattcatggaatgagaacagcacaatttccaaagagacgaacgattaaaaaaatactattaaagtcccatgtcttctcagtgtgaacatgcacccataaatacactgatttgcctagctttatcatattgtattgtcaccaactcagatactggtgtgacatgtctgctcgtgtcacgtgcccacgagtactcatgaggattgcaggcctgcaacacacttagctgctcatgtccgcgtgtcgctggaggtatgattgtgcacgaaatcaggttgacttatgtccgtatcgaggaagtcatagaatacttcattaaactattccgttcggacggtatcccgtacaataatttttctcttttctcaaagcagggggaactacatttatcttcctgcttttgttcccttcttaccgtgtcctcctttttattgggcttaaccatcgcagtattggtactttcttctcaatccacccatccagtcaatccccaattatataggtgtaggccgtgctttattcctaatctgtacaaccaactattctttaattattagggaagggcatgttccattaacaagcatgatcaagccttaaaaag

SEQ ID NO: 62139 - DNA, 8894 bp, Oryza sativa
acaagtccacaaaaaaataatgatcgttccattcagatatgattattcccgttatgactatatttacccccattaatgatcgttctgaatctcttgagaaatttaagatatttaggactaaacaagaagatcaacataatgccaaaattaaagttgtgagatcagatcgtggtggtgaatactatgggaaacatgctccatttggtcaaatcttggtccgtttgccttatatctctagcaacatggaatagttgcccaatatttatgcccgaagaacctcagcagaatggagtagcaggatgacacaaccgcacactcatggatatggtgcgcagtatgctaaatcattctactccgtcaagtaaattgtggattgaaggcttaaagacaactacccacattataaatagaattccaagtaagtcagtacctaagatctcttatgaattatggattggaaggaaaccgacattaaattatttacgcgtgtgggattgtcgtgcaaaagtcagaatatttaatccacaactaaagaaattagacccataagactatgagccatcatttcatcggatatccagaaatatctaagggataccaattttattgtctagaccatatcgctaagtttgtggagactagacacgttgtcttcttagaaaataatgaagtggagagctcacaacataaggagattaatcttgaggaaattaaaactaatgttccaattatgaaaatccaagagaataatattccatttatcaaacttgtgccatagaatgtagtgcgccaacaacgagtaattctggaccctctggccctacaactgatgttgaagaaagtgttgatgaaaataatgatgaaagtaatgagcatcaatagaattatgcgacatagaatgaagaagaaatatccaaaagaagatgctcaacgacatgtgaacaacgatgaaaatcagcaattaagaagatcacaacaggtaaggaaatttgccattcccgattatcatgaagtttatatgagtgaagatatagggaaggtagatggccctacctcatttaaagaagccataagcagtaaaaactcatccaagtggtttgaagaaatggaagatgaattaaagtgtgggatcagtagaagttcctaaggaggcaaaacaataggctgcaaatgggcctacaaaactaagctggactctaaagggaacatcgaacgattcaaagcaaggcttgttgataaatgtttttttttgcgtagataaggaattgattataatgatacattttctcctgtctctaagaaagactcatttagatatattttctcctatatctaagaaagactcatttataattgtcagggctttagtagctcaccataacttagaacttcatcagatggatgcatagactgcatttctaaatggtgatttaaatgagaatgtctacatggcaaaaccagaaggttttgttgtggaaggaaagaccatttagcatgcaaattaaataaatccatttatggacttaaggaggcatccagacaatggtaccttaaattcgatgaagtaattaaaaatttttggattaaaggaaaatgtgatggacaactacatttatatgaagaataaaagtggaaaattcatcatactagtactctatgttgatgacattttgttagcaagcagcgataagaatttgctgcgagaaagtaaagaaaatctgtcatctaaatttgatatgaaatatcttggttaagcatcttatgttttgggcatggaaattcaaatagataggtccaaaggattgctaggattatctcaagaatcatatatttccagagtgttggaaagatataatatgagcaaatgctctacgacacctgccccaataataaaaggtgataaatttggttaattctaaagcccaacaaatgacttagaaactaaagaaatgaagacgaaaccgcatgctttgactgtcgaaatcagatttggcgttcgttactaggatgcttggtagatttttatctaatcttggattggaccactggaaaggagttaagaaggtcctccattatttgtaaggaactaagcattatatgctcacatataagaggtctgataagcttgtgatattagactattcagatattgactttgtagggtgcttaggtactaagaaatccacttcaggttatattttcactcttgtgggagagctatttcatggaaaagctccatgtagacgattattgtatcatctacaatgtaggcagaatctgtggcatgatatcatgtaacggggcatgcagtatggtttaagaatttcatcccaaaattaagagtggtcgacagtatagccaaaccactggcaattacttcagaagcaaaataaactacagcttactagaccgaggttgcatcatttttccccaataagcatcaatgatcttctgtgataaaaatagaaaaacaaaagagcaattgtagcgataaaggctatgtttcctcatgatgatggtaactcatgctcacggcaccagaacatgaagttaacgactcaacagtgattacagagaagtctgtcatcaggtgatggcaatgaaactaaaatcgattgtttctgtttagggtgtgtttaatcagttcacgccaaaattgtaagtttgattgaaattggagcgatgtgatagaaaagttagaagtttgtgtgtaggaaagttttgatttgatggaaaagttggaagtttgaagaaaaagttgggaactaaaccaggccttaattctttgctgaagttcagctttagtttagggtcatgcatggcactaaacattagtcatcatcaaatatattcccatcgcagcgactttatatttaaattttgtcctaaaatattagggttaatttgatctatgccactgcaaatttgtctattaagaaaaatgccattacaattcgtctattcgtaaccgtgccactagaattttacaaaattagaaccgtgccactgccgtcacgttttccatccatcccctgccttttccgtcttcttccttctttctcccatttcttcccggttctttctcctatttcttctcggagtcatgccggcgagctcggaggagagggagcttgccagcgacccaaccatggcaggcggcagcggctccttctttctcccatttcttcccggagccaagtgggcgagatctcgtgcgggagcagcggcggcgatgccaacggcggtcgtccatccatccatggccgcagcgagcttcgacggtgtcggcggtggagccaacgtcgatggaaacaacggtagatctggcgctgcatggcgcgagcagacccaacagaggcgatgaagactcgaagacggcggcgaggtgctccagctacttgcggagctcatggcgggcgacgaggaggcggttggagtctcggagaggtccaaggatgagtagtgcggggagagcactgccgcgagggagagcggccggcatgaggtgctcaccgacccggaggccagagcgggagccgaggttgagcagcaacgcggaagaagagagtcaccgtcgtcgatcacgctcgacacccagcctaggcctcagctggttccgcccgagtcccgatgccaccattgtccgacgccgccaccgccggattcgccgaccacgccaaccgcactcgaggttgggttcgttcaccttgccggcgagctccctctccggcttgactccgggaagaagatgggagaaggaaggaagaagacggaaaaggaagagaatggatggaaaatgtgacgtcaatggcacggttttagttttacaaaatttcagtggcacggttaagaatagatgaattgcaatgtcatttttctgaatagctaaatttgcagtggcatggatcaaattaacccaaaatataattgcctatagaataccaagggatgtttatagtcattaaatattcaaagataccacttatctgacaactctcatccacctcccaccaccaactagtgtaattattgaatagtagtatagattttttacttctcttcttaggctgagttcggaaccctcactcccaacaagcaaaacagagagcggttagtgcatgatttattaagcattagctaaaataaacttgaaaatggattaatatgaattttttaaaaaactttcctatagaattattttttgcaaaatacgtaccgtatagtagtttgggaaacgtgtgcgtggaaaatgagagaggtgagttagtttttgatagctatattttggggtggagtagtagataaagaggttttgatttttttttcggtgactgccattttcggtctggagttagcctgggccgagttcgctgtgacaaaagtggactccaatccccaatgttgcatgaatgtgcatagaaagcaagcacgcgctcgagacgtactactggactatgatgcactggatcgaggacaagcatcgccaatgccggccagtgactcctctgtcatggactattgtagatggaagtatggaaccataatatataatcttagctagagcgatgatgctttagacacccgattggacttactagataatttggaaatgcaaatgaatgactatacccgaagaccaaggggaagtgaagtcattgcaattgtgggaaatcatcattcctctactggtgaaatggtcatcatggacatatttacaaaggttctccccaaaacattcgctaccacaatgcacaagcacaactgccccgcaatactcattatcactaaacacggtttttccgcaaggtcgcacaaaatggttgggaggaatccgtgtatttttcttttgttggcactttcttagctgaatgttaaacaacatcttaatacaaagacgtgcaaatcttttatgtacttcctaaaaagaatttcactacgaaaatgcgtgaacggattgttccagctgcatcccagatttggtgacagaacttctgtcgatgtatattgtaacttctcctaatcttaataaaatttggttggcattatttttgaccgacccagaaaaaaaatacttgtgaacttagtggtttctgtagcaatttgacaaaagaaaagcattatctcaatatcaaacactgaacattaataatatatttaattttgagattaccacacatcacacaagtcaagtacaacatattgcaaagctcacatgaccaaacaagtacacagtagaagatttagatttcaacaaatgaagccatcatttacttatccaagtatataattgacgacagattcttgttcgatgcatgatcggtcacaccaccatcttttatgcagccggtcctgaagcagaagggtccacatcattgtctctatgaaatttcatcacagcgcccaagattgggctcagcacagttctctttctcttcttcttctccttctgctgaatctgcaaaggtttacaaccagatatattctgatatacgccaaggaaccaggaatttagtacacataattttcataaaagccatccaaaccttgtttatcgcagctttcttctggctgttaaacatgtccttgttttgttctttgtactgcttcagctcttggctgtccatagcttccatcctgtccaactgaatcaagaacaattgattatatgatacaagtctacaaatgataagagtctagctagttaattgcatgctcatctgccagaaatttacagccactgtgtacagcctctagaaaaatgctaaatctattcctgcaaaagctaaaataaagcataaatataattattattaaaattgaagacaatatatatcacccattactatgattttatttacccaagagttaaattcatctgcttgtcttcttatgtcctgtgcatccttagcagcaatctctttgttttctgcctgtggcattgccttcttgccattgtctccttgggccattgaaatactggatgactgaattttagtactcagtactctgaagtgagacaacttgtagtttggcaaagaactcaaagggttatcaagcatatatataggcaagcttcaccactagatagtcacacgcaattttcaaataggtgtcaaataaacaagtcatggaacttgcttgacctttggcttgttgtaacgtgtgaatggttgccaccaagctgtttgcaaatgtaggcagaattacatgaggcgattcacaagtctctcctaatcaagaatcaaaagctaaaaacggttggtttataaaggcataatttatggaggttcacatctatcctttatatagaagtcttctagtagcagccttccaatgcagataaccttttgctgaatactataagaagaaacagtagttgattctttttctgccacattgcagtttctcttactggcagttacaatttattttcctcctattatatgcccatatttcctgctaaaacggctgacctgccttggaaatgctctggcatttcagttctttaccctgaaatgagcgttactgtttgtctccattttattgaggggaaaaactccaataattcaattttacaggtcttacattaaactgccatattattgaaaattgtacttttgataattgatttctttcaacaaagttattttccatgctgcatatataagtaatgttatataacaatgaaaccatctgtactacatgcatagaagactaggacgtgatcacaacatacacaagttgtagtttttcaaatatatgcatgctttataaatgtggaaggagacgcggcgaagaggaattcttcttgggattctgcttgggtagaagggcgtaggccaaaggacctcatgctgttggtctatgcaatatcaaaaaagaaagagaagtccttgcatcaggaaaaggaaaacgatgcttggattgatgacttagaccttgaagccaacccaccaattttagtggaacttattgttcagctagtcgccttatggaccgttgtgcgaaacatccatataaacgaggaggagcctgatcaaattgtttagaaattcacttccatatacttagcattgttggcttaccaggcatagtaccttggggtgccaaaaacggtcttcaattcgctcatctggagagtttgggcgccagagaaatgcaaatttcacgcatggctagtcatctaatatagggtctagacctctgaccgactggcaactagaggatggcaaaataatgggatatgccccctctgccgtagagaaggcaaaacggttctacatttcgttgtcagctacagatacatgaaaagaatttggagcctggtagatgcctgggtggcttaccaacagctagaccctaaacaatgggagacgacctagaccgtaaaagattggtgggaggctctagcaaatacgacaggagttcccaaaaaggggttgcacaccctcatcctcgtcatcctctgggagatctgaaggagaggaaccaacaaatcttctagcaaaacgaggccatgtcgtcattccttttcaccaaaaatcaaggatgagacacaagcttgggcgatggcaggagcaaagcgctcacatgactttttgccccactctgtatattgtatagagctttttccctttttcttacttcttggggttcttagggttgtatttttgtgccgctatatttaatgacaaggcacaatcatgtgctgtgagctgttttctttcaaacaaaaaatgtggaaggagggagcgtgagccttttttttttaatatgtccaaaaccttgctatccatatacaggaaatgaggagtatcagggtatcacctggatattctccacaagtagcacagcacacggacgcagccaaatggttctgtttccaagccccgacacccacccctgccaacggagaatgcgttccccgccgtcgacgctatcttccaccgatccaccgaccaacctctcctccccaacacttgaatccttctaggccaacccctccccacccgacgtgaccgcccctgagcgtgagcctttagtgcatcttagggctcaaggtaaggctatagaaggaagtgcaggccacgcaaattcgcagatcaggtttcaaccgggtgcaacttcaaattggtgctgctctcctccaccggcaataatggccccttcaatcctccaccagccaatgtcttttcaaactcaagtgcggtgaagactttcaaaccaaccgatggtacaggtgcaggaggcaaattgctagtccataaaagattgcttccagccgtaagcccgtaagtgatcttcctcttcccttgagcgccctagagtctctgcatctagtagagtactcacaagtggtgttacttccctctgagagatcaagtgaaacaactccttctggttcccaatggagacaagctgaaggcagcccatcccgatctcttcgccagttcttccgaatctcggggtcgagattccgtttaagggggtaggtttgtcacgtcccaaaacgaccctaaaatatatcctttaaattatgcctagaataattaaaatccgtgtgaaagcctccaaaaattaaaatgtgcaaagtaaaagtcaaataaggcttagaggatttttgtatatttcctaaaagcctaaaatgtgtaaataaattttagtggaattttcagagcacaaataataattattaagaaataaaccaagttaaaaaggttttataaaaagaaaaaaacctaaaaagtccccttccctctaatgggccggctcggcccatctccctccccctctcccttctctccccgcaccccactcggcctctccccgcgcgcgcgccgctgacgggcgggcccgtccgccaccctcgctgacgggtggggcccacctgtcat

SEQ ID NO: 62140 - DNA, 6238 bp, Oryza sativa
cgatgctccggtgaggagggagaggcggctggaggtggccggcaaggaggaatgagaagggcgacggcgggagtgcgcctccggcggtccccgcgcgaaacggagggtaggccggcgaagaggaggcggctgcgatgctagaggaggcgacggcgcgcccgcccggcgcacgggcgaggcggcacaggcggctggaggtcgccgccggcgtgggagagagagggcgacgccggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccgggaatggcgcggccgttcccggcgattgggggcaccatcaaaggggaaattaagggggaaagagagaggagggaaaggggattaattccccctaattaatttggaaggaacggttggattcggggcggatttggaggaggaaacgagctagggttccacgggagtgagaggagccgggcgggaggaagaagacgcgcctggcgcgggggccccacgcggtcgggcggcggcgtcagcgcgcgcacgcgcgcggcacgtgcgggaggggagcggcttgggggctggggcggcttgggccggcggccggcccaggaagagaggattgagaggcggcctgggccgggcaggccgggaggggaggggaagagagaggcagcccgggagggagagggaagagggaggtgggccgaggggaagggggcccaagaggaggagggagagaaaagagggaggagaggaggacttcggactgggcttggcccaaaggaggaagaggagggatttttaggttttctttttattgaactttgataaatgttgttgttgttttataaatatttccggtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagcgaatgatttttaattcgggatgaatttatcaggacgtgacaacagcggcccctagcagaacgtattgacccaccgggcatacataaagatcatatcggctgaacctctagtgcatgtatacttttatgaacccctttgcctcacgatatcgattaagctcgaggctaaatatgtgacatcctctaatagctcaatcattcactcgaacctgtgatagattatataacttatgattgactcctcaatcacctttggcaatttccataatctacaacatcgagagtgtaacatcctcaaattttaaactaaaatttgactgcatcatgctggcttttgattaaatttatttggttcaaaaaatctatttgatgtttatttaaaaattggttcaagtattattagaacccttccaatttactctaacttattccctttattctaaaccctagtgaatttgagcaaattctctcaaattcaaaccatagattatttctttagcctatcctattattagtggagttttgctttactctaaaccctagtgaaacccttccaaactcctagtttgaattcaaatcttttctagggaaatattcaaaaattctgaaattcactgttcattgcacataaggtgttcggtagaatgcctagcccaactagagcagcccaatcccttccaatcttgcacaaagtttagatttggtcctagtagaccacatcccactcaaaaaccgtggtttagttggccttctcctccccttcgcgcgcgctctctggcagtcgactttgccgcgcaccatgtcgccgcgcgtcggctttgaggccgcccgcgcgtggccgaccgccttggcgcgccatcgcccgtccgacgccctcagcccaccgccaccgcaccaatcatgacgacgacaaagctaggacgacgaccgccgcacgaaatcgccgctcgacgccgtgcgctcccatccaagccgccgccgagtgcgatttcgcttctacgcggggtgaatcgcgccaattcttgccacacggttggattgaagatagacggtggtatcccctctcacaattcaaaccattcaccccccaagccggccgttttcaccctcgccgccgccgcgcgtcgcgctcggattggcgccaacacatcgccagccgattcctaccgcggtcaagtcaatccttcgccggtaagtattcgaacgtggcctcccgccactcaaatcgatcttgcccgccctctctcagcctctgccacctttgcctcatccaaaacccgagctcatccatggtgatgacagtgcccgagctcatccgctcctcctagcactataaataagaccccaatcccttccctgtccatcatcgatcatcaacaaccatagccccacaaccccaaagctttgcttcaccaatccatctcatcaaccaccctcgctcgtcggtcgaacaccttgtgcgcgatcgactccacccctctccatccatcctccgccctaaataaccattagaaaacctatatcctaccatgttctagcataataagccctaaccaaagccctgcgtcgagttttacctcgccacaccaagccgagcatcgccgcccccgtgctgctctgttcttcgccgccgcgaagtttttccggccgcaatccgtcgtttcaaccaatctcggtgagttcttccgtttcaaccatctacatactacctagattccattttagcaatccctttgcactaacatgccaccctctgagctgcggacgtgagcacggccgccgcctatggaggcgctcgtcatcaactatgttccgcaccttgccaaaggttggcaagctgccggaatccctctagatacctcatagatgctctagagcccctcccctagccatgtctaactcttatcaccttgatcgccatctcggcctaaccgtgccaccgccgccctagccgctaagccgtccatgcatcaaattaactcctccgccgccgctcgccgtcgccggagatccctagctccctcccctcctcggccgcaaccactttctccctctagcgccgccgcaatcctaaaccctagcaccgccggcctgatttggggaacggccggaggtagaagaagagaagagagagagactgacaggtgggacccgcatacagtgccatttcacttttattcaattttcaattttagaagcccatatcttttaaaatatagatccaatttcaatgaaacttggaccaatattcttctaaaatcattctctatcttttggacccctttttgctatttttgcattttattttattttctctatttttcttatttttagattttatttaaaactcctttttgaatttggattttatatgtctaaccctaggtcttgaggattcctctgacactctagataatatcaatcaatctcaggacatcgagcaaggcaagttaccatatacctgttgatcatttaagcctatattttacaaattatttatttatagccttctattaaatattctattttctatgcgtaaattaatcatagaaacccagataatttagtattgcttattttgcttacaatctggttaaaataccctatacttagattgggacaatacgtaagatttggatgatttccgggtggatagtattgtctcaatcgatataagttttaccaggtacttatgtcgaacgaacgggtacgaccgcagtttctagaatggggacagacctagttattatgttaattagcaatatggcacctctgtatagtggttcttatttttaagtcctcgcacaggaggcaactatagccgcgaagggcaactttaaccattaccatgtacaggtaaatggtttgtgatactcgagtataaactatatggtatatttctaaaccctgatcgagatgacgtggtgtcatacgatcagttccccttaaatacctcgggaacgccagaactcctcttgctgctgttaatattatgttcagagcatatgaggatataagttcatggaacaggtgccataattgttaataacttaatactgggccatgactaaagccgatgtttatcagcaagtcgtggactgcgggtaaagcgtacatctgctgcagtagaatatctttgaaactatttgaatagccgtactcatggagttgagtaccgggactcatatggtaccctggttagaaacctaaagtttatatgttttataaactcttgctataatttttccagattgtccaatactgctttttgcaaagaaccatattatatgtcaatgcataacatatttccgtgataacttgctgagtattgtgaatactcatctttgctcttataacccctttttcagatttgggtcaagaggaggacccatatgactattactacgaagaccccgataatttagaaaatccctaaaggttatacctcactagtcagaatgtatagaaacttccgctgtgtattaatcagataggtgagtacctattattgtaaaacccttagtattgtaagactttaacatatgcaatgaagaaccagttatattgcatgtatcaatttttaatgatccaaggattgatacattaatctcagtcggatccaagttgttaatttgggtcccgacagagaggcccagagatatctctccataggaggggcaaatcccatcttgattattcatatcccactacatgtttcacagcatacccgaaaactacttttataactacccaattatagagtatcgtttagcagtccctaagtaagctactacacatgttgagaaccatgataatctcaggtctaaggatcaacaccaatactaaatgagatcactgatgacacaacacatatggctcttgcaacgtctcatgttgggtctatccaacaacatgttccccaacatgtgtccacattattaatttgttatctctgtactatgatctatgagatatgatcatcaattaatacatgtgctgatcatttaaacatatttgttccacatatgatatttgatcagggatcctttagaaatagtaacaaacaacataaagagtctcatgaaagaattacatattcattaaccaataatgagttatctattttaaggaacaaagtcggataaatatgtaaacatagtatgtgatacaattatctctatgattgtctctagggcatatcactaacagcgtgctggaaaggaatcacggtgtcgtatgagctctatcagcgggaaacatatagttcaactgtatgactattgcaaacataaattttagtgctgcgcatgtcaatactaattgggtgcattgttttgctgtagaaaacagtaaattagggtacttcgaaaaatgatactccctctgttttaatttacttattgaatctcagactaaattagaaggtcctagctgtcacgcccggaatttctatccaaaattccaaacgcttacatgtgtgttaaaccctcgtccaggaatcagccgaggcacacaataacaaattgataatagagtacaaataaataactatttaatattcgcaaataataaattattacagaggtggatagttcctctcaaagaataacattctacgcagcggaaaaaaaaaactaaaacaaattacggaacagctatggcgactccactccacaggcatcttaaccaagaacaagcttaatcctccagatcatcaccttcgctgagatactcctcttctgatgattgaatattgcaagaatgagcatatgacatactcaacaagccacacagcaaatatgcaagtgcacaggataacaaaggatggcataatatagctcatttgcataaacagcatttaataaatatttaagataatagtaaaatagttgaataattaatcaatattaaataacaccatacaacatacccgtgttgtataggcccaacctcatatgaacaaccaaccccggttgaacaaattaaacctccaaaccaggaatataccattccaaaccaggagtccaattaattaacacaattaccattaatgaatagtgtgagactaatcacgaaaaacattgttcaactcacccataaccgcgggtacggctattcgaatagattaaactc

SEQ ID NO: 62141 - DNA, 6149 bp, Oryza sativa
gggggtttcgttgacggtcgttattgattagtttcgaccgtcaatattgccaaaatagaggagaactagtgatgcttacaatgcataattacgttagaataataatattccactagtattaggtatactaacattttgcagagaatgacaataaagtgaaggagaatcgacatcaacacagatgataaatcaatcggacgatgtcgacaatcaaactaatgtatgaatgagcctagaactcagaattgacacgatgaattgggccaaaattcacaagtctacagagtggagcaatagaggaggccaccagccgaaattgggctggattgggccagccccaggttcggccgaacctgatggttcgtgcgaaccaatcctggcgccgttggatctaggttttggcgtggacgtccaggattgcatcccaatgacggttggagggcacttcagacaattccccttccacaaccgtcataactacctttatataaggagctcactctcttcacttcaacacacacctcaagcaatagcttagtttagtagtatctagctggtggaataggaatagagtagaaatcaggagtccggaaatcttcggaagagttcgggtatggctctagcagcttttctcttctcttttgtaagccttgtacttttattagaatattcttctaaatacatttatggtattgaaatactttccgagtatattagtacatactttacattatgttcttgttatactgaatatacggctagcttatctgggagatgctttggtgcgggtataatgtttgcttatgcaattactctatgtcatgacgatgatattagaattactcagtacgggtattcctccgcgcctatatgaaatcctaagttaatttcctggggagggtattcctccgtatttagccccgattgtatggtcatgatgggctgtcgtaaggaactcgacagtcaggggtggcttcttgaaataccaggagggcatcggaaagagggtattagctagtatatcagttaactaagatgtatgtatactatgtatattagaagtataggaatatattatcttccttttttctttccacttagcttagataatatattatgagaatgagtagttaatgcttgtgtgtcactctacccttggattatcttaaaccccgcttagaatatgattattacatgcaacatataaattattagtcaagtcctctctacatgatcttcccacgggataaaataaatacgatacgcttggaatactctcgggtaaatgctacaatggtatatccgtgcgcttgcggatgaactctgtaaccataatatacgagaagtatttctgcgccattgctgggaattatatttctagtaatgtcgttaagaaataccaacatacgtgcggaaacatccaaaacaatatcagatgcaacattgacaaataacctactgaaacatcaggaaatatttattgaaacatccaaataatatattgtgtaacactagaaatatgggtgccaaaaagaaaactaaagaagtcatcggaatataatcacgttggatcttgttataataatttcattgtaacgaatttaatggtgttatcggatcacggattggacaaaaagtttttaaaaaaccatttgaagctaatgttgctcttttacaaggtggtgctagaaaataattgggctaggatttgcgaacactacgaattgaacatttgatacttacaaaatatcataaggtgtttcatcatgtgtaagtaaatgttttggataaatatatttcgttgtttcatcacttgaaaaaaattgtttcatcgtttgttagaaaatgtttcgaggagatgtaacattgaaaaatcattttatagatcgacgtttcgatcgtgtcattttatttgttataattaaatcttcacaccaacatctcaaatgattatattttgattgaaatatatatatgtcttcatcattataattcaatgtttcaggtatgagaaacaaatgtttcagctcgaactcgacaatgttacacattttttatgtttttttatacaatggatgttttttagtgttgcacacgggatgtttcaaataagtattttatgatgtttcgttatttcatttgtgaatgttgcaccagatgtttcttgcatgtctcaacaaatacattgtaggtaacatttgtaaatttagtagtgaaacgttgaaaaatacatgttgaaacatctaaacaatactatctgtgacattaaataaaggtccgttgaaatagaaaatttaaattctgcaacaaagtgaaatcctaattggaacatttatttctcacatgtgaaacatataattttaatgattgaaacatatatatatatattttttcatcggaatataatcatgtgagatcttgttatagagatttaattgcaacgaatatcatggtgcaatcaaatcgtaaatcagataaatagtatggaagaaaatgttgtttgaaaatcaagtttgtagttgtttctttgcatgtgtatctatctacgtcatcaaatatatctatttacgtagacatgcagtgaagccacgtgtgtctgatgatagcctcttgcgtcggacgctcggcgcaaagcattttcccaggttacgttcgagagttcaaaaggttcgatcattggttcattctcgcaaccgtccaaaggtgcgttcgttcgttcattctcgcaaccgttcaaaggtgcgttcgttcgatggtgcggtggcctacccatccctttgcccaaccgaagcttaccctaggccagccgcggcggagcaaacggagaggcgcactactacagaaacggattttctgtacgaggggggggggttggttccatgcgggtgagttgtgtcggcgcctggaaaaatcgccccccccccccccgggggggcgggttgaccagccgcaaaaataggcccattatcgcatgccgctagcctaagcagccgcatgcgataatggatcttcgcatgcggctggcttaaggagccgcatgcgatgattggccatatatgctcatccaggccgcgagcttgaccatttgaaaacgaagctttctctctcctaaagcaatctataattagggggggaggttttcaagtcaaaatttttgcttgaactctatacgaaaggggaaaaactctctcttctccatttggctccatttttgttatatttcgttggttgaatgtggagtttttttaatattttgacaaggtttgttctagctagttttttgcaaaatctagcttcaaaatatatgttttgatgggcaaattttgcatgtaatcacttgtacatactagttacatgtattgttgtaatttttttggagggacaaatgcatttaaacttttgtataaaatatctgctgtctattttttttatctgtaacttttttgtctttatataaatagatggatcggtcatcatggatgtatgagatgcggagaacgcagctgatatttattaaggcagcatctaaatttattgatcagtctaaggcgcatgctttgagggagaatatgacaaagatcttttgtccgtgccgtcattgcaagaatcataaattgttagtagatcctggtgaaatattaggtcacataatggagtacggattcaccgccaactacaaggtttggacctatcacggggaattcgccgatcccgaagatgacgatgaagagttaagtttcgagatgaatgaggcggagaattttataatcgaagacatgtcccgtgaaagaatgggtgtagatgtttccaccgatagtgatgatttcgagggtggttttgatttagaggatatgctacgccttggtgaaccagaggtggtagcgggcaggtcacgaggattggagaattggcaggcattagagaaggcattgaaggatcttctttacgatgaaacgaaggaatgtgataaggatttcacagtcttgcgttcagtgcttgaacttctgagattgaaggctaaacatggatggtcggacacaagttttaatgatctgatgagtttgttgcgtgtgtttcttcctaagcctaactttgtaccatcaaacacgtatcaaacgaagaaactcatatgtcctttatctcttggtgtagaaaagattcatgcttgtaaaaatcattgcatattataccataaagaatatgcagacttggaaagttgcccaacatgtggcacaagtcggtataaaacgggaaatgggcccgtagatacagagtgtaccgatccagattctgataagggtaagcgtagaaagattccctcaatggtgatgtggtacctaccaatcaaggaccgcctaaagcgtctgtactcaaacccgattggtgctgagttgatgagatgccgaaagacagatggtatgatttgacatcccgccgatgctcgccagtggaagacatttgatgcaaaacacccagaatttgctaaggatccctggaatgtaaggtttgcattgagcactgacggaatgaacccgtttggtgacttaagcagctcacacagcacatggccagtccttctcacaatgtataatcttccaacatggatatgtcagaaacgaaagtacatttttctcactatcctcatacaaggtccaaaccaacctagaatcgacatagatgttttccttgagcctttgatagaggacatggaggagctttggaaagaggggttacgactatgggatgagtttaagagggagcacttcaatctatgtgtgatcatattcgttaccatcaatgacctacctgcaaacttttcattatctgggcagattaaagggaagactggatgtctgatatgtttggagaaaacttcgtacaaatacctaacgtcgtctttgaagacagtgtacatgcgacatcgacggttcctaccacaaagacacaggtaccgtaagatggccagattgttcgataatacagtggagaatgacactgccccagaagcacgaagtggtacatacgtgtatgagataacaaagaagattaaggttgtatatggcaagggaaagaagaagacagtaaagatgaagaaagctgatggtgacaaagatactgcgttgcctttcaagaagcactcaattttcttcagatacttagattactggaaggacctagagattcgacatgcaattgatgttatgcacctcgagaagaacgtgtttgatagcaccattggcacattgctggacatcccgagtaagacgaaggatggattgaagtcacgtaacgaccttgtagatttggccatacgacatgaccttcacccagtagtgctgccaaatggaaagaccgagattcctcctgcttgttacccgttgacatttgaagagaaaaaagccttctgtaaatgtttacaaggggttagagtgcctactggtttctcatcgaacatcaggaagctagtatcaatgaaggatttgaccatttccggatacaatgcgcatgacttccataggttgctaacggtattactaccaattgctataagggcagttaaaccagtctataccaaggtggttataacaaagttgtgctactttttcaattgaatttcgcagaaggtatttgatcctctggaattaggtccccttcagacatttggtgtcgagaccgtatgccaacttgagatgtatttcccagcatcatatttagatttgatggagcatttgatcgttcacatcgtccctcagattattgaacttggtcccttatacttacatcagatgtgggcctatgagcgttacatgtcgatcctcaaaggctatgtatgcaatcgcgctcaccctgaaggatcaatgatagagggatacacaactgaagaggcggtcgagtgttgtatggattacataaaggatgctaatgccattgggattcctgttcatcgacacgaagggagattgtctggaaggggtactgttggtaggaagcagttcttcgataatgattacaaaaaggtgtccacggcacacaacagcattcttcaacagctcgctatcgttgagccattcattgagcgacaccttgaagaaatcaaagcctgcttcacagggcgagggtgcgagcaagcaatcaatctaaccccagta

SEQ ID NO: 62142 - DNA, 750 bp, Oryza sativa
ttgagagattttaaggcgtgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttca

SEQ ID NO: 62143 - DNA, 10449 bp, Oryza sativa
ttaattgtacacataattacataaggcttttactccattgcatcacttaggtaaaatgaaataaaaatgccaagacattaatgtgcataaacataatgttccactctacaataccgttgggccaaaatagagtgaaacgacatgattgaggtaaaatacgcacataaataaaattctaccccataatgccataaggcaagatgggataaaatcatattaggacatgaaatgacaattgacgcgcacaattacataagatttttaatttatctcaccatagggcaagaaatgagaggctacatgtaaaaaatgtcaccaagattaatacaaacacaaaattctacttaatgatactattgagcgaaaatgaagcaaaattaacattagtatcttaataatggaaaatcctatatcgtaatttccgttgggttgtgtcacgcccggaatttctatccaaaattctaaacgcttacatgtgtgtgaaccctcgtccaggaatcagccgaggcacacaataacaaattgataatagagtacaattattactctaattaataagcgaataaaatatcattacagaggtaagcagcggaaaaaataagataaacggcgcagatgactccactccacaggcagcttgaccagggctacacctaatcctccacaccatcagcatcactgtagaactcctcctttgatgaatgattgcaaggtgagtatatgacatactcagcaagccacgaagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcctggctgcacagttctatctccaaaccaggaattaaccattccaaaccaggagctaatcaaattattaccagttatagcatcttttattatgatgagaaatgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtaccttggaaaggagctgtgacagtacccctcgcacaacacaatccaccacagtgcaccgttcctagatcataatcacccctttataaacaaggcatggactccccagcgacccccgtgggcttatctccgccacttctcagtctggtgctccgcaatgaaccatgttatacaaaaggtaaagccattgcccacgctggcttgtggttggcacggttaatgtttcacaaccgaaactcgtgaaccggtccttaattgtcatgagcacgaccatcaaaaccatgtgctcacaacccaccattatcaagttttagttggcaatttaattaattaaccaatcacgattgaccatcgtgaactatcattaagccatcattaaataatagtgaatcataagttatcccaatagtgtgctaatgtttctaagcatggctaagcaattatgtctaacatctagctgaaccaatatataaagctaaactagtcaaattatcacccaaggtatcaaagaatagagtaagcaatgcaaagtggtcataacaaaggaacaggtccacaccactcggtgacattcgaaaataaatgcacagttgaaataaatagagaatttaaatataggatcaacatgctcaaaggattgtttgggatctgtgtgacttgccttgctggccttggaacacttcaaattcttctcctgcgaaaacggactctccggaaacgtcggaatctaaacagaaaggagcaaaatcaccaaacagcacataaacaagcatgaacagtatatgtggatatttttaacatgtagatctcaattttagaaaaatttagagacttgaaccaactaaatccgagctaagatgaattagttatgaattttcaaagattaaatcagattaaatcatttatttagattttaattgaattatgacgcaataatgaattatttttgaaaaggaaaaaggggtttattgcgtcagcggctagggttcgcggtgaaccgggtgcacggcggcggctcacggaaacgaacggccgagatcgattcatccaaaatggacggccaagatccatcggtccatgaccgggccacggggaacgacgacgatgacgtcagcggtgacgtcatcaccggcgacgactcgggcacgcatgcccgccggcgaacgacggcgcggcggcgcgaacggagagcaccaaaatgatgcgggcgacgtggcgaactcaccgatgacctaaacggcgacggacggtgaccgaatgacgtcggcgacgaggaagaagcggcggcgctcttcggcttgacgacggcgacggtgttccggcggtcgacagcgacggcggagggacggacgaggactgcgacgacttggcgaccacgatggtgacctccccgagcgacggcgacgaccgaagcgacggcggcgcacggctggagcgacggcgacgacggcgacgctaggctgcacggggctagggctctacgggcgacgagaggcgaaggcgagggtggcggtgggtagcggagacaccgggggtccttttataggggctaggaggcggcgtcggaggcccacggcaaccggtgacggcgaaggaaggtctagggttcggggagagagacgaatccgattcgaaatcgaatccacggatttccaaacgaaattagccaacgattccataagagaaaagatagaggggatcccggggatcatttcccctctattaatttcattgaaaacggaaaggggcgggcggatttggaaggagatggcggcggcgcgacgctagggctcgagcggcgggcggccggaggtagacgacgacctgacaggcgggccccacctgtcagcgtccgagggcgcgcgcacgcggctgctgcgggcggactgggccagcttgggccgtggagagagagaaggttttgggccgactttcggcccaaagccaaaagaggattttaaaaacctttttcaatttaaattattcattaaatgcaattccatttattaaaaatacttccctagctcaaataaatcccagaaaaatctagaaattatagaattaagcaaagtatttaatgaaattttatctgaccccattttatattggaatttattaattaaaactagatcttctcttctaggcttttaaaataaattctaataattccaatttagacaacaatttatatatttggaatttttagggtgtaacaggttgaaacaataaaggcaataaattaaatattctagccaaatttctagttggttccatttagctagacatgatcttatttgcataaggatacttataatgcaattttatggcatcaaattatggcttaagctgattaaaaatgcattcatgtaattagaataacattgattcgggctaaaatataagaataaactaatttggcccaagtgctggccatagcccaaaattgcatccggccgacccattatcgtgcgcggaggcccgtacagcccatgagggagatcaagatcgcacatgtgtggcctagcttgcccacaggcccatgagcaggctcggttggatctaatcgatggacatgatcacccagggctggttgatgcggtgtaggtgcagcgtcgaccgtccaattccgatcagacgactcagctcaaacgtacccggaacaaaagcaccaccggtttccaaaaccctaaccctaaccattaccctctctctccctgatttcaccgacgcaaggagcgcacgcagcggcagggatgccggcggagtggtgacgttgagacgcccgtgcgcagagaggttgatgctgagcacgtctctggcggggtccagtgggttgccgtggccgtaataagtgcccatgcgagctaaggctggtgacatagtgtgaaggcaggtcatggactcatggtgtgtggcggactaataccgcgcgtaatcccttcttccagcttcagttctcctctccagcgcggtgcaagaccacgccgagacaagcctcgacctcaagcggaggactgatgcgggcatgaggccggtccgaggcgacggcttaggggatgcatagcggcagtgaagtcgtgtgccattcacatgaagacgatggagaactcggaacgatcgcgcacgacggactcatgccgcatatggcgaactctggcaacctgagcccaaaccgtgagtcttcttactcccaaatccttggggtttctgattgagttgggatttaccggttgggttgcacttaatttgggaattcgtcatgatttagggaattgaatgatctgagtcccctccttggctccttctaattgctacccaagttgaacttgattagtaatagcaatctaattaatacactaaaacttagctctaattgtgatcaacagaacatgaataataaatttgacttaatttcaacatgaacaaaaaaacatacactgaacataaaccttaaaactttaagaagctgacacttagggaaaacttgatgcaacctttggcttcaatcactggagtgatggaacatgcatagtcctaagaaggctcttataccagaatattggagttaattcttaaaatcatgaacttaggctatgcttgatcacctcattaagcttacgagaaatttggtgtactgaccggtattgggagaagccattcggcgttgtgatagtaggacaccggtgataggatcaccgtgcggcagtagtgacaggaccgctgcggtgtggcaatggcgatggaacactacaagaatcctattaatccgtgatgaaaaatttctgtcacatatcactaaaaaaccgtcaccaaacaacatctgtgatggtttcagaaatcatcacggattgagcatcatggattgatctgcgtgacggtttgtcgaaaaccatcacagattaacagaatcggtgatggttttaaaccgtcatgatggagaccatggtctagttagtccaaccaagcccatttcctgtgatgaaaaataaccgtcatggatagctgccacgtaggatatttttctgtcacagattagctgccacataggatatttttccgtcaaggatttgaatcaccacgtatgtgccatgtgttcgccaaggtggacgctgatgtgtcatcgatgccatgtaggacttagcccacgtgttttgtggcccaattctttttccaaggagctttcggcccatttatgacctgatgatttttttttgttttgggccggtttttttttggagtgttttttcggccttttagtcatcattcagcccagttcaaattgggctacagctagattttagcccaactaaaattcagttgctgctaaatttagcaaaatacaaatatttcgtccataattttagcaaaattaattaccgatcaattaacattctctcatcatcagtaacaaaatagttattgatcagcacataaatattctaaaaacacattacaaccttcacatctcatacaacataattttttagcatatctcatacaacataattaaaacctgttcaaaagcacatgacaatacccaacagccaccaaagcattttggccactccatcaaagtcgcatatgtttgagcccagcaacctgatagtacaataccatgtgttagattatttttttatgctctagagaaacaagaagaaacaatctaccgatacgatattagtttttgaatgatagggctactttgcaacaccaatcttatgtcccataatacattgcactaacaaaactcaatgtccccatctacctcatttcattggccaagcaagcaagcaactgatgctatagattgaaggagaaaataaatgtggtccttttgcaggacagagcaagaaatccacagtttctgaagcaaagaaacgcaacaaaacagaactatcaaagatttgtgttatgtacaattaatctttaaacatcttacttcaggaatagctctacatatcacgtactgacaaaaacctctgtacaagaaactaaaaatcaaggcagtgcacaactagttcagagttgttctgagttcagaatgctatttgaatgaacaacttggcattcacggccaagcagataattcccatccaccaaactatagatagattcacaaacaactaaagtggttagagatatacacagacaaattctactgactagacctgctcatcatggaagcaaaaccaaaaatggcatttacagccataaaacgacactgctagtttggctccttttgcagcttaagaaagttatcaagtatatacatcaaacaaatctacttggtttatttgcagattaagaaaatgagcaaggatatacatcaccaaatacttgtacttactagccaaaattattatcttttgcaaatttacagccataaacaaggggttgatagcaagttcctaactcatttcagatataatgaagtgcatcgaccatgttgtcaaattgaaaacttcagtgcattcatagaactgatttcaatctgaaagtaaaaaaaaaaaaacaaattcagtagtagatacacgtctgggatggaactgtaaagacgggaagaccgctgcaactatgacgaggaagtggatgacgacggccaggacggatgggaggcaggcaggacgtgcttctatttgcactaattcaatctatttgaaataagagaaagaagggggaggaggatgggggtaccgtgggatggatctgccgccatcgctcgcctcctcgccgcctagcgccggtgcaccacaccaccgccgctcacctcctcctcaccgccgcacaccgtcgagccctcctcactgctgctgctgccggaggatatctctcgcggtcgctgccgaagcggttggcggccatgaggatgcgcccccgatggcgccgagcaccccgaacacgaggagagcggccgcgaaggcgatctccatgatggacgtgccccgggcccgcccacggcgccgccgacaaggtcgtcctcatcggagatggagaaggagtggtccacgtacgccacgcatggctaccctcgcctcctcctctacatctgcctgtcagtgccggatccgatctatgaactactcttccccacctcctccttcctcgctcgcagcctcgacggcgccacctccaccatcgataccgctggcggcgggagaaggaggcatacctccgcgtcgaacagggcgtactcgccgccaaaccatctccgccggaggttgaggaggaagaggttgcggattcagatggggacttggcggcggctagggttggggattgcttcgtttgattttggatcggctagggttggggaacatgggtatgaagcaacaacggatgcgattttacaagaatagccttggtgcatgtactagcttctgacactatttggacatttcacgtcaattttggcttgaccgcgcgcagtggcaccgcgatgcaaacctggccggaaaattttggcccttgcagtatgtttatttttggcaaaaaaaaactaaagatcttatggtaatttttaattttaatttatgagaactttaaatttaattttagactgatttttgtatttcaaatgaaaaaatcataaataacaaaattgtagaactcatcgaaatctacaactattgtattggtcctttctacaaataagttcatttgaacaatttcaattttgaattttcagaatttgacaacttcgaataaaaattggggttaataaatgattttaaatagaaaagtcaccaaaaccaaagatgtagaactcatcaagatgtaaagtttttattttggtcatttcttcatctgactctatttgaacaatttgaaatttgaagttcaaagtttgagaacttcaaatagaattttttattagtgaacggcttcagctgaaaaactcatcaacaataaagttgtataattcatctagatctacaaattttattttggtcatttattcatccgacaaagtaattttaacattgttcataaattttacatatctccaatatggtttcataaattataagagagatgtgtatattttgtaaacaatgttactatcactttgtcggatgaaggaatgaccaaaataaaagttatagatattaatgagttatacaacttttttgttgatgacttttttagttgaaatcatttactatttaaaaatattggttgaagttatcataatttgaaatttaatttgaaattcaaatttaaattattgaaacaaagtcatatagcaaaatgaccaaaacaaaagttttcgattttgacaagttatacaattttgttgttgacaattttttcatttgaaatcatttattcccgaaaaattatttgagttgagaggagggatgtaaaatggacttctcggcaagggaggagcaaaaagggctggcggcccgaagagggaggaggagggagagggaggctgcgggctgagggagggagagagtaatacttgggccgaaaaaggcccaagtatagagagatgaattttaatttgtttttttatttattttaataggttaaatgaactttgtgatattaaaattagttattgcgctctgaaaatttatggaaaatttcagaaaataatttagaccacgtagaatattaaaaaaaaattccagcaatgatttttaaagaaaaattttagtttcctcgttaattcatttgattaaattgctttaatctttaatatatttttctagtaatgctatatataaatatatgacgttttcttcaactataatacattatagaatcctattagaacacaccaggcaactagcgcagtggtaggatgggttatcttcaactagaggtcatgggttctattctcgttgggcgcacgttatgagttattttttccttctttgaaacgccaactctgagttgctgggccaactcgagtgacattgggacaaataaaaatatttaagtgcacattgggacatctagaacaagtggttcaaagggtaagacacattcctaccttctagctaagttgtgggttcaaatcccacatgctgcagatttttacccatgcgcaccatatttttttagtttgccatattatgcatcatatacatgtaacaaattaataaaattattttgttcaaatttaacaaaccgtattttgcgtttgattcttcttgcaatcacattttttatttttctttgcgctaaatatgttttattttttattgctttgggctaactagagtatgacgaatttaaaatcatacattgtgacagtcttgataaaactgtcacgagttagcaggccgtgaatatccactgggctcatccgtgacgaaaaacaaaaaatcgtcacgattacgtttgtcagtgacgatctataaatccgtcaccgaaaatccgtcatggattaacaagtttcttgtagaaattcgcccttcgatccccttcaacacgccttaggatcggtagtctcaaggttttgggaatggcttagcgtacgtgtctcgtcactcgtgcacagggttaagattccctttatatgtatcttgtggggatcgggggtgattctttcttgaggaaaacggtgtatccgatcatagcgttaaggagagaaacatgcatgaggatgcgtgggactcgctcttcaacgttagagatcgcgtgggcgttggtgggctgagcccatcgctctcctttctggctcggtggtcagagatcaaccaacaagtactaccgttaggatttttgttttttacttgatgaaagattgggaggatggacaatactaaccttaggatttttgctgtttacttgatttaaaattaatacatgatgattataggcaaattttgctacatgacaccgtgacttcgtggttttagctgtagggcactgcacgaagtgatttttgggggaaaacacttccaaaagttagatatttggtggtagtcactgcacacattaaagtaataatttccggttagagaggagagagaaatcgtgtgaaatgtcaaaaatgcccttgggcccacatgtcaactctcctacctctctatcccctccttctcttctctctctatcccacatgtctgtgacgttggtaggcaggcgaggttcggcggcggcggtgggccggcgagggtggagtggccgagggcgagggcaaagcggatgcgaccagtgacgcgcggaggagcgccggcgccagccagcggtgcgcccgggcagcagcgcaggctggccaacaggcgaggttcggcggtggcaactgcgtgtggggctgcagga

SEQ ID NO: 62144 - DNA, 1179 bp, Oryza sativa
  unsure (1)..(1179): unsure at all n locations
cgcgatgttgaccactgatggagacgagcttgccgtgacttgtccacgatacacggacactcagtcactgaggcggatgatttctgcgtcggtgtgcaggtagacccatttgcgctcctgaatgactgctgagacgcgatatgtgcggccttcatgcaatgccatcatgccgggcgtgacgcactggcgaatgagcggggtggtgccgtagtggttgatcatgccttcacctcaacctgttccaggaggccagccagcttcatatgccagcggttcatcgtcagcttttcacgcgggttagataccgacgtcagctgccactcgttatcgttgagctttttggcggtgtactgcttgccgttgtgggtgactgtcatctcacaccaccttgaataagaaccagcccataccgcacacaatcaggcccacaatggttattgcggaagacatgcgtacatggtcaatggctagttttgaaagtggctggcgatgttcttttttcgtcagcgagttgattgctatgtcgagcagaaacgtcccgacaaaccataatgcgtatatctttaagcccaactccaaatcactcataaatcctcttggccttatcgcggcgaacggaacgggtaatacaagacttcaacgcatttattcagtgtttcaatggtcggtggatagccggccgctgtcataacttgacccactcgaaatgaactcagtatgaaaaagcgctggttaggcggttttgagttcccgcggtttgggaccaattgggccccccgcagttattcaaatggaaaaaattctcgggccttaggaacccagtctaaaaaaaaaggtggccgtattccggccttatttgtttattgtaatcaaaaagaatggaattggctttttgagctttttggcccgggttaaaatgtaattattaatttggggaccttaaggcccgttattatggaagcgtttttattgtacccccccttttttganaaacaccttaccctttgggacccctttaagggaaaaagctttgtgtgtgtggggtggaaccttttacccgtgcgctttattttgcaaaatctctcgctcccctcttattgatatttctccctaacctcccacacctatatttctgttgtgacgccatcctctagtggtgtttttcatattattttgtcg

SEQ ID NO: 62145 - DNA, 1362 bp, Oryza sativa
  unsure (1)..(1362): unsure at all n locations
cccccccctccaacaaagaggccttatatggcccaaagagggcccccggggggttgaaaagagaccctctgggggttgtttaacaaaaaaaaagagagccctctttggtgttttgggacccaagagataaacacccttttgggaaaaaacacgtttgtggctcaaggcccccaacattggaaaaagacctgttaaacacccatttttcacaaaccccctacgggaaagggggtgccttaataccaaattttccaatgaaaaaatttttcaccctttaaatcacgagaactttttcccggaaacctccaagcaagttaggaaatctgcaaagtctgttgcaagatttcttggcaattaaaaccactttaaccgtgtacttccaactaatgatttggaattaatctggaatccaggtgttagttccgggggaaaccactgcaatgttaatatcccagatcatccatgatgatgaggaatctggtatcctttacttgaagacaaatacttgtctggctccatcccattaacanctggcatgttaaataatatgaatttatatacattggaaccacaaagttctctggcttacaattggaccccagtaatttgaccaagttagagcacctagcattaggtcataaccaattatcatcaacagtaccaccgagcttatttcatcttgataggctcatcctgctagatctatctcaaaatttcttcagtggtgaattgccagttgatataggcaatataaaacaaattaactacatggatatctatatgaaccgctttgtcggtagcctccctgattcaattggacatcttcagatgttaggatacctgaacttatctgtcaatgaattccatgattccattccagactctttcagtaacctatctggcttgcaaattttggatatatcccataacaacatttctggtaccatcccaaaatacctggccaattttaccagccttgctaacctaaatctgtcttttaataagcttgaaggtcagataccagaaggaggtgtcttctcaaacatcacgttgcaatccttggcagggaactcagggctatgtggtgttgtccgtttaggattttctccatgccaaacaacctctcccaaaagaaatcgacacatactaaagtatattttactcccgggtataatcatagtagttgcagcggtaacttgttgcctatatggaataattagaaagaaagttaagcatcaaaatatttcttctggtatgcttgacatgatcagccaccaattactctcctaccatgagcttgttcgcgctaccgataatttcagtgaagacaagggtaccgagctcgaatngcaaatcaacacg

SEQ ID NO: 62146 - DNA, 7408 bp, Oryza sativa
caaacgcttacatgtgtgttaaaccctcgtccaggaatcagccgaggcacacaataacaaattgataatagactatgaatacacagctatttaatattcacaaataataatttattatagaggtggatagttcctctcaaagaataacgttctacgcagcggaaaaataacagcaaactacggaacagctatggcgactccactccacaggcaacttaacccggatcaagcctagtcctccagatcatcaccttcactgaagtactcatcctctgatgaatgaatattgcaagaatgagcatatgacatactcaacaagtcacacagcaaacatgcaagtgcacaggataacaaaggatggcataataaagctcatttgcataaacaacatttaataaatatttaagagaatagtaaaacagttgaataattaagcagtattaaataaacaccatacaaaacacccgtgttgcataggcccaacctcatctgaacaaccaaccccggttgtacaaatcaaacctctataccaggaatataccattccaaaccaggagtcacattaattagcacaattaccattaatgagtagcgtgagactaatcacgaaaaacattgcccaactcacgcataaccgcgggcacggctattctaatagttttactctgatcagaggtgtaccattgtacccacaagatacaatcccacaacatgttaccatgcgccttagtaccaccacggtacctcggaaagaaactgtgacattaccccttgcacaacaccactcaccacagtgcaccgtccctggatcataatctccccctcaaaaccagaggcaatggactccccagcgacccccacggacttctcgccgcttcacagtctggcacactataatgaatcatgctatacaaaagataaagccgttgcccacgctggcttgtggttggcacagtaaatatttcacaacagtagctcgcgaaccggtccttaattgtcatgagcacaaccatcaaaaccatatactcacaacccaccttaaccaggttttaattagcaattaattaccatcacacgattaaccatcgtgagctaccattgaatataaccataattaataataataattatataatataatttatatttaacccctttagttagctaatgtttctaagcatagctaagcgaatatacatatagcatttagctgaaccaatccaatatataaggttcatgctaatcaaattataacccataggaaaataaagtcatcttcggccattaattaacggggaaaggttaaccacccgatgacattcgaaaataatgcatagttgaaataaaacaatagctttaaacgggttcaacatgctcaaagggttgtttgggatctgtgtgacttgccttaggcttccacaaacgcttcggaaccttcctcaacggaaacactctcctccggaacgtcggaaactaacgcaattaaacaaaaatcaacaaaacagtaaaaaataagcataaacagtacatgtggatatttttaacatgtagatctcaatttcagaaaaatttagcaacttgaaccacctgaaacggatctacggttatttagttatgattttccaaagttttaatctattagaaaaacgggaaaaagaaaaaacgatgatgacgtcatgatgacatcatcaatggccggcccgggttggcgacctcgccggagattggatggttggccgggattttggaggacatgtacacgtagaggacgacgagacgaacccaacggtactcaccctcgagccaaacgacgaacgacgacggccggcgacgagatgaacggcggcggcggctccggtcggcggtggcgggtaggctccggtggtcggcggcaacgggggacgggcggccgggcttcccctcaccttggcgcacctattggcggcggcggcaagcggcggcgacgacgaaggcggcggcacggcgctaccggagatggccggcggcggtggcgacgactctacggggcactagagagctcgggaaagggggcaaacgaaagaggaggactaggggatcctatttatagccttggattggagatatcggactcctcccgcaagaaatcgatccgggaaatcaaaaactcggttttggagataaactcgaaaacgagttcgatttggataaaatactcaacgattagctccgatttttggggtaagatagaggaggatgagatgagaaaaccccctcaacaatcggactcggggaggccggattcgatgcggatttggaggggaaatggggcggctcgagcggatgcggatttggaggggaaatggggcggctcgagcggcatggctgggctcggccggccggctgctagaggttagggaagggtccgacatgtggggcccacatgtcggtctcccaagtggagggggcggctggcgggttgggttaggccggctcggtggctttgggccggctcgggcgcgcgggagagagaggagttgggccgaaatcggcccaacaacttagggaagggatttttgaactttttaactaaaataatttgtgaaatgttgttccaattattaaaaatacttcccttgctcaaataattcccagaaaattctagaaaatagagaaacaagtaaagtatttaataaaattttatctagctcatttttatgttgaaaattttcctagattattagagtttaacttgtaggcttttaatttaatttctaaaaaagacttaaacaatgtatttataatttaggcgatttttagggcgtgacactagctagtcgtaatcaccatcctaatattaaagcttccatcatatatttttacaaattataccagtcttggatttaaggagcagcctgtgccaatttgctactttgtaatcattaactcctaattttagaatgaaaatcacaaaatacatagagtagttctactataagattaacatctccaaattcaaaattaagtaattgtaaaatatgtagtctcagttatagtatttttttcatgacttaatagttatgatattcagaattataattaataagtactgagttgtactcaacgttatggccattttttcatttttttaattcaataagtatgaatttataaatttataattatgaaattatatgattttagaaattctaatataattgtgttgtacttacatgtcctcttatttaatctattcaatcgcaattgattttatttttttagatttgagttattttatattgtatatgggatggacttttttttgctctaaatctaagtccatctaccgccaccagaattagcacggatagattattttcaatctagtgtaaatgtgtaactgcacactctctagccaaaaagataacaaggaaaaaaattgcatgtatgtgctcgagcaattaatgtaaacacctagtctgtagtggaatgaaaaatcctatacttatgtattctcataatatatacagcttaagaatacaattaatactatggggcatggttggtccagaagagagattaggtagatagttaatctcgccggaaaaaaaagaaaggtagatagctaatcttttttagacagaaggccaacggcccagcttataatgaaagaggttttacgtcgctaggggttacccagtttaacagcagcacaaaaacaggagggatagttatccttacatattcttttatctaagagccgtgggatcgctgagagattaagagccgtgggatcgctgagagattaaggctgccacgtcagcttgatttggacaaagctaacaacgataaagctaacaacgacaaagccacaaatgaggcctccaatcgttttggttgggcttaatattacctttgccggcccttccttacacatgggatgtttcctttcttatcgctcggcctgctcaaccccctaccttggtgcgatactgctgtttctcctcttcctacacgcagcagcgccgcatcgatttgggcgctcactacgtacggtgctcgccggattggccggcgtccctgccgccgtacacggtagtggaggtcccttgatgaaaactcctctctgctggtccgtagacgcctcctttcgccattctctcctcttcagttttttcggtgaggtcgccgcacagtacccgttcttgctttctcccctttcttcctgtgcaaatctaatccagtggattcttatgtttctcttctttcccagggatttcttcaccgtccggttgtgcattggcttcccctaggaccttcttgcgtcgcctgattgatctgcagggtgtgccgccgtgggagaccctaggcctccacttcccgtgctaaggtagtttaatcatgcttgggtgataccaattttttccttattgtgtgacattgatttcttagcttttttattggtttttcagtttgttcatcatgtttattattactctatttaccgatgccaaccgcacttacctctccactaaccaatctaccgccttgcctacatcggccgcatcactagcttccaccatggaagggggaagcaaaggagatagcaacagcttaggggcacaaccagaagatcaaccggttcttctcccatctactgatctacatgtccataaagctgtggaatcacaagatcaaccgactattctcctatgcactcatccagatctcctacaaaattaggtattttcgtcaaatagatctcctctacatatttgttcgtggtttgtcttagaagcatccaattaatgcttattcttcccctacatacatacacccattcattgagcctgcctttgctcaaaaatacctttcacttgcaggaatcaactaccaatttcgtctagcagatccaaacaagtcaaccaatactgcatattccacccacacatgacgatctgtcacagctattggatctgatgaatctatcctagatccaaccgtacacggcaaccctgctccagagcaatatgtctacctcccaggggtaagtcaaaagaaaagaacactcacaagttttttcccaagcgtgcaatttaaacttaaactacctacaccacattagctcaccctctatctgcttgaaattatgatgcattcactgctttagtcatatagttcaaacatattacaatataattggccattatatatatgcaaagtaaaatatcattgcagtaaacatatagaagaataacaagacatattgcacccatatgaataataattttaacaaacaatactaatatatatatctacatgtacatctttattttttagacaattgtattaaggtatttgtatccacacacaacccaattgtgctcacaaatgtttttttagtcaccttgatataaataggctgcaactaaagtctatatctcaaagcagctcctgctaacgcgattacatccaagcctggcttagtcatacattcgtcatagatcaagttcgaaggaccagatcagtatagggccaatttaaacatggatttaccaagagtaggcattcgggtataaaaaaatgagatacattctatggtgaggtagcagacacatcctacgaagctaaagagagtaccacgcatgcagccattcaatgccttcagagaaagaaaaatattgcaataaaggatctactgagaagaaactccacacaaccaagcaaatgttagacctgtttgcacatagtctagaactccacagaaacgaaggtcacctcctccaacagaaccaacagaaatataacatgttagtgaatgagatcaacatgatctgtgcccaaagtgcattataccttcccaaacatgtcaaatggttgggacaaccagcatggccaaacaaatgatatctctgttgcatacattggccattctccacctgtcacatcaaatgagatacttgcaaagcatctgatagctcttacgcagtacaagcatgattgatcatccttccttcccacataggcaagtattattcaatctcctacattatacatatgagtattttcaatgtaccaacaggtcattactaaacaatgtctattaccgaccaagctatgcatcccaaataatgaattgcatggattttcattttgcaggataaacaaatgtgtatgtcacatggctaggaaatccaaatgtggctaaaccatcaaagtgctgtgtccacattgtgctagcttgcatttgcccctttttgtagcatatgttcaaaccgcttggaccatcataattgatgagcaaaacaatatatccctatatgttatcaccactgttataatgttaaggttgttcaaatattgtaccatgtacatatcgtacctgatgttatctgtataaatttcgtatcctgtacacatagatatcgactccatgtaaaataatctactctatgttactgttgtttcctcttttatgtaaaaatgtctatgcctattatcttcatcaccatcttattcacagttgaataacatgcaacctcctgtttgcatacttcttattaatcttaaggaaaacaatttattatgataactatgacaaacttttttatatatgcaatgaaaaatgcttaactcatggctcatataagatcccttggccaaagctgaataaaaccgcgcgcggcatagcgcgcgtttattgctagtcagctttatagctgagaataaagattgcacgcaggccaaaacacaaaaaaaacaaagccctcagaaccgtgataacatgtcatccaacagtcgatctaagcaactgcacggcagtcattgtgttctcttccagctgctccaactggttggcgccttccttagtctatgccactgtctcaaaaagaaaatcactcgaaagatcagcgtgagagacgtagaagggatcttcttattgaaaatcatgtttttcctggctagccaaagtgcccaggccgtcgcccctaacaagattattaggttattggatttatgtcatggtaagccaacaaactgttcaaaaaataattgatgacataaagagggaggggctccccaatctagtgcatatcttagaatacaccacaggaaagtggccaaaggacaagtgaaaacaatgtgatcagcatcctctgagctgtggcacagggtgcagctatcccctccccctatacgacaacagtgaaagaatcagaagatacaatcaacctgttaaaaggaagggtagaataccgaaagagcatcaacaatgaatcaatctaatattgacggctggcggatgtgattgcttggtcctcaactctatggtcgttgaatattagcacccatcgttgctgctcttggcggagagatataataatgttttcatctacggagaatttgagatcagaacgaagggatcaac

SEQ ID NO: 62147 - DNA, 1854 bp, Oryza sativa
  unsure (1)..(1854): unsure at all n locations
cgcccctgtcccaagggcgaggagagaacactgtttcacagcacccccacagagaggatgtggtgccgtgtgccggcctctcgcgcagggtcttcacccgtagtttttatatggagccttcccatccccccggtgttggggtcaaatatgaacccttaaggcacatgagtccggccttcgcgccttggggagtccaacctcctccataatcccgtgttggatggtcggccccaatccttgataattggtggcaaacacgcaattaaggtcgcttttatagacccaggtttaagcggagaagcgcaatttccgagttgggagggggcctcccctggcgcccccttctgggagaaggggattggcctctcacacgggaccgccgaccattctccgttgcatggacgccggttataaggttacttgcgttccggtctcacctcctcngacgccaccacttattgcacgtaggccaaggcacccccaacgtccacgacatgctgtcaccccacctcactgccgatcgctcacttccctctttcccatcaaccatggtttcgccacgcatggatctgggcatccacattgaagggaagctggatccaaaagtggggttccgaatctagtgtctccagcagcctctgtcaccctggctacctccaaccaccaaccctgcttccagtggcggatctaggatttaggatataggtagtccgacctaattttatttttctaaacacaacaaatctaatgatactaatatgagaatagaatagaccaaatcaccaaaagtttaccatgatatattaataaaatatcttaaaacatcacaatgcacaagagttcaaaattttaaaactgaaaactgaaaaaggtacccaagtacttcgtagaaaacataaaattgtcagcgcaggcagccgggcatcggcggcgacgcactgcagcaagctaggaggcaggtctccgtgactccatttgccagttttactcgactgatcggctcgaagacggctcctcgaggtggcagcacacactgcagcctgcaacactgcatagcagcagtgccagtgcggcgtagcggcgcggtgtgggcgtggggggcgcgtcacgcgcgcacgtgggatagcatcggcatggcgctattgcgtgatcagatgagatgagaaagcatcgctacgctaggggctagggcaagatgagagagatagagtcgcgcgacgccgcgacattctgaatgatcgatacacgcgcatgtggggcatgtgggaggaataggatcgctactttttttttcaatagtcgctatttttttaatagtgggtcgatcgcctttttttttggtggtccatgcaccacccggaccaccctctaaatccgccattgcctacttccatggcaagttggtgctggatatggcaccgccaaggttgagggggagtcaccatgtcatgtgacagcatcttcgtcgccgccttgcaccgcccattcttcatgccagaatcaggacatcagggaagccccgccaccaccgtccttgctcaccgcttgggttccggccgcagctccagcaacagcaaggtagagggggtagggtggtgggtgacgcgaggggatgagtagagctcgcacaaattaatttaacttttccaagggcccgccgtgttttgcaagttactttctgtcctgccatagagttgatttatttgtagcatttaaatctatcaaagagggtgatttgcaggcgcttatatgcacatcatcggcccaagaaaaatcgcattgaatggatcatacttcatcatatctcttatctaccaatttaattagtatagtcaaagccagaaaactttagag

SEQ ID NO: 62148 - DNA, 8201 bp, Oryza sativa
  unsure (1)..(8201): unsure at all n locations
cctctccaccggcaaactggcatgaaaaaccggggcgcccccacgtcacgcttaaaactgcccacatcctgcgtcccgggagcacgtccgaccgtgcggatgtggttcccgcccactcgtccatcatctcccccatttttccccaaatttttgtgccaattagagctccacctagcccacgtcgccggcacccattcgtccttcaaatccgcccctcccgtcctcgatctcgagctccccgcgctataaaaatgatcctcgagtcctcctctcccatttcctcatttttcccgagctccctgcgctctctcccgctctcctcacacgagcccaagcgctgccgctcgccggcgaccctccagtcggccgctgccgccgctgccgccgtccccgtgccgcgccgtttgcgccgccggcctcgccgagcgttgtcacaccccgtccatcgctcatcttccccaatccactaccgaaagaccacatccaccccgcacccatttcccccactctccccatgaaaatcggcgccagttaacccctccaccgcaagcccgaggagcgccgtcaccatctcgcctctctccggtgccgtgccgcttggtgagcatcccctccccatcctctctttcgccgcctctcatgccgtcgccgctcgtcgctggcgtcgtcgccggtggtctgggcttggcggtcgctgccgcctgtgtgcattcctgcctggccgtgccactcggccgtccgagcggtctcggccgatccgggccattgggtgcgcggccgagtggccggtcgccaccgtggactcggtccacggtgggccggtaccccttgtgtcgctgacgtatggggcccgccccttcgtggacgcggtccgcgcctcaccccttgctgacgacagcagtccccttttcctttgtaaaaataaataataattgcacaataaattgtatttagttctagaaattcatttaaatggctcaaaacttctaaaattcatatctaattcattcgaactccgaattgggccattcaacttgcaaaattcatctaaaattgagatctacatgtttgtttactttttatgtactgtttccttggtttttattagagtttttcctcgttttgcgtgctagcgtgtagaatccgtcgtttcggaagtccacggtcgcgaggaaaagagttcggaagattgttttgaagaagcaaggcaagtcacacattccccttgagcatgttgatcccaatttataaatgtttgaccatttgcaaataaacatacatgtcttgctaattacatgggatccgggtattacctatctgcttgcttgtgccatgtttacttgatatctgtcctttgtcaaccctgggtaataaatcgactagctcatgttacttatgtgacctagctagaattatatgcttagccatgcttaattaccactagctcagttgatgggataattacagtattagacctttttagtatcagaatgagctgcgtgctcgagacatctagccatgcttcatggtcgtaattatccaactaaaatgcgactgaatggtgggctgtgggtgcatggttttgctagtcgcacccatggcaattaaggaccggttcgcggtatgccctagaagaacttatcgtacttaccacaagccagcatgggcaatggttggacttatcgtacttatcacaaggaagcctaaaccatagagaggtacaacatgtctcaaacaagagtaatacacatgaaaatacacaagatagcacaagtgatcatacaatgggagacatgatagcacaactaggcaaataaggagataagcatcacaatcacaaagataaagagagtgagaggagacaaatgatttgttttccgaagttcggattctccaccgagaatcctacgtctccgttgaggagctccaaagagccgggtcttgattaaccccttgcctcaccaagaaaaggcctaggaagaggtctccggtcttcaagccaacacccctaggtacttctctttggtttcaagtgaccactaagatccccaacttgaacaccaaaagaacaccacaagtgaggcttgctctaccaagatgacatcctaaacctcacctcggattccactcaccgagttttccgtttccttttggaggtggaataacgccctcacaaatttgcccgggtcaattcacaaccttgttggaaactcgcgggcgacacctaaccatctaggaggtcaccctccaagagtaacaagcttcaaataatagcccaacgagataccccaagtgctcaagtcatcctagcgttcaaaaccttctccaatcctcaccaccaccctcaaaatcactctctcactcaagaagtacacaagatttgggtggaggaagcaaaatcacattgggagaggctagaacaagctagggaacacaagaactaaagtggaatggccaaagggtgacctggggacgagatccatatatataacggctaggtgacgtcatctagccgttactcacaagtttgaactggaaacctgccaggaggttccgggtaaaagtgccaggaacatccgggcagcacttatgaaatttttcaacctcacctcggtgccaggaagttccggacagaacctccgggtgggactctctgtcccgagtagagccattttcaaaaacagctcctaaaaatatttcaacacttggacaccactaagagcacttgtgttatctcagaaccacacttggaacccctcttaatagtacggtttttcctaaactcaaagcgaaaaagtaaactagtctaactcggctccaagtcttcttgccgctttgttttggggggtctccaagcatcctagcccactcctaagcaacctgggactaatacaccactaagaatgttatcttcttgcttcaccttgagggttgtcaacgtcaacgccatttcactattgggactattctcacctacacttaagcatattagtcccaaatcaattatacctttgccttgatcaatgcccactttggattttgacttgatgttcatcgaagaaccacatcctcttgatcctcggcattccatcttgcggtctaattgatacggattactcatagcttcaaatggcctcgcacagtccatcatgaccatcatgacaaagccttcactcgtccttcaccaccggattcggtgaatcggtgccaagcctcttgcttgcccttcaccccacgcatggtccattgtagccgagccttgcttgcccttcaccgttttgccataaatagccacttcatactccgcatcatcaatgtcttcacttattcctcattaaggtataatgtccatcttctagccgagcctttctttttcttcaccggtttgccatagatagccatttcataccccgcatcatcaatgtcttcacttgctcctcatcaaggtataatgtccatcttctaacttcaatcttttaacttgatggcggaacttaacctaatctcaccaactcatggaaatagttagttccaacaatgggttgtcattaatcaccaaaacaatcaccgcactcttaggatcatagatattccaatctccccttacaaggcaattctagtacatagatcttttaatctcccccttttcggtgattgatgacaacactatcacaaaataggaatttaaagagaatactctagtatatgttaccattagcatgaaacatatactagagggttggtttcatcaacatatgaaacgagtatacactttcccctttatatctctctctttatacttctccccctttggcatcaaacaccaaaagattgaatgtttgggtgggagcataaagaaaaagaaatcatcaagtatataagaactacacaagtcctatacacttgaaggaaaaatggtttaacatacctttggttttccaaagaggctacaacaagatgaaactctatcaaaagcgttagtttcaatatagcaaagtacaaatagcctcgaggtacacacgtatacaagaaaaacatgtgcaccaacaccgaataaagcaattgaactcatcgaaattccaatagaaagagttggagtccaaagaaacaccaatccaaagcaagcacttttttgttttgtgcttatgaaccacaccaattaatagaagaataccaatcaaaagagataggccttgattatagtcacaattggtaagaacccatatgcacatatagcaaatacattgattagttaaactcgcttaatttggagaaaggcacaaaagcataattccaaaaaaaatattttctctttaatgcatctcccaaaactcacttaaaggagggcaaaaagtatgtcgggcatataatgctatagacaagtcatgtatgcccgaatgaaatgtctcataagccaaaacccaataagtagtgatgatgaagagacatatcaagacttatgaaacatcacaacataggatgaactccttctaaatacgtgcatagcaaagagtgaaaagaaatctttatgcactttcacaaaagaaatgaaggaacaaaagaatccatcctatattatgaaatcaaggttgcaaagaaaatccatagaagcaataatgaagtctaccttgggagtcatccacttccaacatgagaccaaagaataaactcaatttaaaccattagtcttccaaggtatagaataaacttcccctcaaggtgtgcatataaggataaatttaatgcatacatatgcactttactaaaatgagaatcggggaggagtttacactatattttgggtcaaggaggcaaatatcaccaaaagaaataaattgaaggactagaattgtaaagcacactttcataaacctcacatctcaagatgatggtgcttaaccaatctcatccttcttcacccattccttcggttgtcataaatcaatctccccttgatccatcattatctcttttctctatttgaatcaatagaaaagagaaagcatcaaaagcacacgagtttcacaaataatgatccttttgatgtggaggaaaattggatcacttatttgtgaaacctcataatatagactaaattctcccaaaagtaatgcacacatatggtggaaggcaaatttatgtgcattatttgacatttaaatcaagcaagggaatttaatccatattatgaaaggtagctagataaaatataagatgaaaagttaattgaattaccacttgtgaatagcatacctttgagaatgtttcacttctcatgagactaaacataaaatacacttaacaagaagttagtctaaaaaaatacaaaacataggacatgctccccctaaatatgtgcatgcaagcatttgaattacttgatagaagcatgcacttgtctaatgaaaagaaatgaggagtacaccctataatttcaacaatttgcacataaatgatttgcaagaatatacatgtgccaaacattgggtagtaataatgcatgtaaattgccacaagataatagatggcaatcaaccataagaaagaatattcatgacacttgaagcttgtatatgtagagatgatgtaaaagatttaccattggagcatacaagtccttagtagaccgaaactttcggttcatacatgaaggtaatccaatccatgggctgaaaaatctacaacaaaccttggagatagattacacgataatgcacaattttcattgcgggagcattgcccatgtctcaaccaacatgcatgtacaaggatcaaaagaattaagaaagctgaaaatttgaagatgttcaaatttcggaaactcaaaaaataacttagaaagagcattgaaatgacattcaaatgacctttgataatttagacaaaatttggcagtgaagtccaactatagagaatcgaaagtcacaatgtaagctctttccaaatcacaacaacacaacccattttgagatataaagatcacaaattagctcaaagtcaagttttactgaaaatttctacaagttgagaaaagagagaaaaagtctgaaataattcaagcttgcaaaaaagatctttgaacttgagagaaacttctccaaaattaatttcactaaatgagttttcgataaagagaatgacttttaaaacaatgaatttcaaccaaaagattttttatgaagtttgacatttggaaagacttaagatgggttagaaataccaaattgagccaatgttcacaaagaacattaatcaaattgcttaaacccaccatatgcaaatatagaccaaatatgatcaaaacaacatgttggataaatgacattttgttccaaaaacaaaaatttcactccaaaagctttttagaacatttgaaataaaagatgaagccctttgaaacatttttcacaaattttggaccgtcaaataagaattttgaatttttaccaaaagagacccttttagaaaacatgtcatctaaacttttgaacttttaaattttggaagcttgagctaaacgtttttgggccaaaacaaactttaaggttaaaccaatattttaaaacaatgttttgaggcaagttggaccggaacttcctaccaatttgtccggaagttcctatcggccctctttgtctccacagagagtcctgaccggaagttccttgtactttgtctggaacttcctagcagacaaaatcagcacgcgagaactttcaagattttgctcaaaatcacccaaacaaactcggaatttcacgaaatttgaaccacgagctcacaacaacatgggaaatcagatgaaacaagaaataaccaaaatatttaatatttcatcaccaaatttaaagaacttggaaaaccaaaggtaaaaaccgagtttttggaaaaccatcaaaatccatggtgctcgtgtgagggatttgtttgaggatcaccatatgttcgttcacaattgacctagcatcaataaaatcacttttaaaggattcatgtttaattccttgctcgaagaaagataaaaagttgaagttccaacaaaatgacccaaatgcaattttgagcaaaatgagatgttttggagacaatttgatttttatgagtttgaaatacgtccatgaaccaatataaatcacaatatatggttctagtggctaaactcactcgatgctataataggaccaaatatggtcaatataaattttcatgtgaattttgagatcaaataatttcaaatcatttatcatataaaatagatataaataccaaaaagatttgaaatgaccaactctagtggcttgtcaaaaggattatttgcaaaaaccttttcagatacattttgacataaacacactttaaaagcaaaaacaagatcttagcatctagatttagaggctaaaatcatttttgtcgcgtcccaaaacgactctaaaatacatccttgaaattatgcctagaataattaaaatccttgtgaaagcctccaacaattaaaatgtgcaaagttaaaagtcaaataaggcttggaggattttttttatatttcctaaaagcctaaaatgcgtaaataaattttagtggaattttcagagcacaaataatatttaagaagaaataaacaaagttaaaatggttttataaaaagaaaaaccctaaaaagatccctttcccttcccctctccctcttgggccggctcggcccatccctttccctctctcccctcttccccgcggcccattcggcctacttcccgcgcgcgcgccgctgacgggcgggcctgcccgccaccctcgctgacgggtggggcccacccgtcatcccctttctcccgccggtcccgccgcctcgcccgtgccctagcgccgccgccggcgagaatcccgccgatcccgtacgtcccgcgtgcaatcaagaggggggaaatattccccgtgattacctccctctttccccccatttttccctccctctctccctcggattcgttcggaaactttccccctaacctcgccgacgcatcaatggcggccggatctttcgcgcccgttttcccctcattcggacggtctctccccttccaaccctatataaacactccccgtgccttacttcggcgtttacgcactcgccgctcttctattcagcgaataaactcgcgccgtcgcttttctcttcgncgtcaccggcgagctccggccgc

SEQ ID NO: 62149 - DNA, 3695 bp, Oryza sativa
ctgattttgatctctaaatcggctccgctagccggtttagctgtttttctacaaaacccatcttgatttggccctttggctagatcgaggtggttggcgactccatatcaccgcaaggcgtttaggtgttgcgatcgtgcttgtcgacttgtcaaaaaagttgccaacagaaaagattagtaatactagccgttatagcagcaagttatgttgcgatggttcaggcagacagctacatgattcacagtacatctgaaattcggtgaagttcggcaagtttttttgtagagggcctgatgactgtagtccaatttctagtatgaaaaatagagcccaacaaggttttccagcaatttacgactcatatattcctatagcatgtggattctcgtgtgtttctaacatataattccagatgataatcgttaaaaatcacatctaaaagtaataaatagttaaatatctctaattttgtagttaaaacttatcacacaagggtggtaaacgatagctgggttgaaactgaacacaaccacttatccataggagtgcgttgtcattcgcaggggtggatgaaatgttttccatagaccgaaatatttttaccctataaaatatttgaggactaggtaagctcatgaaaaaacccattaccaccaccggtcatccagtgatattatgccatgcataaaacagaaattttgaccactaacccttaagccaaacagcaccatatatacacttttaatagtccctagcagtggcagtgaatctgtcacctatatataactgtttttacaaattggctcctgaatattatggaatagcataaatatttcgttcaaacaattaaaaaagttgtactaacatatttgacaattttttaatattatattatattttatccatagcaaatcattggtatttttctagtgaaccaaaaagctcccaaccacagtagacttcatcatttcacttattgacggaataagcgaaacaccatatttgcaaacggaaaatggtttgtaaataaaacttttatatacatgttcttagccatctaaaagtaaaggttgaaaaataaactacgatgaaaaccctaaaatcaactccaaatttaaggttgaaaatttaaattttgtcttataagaacaagtataatccaaaatataggactagcatagcatggcacaaagggtttggttagccagaaggcacggtgtggtggtacaatgctgccacgtcatagtcaatgggcatagcatcactttactactatggaatgtccagcttcatggactattacaatatgactatttttggaatttcaaaacataaaaacaaaaatcttaaaccagtattaaggcatgtacaacagtgcttaattattaacaggctctctccgttactatgcaagtaaatttggaaacatggaaggcagagagaagaggaaaaagaaacatcgttgtaatgcatgacaacatcttagagtcgactcttagcaattattaaataaaattttgttgcatgtggatggagaaaaggaaacaagagtaataaaaaaatattttggtgcattagttgttaatatgttttcttatgtcaacaattgttgcccctaggatttcttttttgttcttctcgtgacttgccactagcattttcatgtgagttctgactgctttttgatccagataatttgtagggcaggttgtagttttgggctgtcaataccaactcctccttcatattttcacttctatagttatcgtctaaaccttatccctaaattaaactattttgttctggttgatgtgcacctgaagatagttcaagtccgggaactcctgggaagcctggcagctgagatgccggcattcttatcagacaccaccatccgccgtttcctaagggcaaggaactggagcacggaacaagcaaccaagtcgctcaaagaaactgtcaagtggaggcgtcagtacaggccagaaagcatttgctgggtgctctcacaaatcccaaatcaacccctttgttgagtttgtaccaattgttttttctaaagcataattgtttgtaattattatgttttggacgacattgctgacaaggagtatgagggtaggagagcatatatagctgactaccttgatgccaaaggaagatctatactaatcacaaagccgacaattaaggtcagatttttgctgactacaggatatatatatgccggtctgactgtgataacaatccactagtaatttggagcaaatgaaatgattcaagtccccggttgaaaaaactaaagacgttctcgaagaaaatcaatgaatactaacaggatacaatgccaacttaattaggtgactgaaagttaacttttctgtagaattcagaacctcagacttgcatgactacaaaataaagttatatttctgcagttctcttaccaacagattaccatactaggggtggcaaaaagtgctgttcttacagttcaagttgaatacggtttttattatgtatgatgggtttatgggcaataattaataaattttgaagggtttctaatgtggtacgaatttaggcagggggtaggtttcagggaaggagcagataaaacactttgtatatctcctggagagtttggctatgaactctgcagatgaacaagaagaacatgttacttggctgatagacctcagaggctggagtatatcaagtacgccattatcgacatcccgtgaatccatgcacatagttcaaaactactatccagggattattgcagtagcaatactcagcaacactccaaggatttttgaatctttctggaaggtactatgcaatattcaggacttctatttactcttactaaatgatgttctgtgatttagttagtgaatatatgtactacctccgtttcaggttataagactttctagcattgtccacattcatataaatgttaatgaatttagtcacacatatatgcttacattcattaactggtaataattaacatatctatgaatgttgacaatgctagaaagtattataatatgaaacgaaagaagtatgaactagtagttgtcttgtcctcatttgcagattataaagcacttcttggaagcaaagatgagcgagaaggtgaagtttctatatactaacaatccagagagccacaagatagtgtctgaaatgtttgacatggatctgctggagactgcatttgggggcagaaattcaattaccattgatatagacaattatgctgagagaatgaggagatcagatcttgcgagaggagttttaatcatccaaacggacataaatctgattagtcgacatcactgaatctctattctctgtggagaatgcctattgcttaatgacagctaatgaagaacaagaaggtaccgtgcaaaaaagtggaagaaaaagaacaagccatagaaaactacgtgctcaccttagctgttttagatgttatatcaattaatctcaataattatggacgacatgttgcgcatgatcaaaaaaccagttaatccttacagtatgtttatgtaatctaatactacctctgttttatattattaattgttgttgacatttttctaaatccatcttctttttagctttgatcaagatttgtagaaaaatataactatattttcaatgtaaaacaaagg

SEQ ID NO: 62150 - DNA, 4882 bp, Oryza sativa
  unsure (1)..(4882): unsure at all n locations
agcgcattgattgctngtcgagctggacaacggngatacagagaacagaagtttacatacggagagtatatgaacagcgatgttcgtgcattgccattgcatctagcatcaatgcacgagcgggaaacacaaagtgaagaaattacgagaaaatcaaagctcgatcacaccgagatatataggcagtcgtgtgcatgatggatggcatcgatcgattggccggtgtgtcggggtcaaattcagttagaccctggccggggcggcgggcttgtggtggtggtcggcggggtagtcgccgtcgtagccgacggcgccggcggcgtggttgccggagaagaggccgccgtggagcatggcgacgtatagcagctgcgtgaaggcgaggatgatgaccaatgccttgagcacgcggaggcgccacccgcggaagccgccgatgtggatcttcttgcaggcgaggccgaaggcgagcgctgtgatggcccaggcgatgagcgccgacgcggcgccggcggcgaggctgtgcgcgccccaggagcggacgtggtggacgccggcgagcttggaggcggcgccgaccacccccgcgaggatggcgaagacgaggaagtagaaggtggcgccgttgccggcgacccccgggtggttggtctcgccgttgatgtagtggttgagattccagctcgcgaacccgatcacgatcaagtacatgatcagattcagcaccagcagcggcgcgatcatcgtcctccctactccggccatctcgtatcaaaatcacaaatcaacacaaattagcaacacaattagcactggtttagctagctagctgagagctactgtgattaagtgaggagaaaacgtgctggttggtggagggatatataggcggggagaggggtgacacgtgtgggtggatggggatggcacgtgtcggcgtgtggcaaggggtaggggggacacgtacgcgcggggccacgccacggacgcccggcttctggtgatttccggagaggcgcgacgcgagggagacgggggtaaagaaagcgtaaaaaagtgcagcgcgcgcggcgtcggcgtgtgcggaggtggcgacgcgcgggcgggagatcgaggggaggagaagcagatggttccggactttcgccgcaagcgcctcggctcggggtcccagagacggcgtacgtggcgggcgtggttagagcacccgcaatgataaagtaaggtgctatctataaaacatgtacatctcagcaatagattcgattaatagtaaaccaccttaatagtatatctacattggtatctataaatctctcatgcattgtctgttttttctcaaagactttctttagttaagtagaaagcttggtttctttcttcctttaatcctttccaagtagaaaattatgctgacatggatttcttgtaagaggttattgatacccattgtggttgtccttaccggcttattttgggttaaagtgtgcgtggtttaccttattctggcgggtgtgccaccagaggcaagggttagctgcttgttttggttttaatgatgatggtgttgctgcttcttttttgttcctcctttctttaaggcctagtgcaaatgtgcttccctgttttgggtttacgctgatccggcatactcggtacttctattcgtctgcctaagtaatgcagcaatctgaagtctgtattccctgcatttcaaaatgtttgacaccgttgatttttttagtacgtatttgaccattcgtcttattcaaaaaaattaattatttatttattcttttcatatcatttgattcattgttaaatatactttcatgtacacatatagttttacatatttcacaaatttttttgaataagacgaacggtcaaacatgtgttaaaaaatcaacagtgtcaaacattttgtaacggagggagtagttttaagtagtgttgcatacactactatcaaacttttagtaaaatgcttactcctttcgaaatatgggaatattgtgtcttgaaaaagtatttttaaaatcttttaatcacagtatattttatgaatttattccgatacaaaattatgtttagattcacacactgaagatgtgaaaagaaaaatcaaaccgcgcatgttctttttaaccggagacaatattaatatgtgatacttgtaaaactacactttttcatggcctgatcaaatgcgaaaaatttaaccaagaaccttttacacatttgttgtgtccacagtacattcgaatctgtacgtgtgaacaaagctagtataatatttcaacgcaacaagaataacgtgcaataaaattaattaagatataatcagtacatgacaggcgttgggagttgacaaaccgaccgaaatcgaagtctcaaataatgtctcaggacgatgcccagtttgtacggccgtgtttctcttcatctttttacatgttctttaattatagtcggcagttgccacatcgagtcagctaagcaacgataataagcacgcacgtagataataagtccaccaaataagcgcgttatacctggcgactaattaaccccctgtaatataatcgtaatactacaattggtcgcggtcgtacgtgatcggtcaaggcagatccacgcgtacgtacgtggcagtactagcacgactccaattggaccaagtggcacatgttctttaaccaatttaggacatcctcaatgtatagtgtccaaatacttcgtaagatgtaccctttaaaaataggtaatagttgttgaatttatcataaaaatatatatattgctaaaagtaaatagtaaagtggagccatatattacaatagaaaaatgagatagatataggaggaaagatgaatggctgatggagtaatagggaatgaatggaagagagaaattttaatactatttgttaagttcttatgacctggtaataggtctattgctaccagattgtaggagcttcttactacccgatttcttcttacattatactccctctgtcccgggattttcagtttttgcttgcaacgtttaaccactcgtcttattcaattttttttgcaaatataaaaaatgaagagttatgcttaaagtattgtagataataaaataagtcataaataaaataaataataattttaaaattttttgaataagacgagtggtcaaacgttgcaagcaaaaatttaaaatcccttatattatgggatggagggagtattgtggttgcctttaacatagcaatgtgatcaatgcatacttcgctgaaaccgagcatgcacaaacgacacacgcgacaaaagggcttagccacgtgtcgtcaacagggtgattgaatccccatgaacttgctttactgccttcgttataaatataaggccattcccaatccaatgactaggatgatgtctaaactgccacctaggataaaaaatgatgtgacaagtgaataaatgaggaaagagaaggaaaccatgtcttgcatgagacatgatttctacacaatatccaagacatcatgtgagataagtaacattaaatttaagtatggaatagtatgtttgcattggaagagtagtgtataatactagtttcttgataatgtggagtttatagtaattatatctagtgttttaggttgggaatggcctaagggacttttacataaaaatcgtttatatattttagaatgagtataggctgtcgcatatgttcctcaacaaagtaatctaatgatttcaataaccgttattcatttgtccgaatttaccataatggttttatttaggtgtgttggtgtgccattagattgttctttctttttaacaaaaaaactgctaggtttttctagaaaaaaaacgcttcaaattaaataacaattatttgtcagtagaaaccatgcaaatgaatccaattgaaattatgggtgggatcgagccaacgtacgtggagagttttttttttcgtttttagaaacgtattgtggagaatttggatgaaccaatatatcttgcatactgcaaaatcaaagggctgctttcaggctttcagccaaccaaagtatcccggtcgaattaattactgatatcgctgacaggatggcgatatatatagataaaggacacggctagatagagcgcgtgttaacgaaatatcgctaaccagcaacaacacctagcttcctttcaatccgtgcatcaagatggatatttatcgccgtgcctgtgcgtgcatgcgtatgtagcataccactcccttcgttccataatataagggatttttgactttttcttgcattggttaatcgctcgttttatttaaatattttgtgcaaatataaaaaacgaaaagatgtgcttaaagtactttggataataaagtactttggataataaaagtagtcattaataaaataaataataatttaaaattttttaaataagacgaataatcaaacagcacaaagcaaaacttaaaaacccttgagggatttcattgacccgtccccgcatatatattgataccgtttcttgtcccgtccggcccaatagtgtttggggggcaagcttaaaaagtgtcggggtacccgccgccccatacctgggtttggcgggtttaataaaaccaatttgaagttgtttttcctcctaaaaaacaaacccgcgtgggtgggtatatccagacaataaatgggacaaggtgttacccgattatgggccagggtggcccgctttatagaagattttaaaataaattggatattttggcagagggagactggtttggctttcctaaacagcccagataggccccttaagaaaacttcatggggcaaatatttcatatccccagaggccctccc

SEQ ID NO: 62151 - DNA, 2123 bp, Oryza sativa
cttcactattttttttgatttttttcttttttttttaaatttttgaatttggacgaattttattaaaccgtaccgtgcggtacgggtaaccgtacccccgcggtacgggcggtaaccgcggtaaccgcgcggttaccggcggtttttcacaccctggtcggcactcggcagacggatgcgaatcgaatcagagacgaaggggaagaaagaagaaggatagaggttggtaggtcagtagtataggggaggaagaaaaggagacgggattactcggtaggcgtctactctttgaggcccacgcaccgccgagaggacgcaaacgtaaaaggcccatagattggctcagccagggcgggaataagtctaatttgtctccctcaactgcaaaaccgggtataactcgtctcctaactcccaaaacagttgcaaatcaactcccgtagcggttttggaggtggtttcgtccgacgtggtaactgattcgctgactcatcaggtgggacccgcttgtcagcggcctccaccttatcatcttctccctcacttctccaccgaattaaaggcggctgtgtttagatcacgtcaaaattgcaagtttggttgaaattgaaacgatgtgatggaaaagttagaagtttgtgtgtgtagaaaagttttgatatgatggaaaagttagaagtttgaagaaaaactttggatctaaacacagtcgaaaacttctttttgtcgatattgacaagcacaaatccgtgcacaaattcatggctttggctggattcagtgtaatgcaggcatgtaagcctgttccatccaccaacaaaccggtcgcgatcgccggctactgatcagtagctgaagcgaagcaatcgacgcagctatagctgagctagctacctgtcaagctggccgcaatagcagcaagtacggcctcatgtttactaataaataaggtagactttatatctatagtaataattctaagaaaatttgaacttcaaagagacaacaattctaagacagagggagtagaaaacagaacatgttttaacatcattagataacattgtttctcgcagggcgacaagaacgaacactgaattatttacatttaataacagcattcgcatccagagcatgagttttccaaaataacactactgcatacatttaataacaccattcgcatcagtattccaaaataacactactgcatactactcattggtagtaggcgggctgactgtgcctggagtggtaggcgggctgactctggctggcgtggctggctttgttgtagacagttcctttggtggtaactgaatcaacacaagaacaaaatgggaatgaatgaaaacagaaaacacagcaaaaaaaaaaaaacataaggacttcatcctcatcagagtaaacaggaggcgtccgcgcggatggggctgcactacgagcagtacgacgcggaggggcacgagagctcgctgagccgcaagtacggcctccgcgacgtggtggtgtccgacccggaggccgccaagcgcgacaaggggtggggcttcgtcgcccgcgtctacctcggcggccagaacgtcaccctcgacctctccaggttccgacacacgctcaccaggctgcacgcgcgcgccctgcgcgtacgctcgttgcacccagcgccgtagacggattatcggatagcagcggcagaagcagccatggatgaatccatcggtttctcgagcggatagacgtacgtgacaagtgctccattgcaactagctgtttaggcctactaccactacacaaacgagatggactaccttcagccagaacatgtaagtactaaacccttttatcgtagatgaaaatggtaacttactctataatacaaaatttaactaactgtttattgtgttggtgcaggtggtgtggaggccatatgaggcacaagaagtagtcgagctagacatgaaccctatgtgccacatagaggatacgttgcaaaccttgcggagcccactgatttgcttttatgcagtggagttccagctatgcaaccgcataatgcggcagttcgggaggcttcaaacaataccgcaccgtttcttcactagtatcgacctccacaagta

SEQ ID NO: 62152 - DNA, 672 bp, Oryza sativa
aacacaaatacatggtcagcaacaccgactaagaataataattatgcacgctcacttaatttgttgtactcggcatccaccaacacaactcagcatgtgtttatattgattcaggccacgtatcatttgacgagcctgaattcatacacatccacttgcgctggccggaattgaggcccatccaaacaaggtctagaagtgcatcattatctaaaaggtctaaaagtgcatggactcacagtaatgaatctcgatagttctccattcaatcatgccagattttcaaccaatacactaagttttgcttcatgcaggaggacaaaaaattacttgagagtttcgagatagcatctaacataattctaagaaccaaaaactcctaacaggagccatctaaggatcggacctgcagaacagcaccatatgtcctgagaatgtcagcgcgggcaccggcatcgccatcattgagatcaagcagtgttcctaaacaaggaggaaatgacacggaaaatcaaagtcaggggggagtagataacagattttgtttgaaaaaacatatcgttgcccatcagccaaagttgataaacaaacagcgacatagcagaggattttgattctgttccttttggagccggctagcccaactactccagaaattacacgattcaaaag

SEQ ID NO: 62153 - DNA, 8469 bp, Oryza sativa
agcttaacccgtgcatgcatgataaaatgtatctgatgaagatcgatgtgtataattataattaagcatattcatgatatcttgaaattaaatcagagggaaattattagaagtagcttttcatgaattaatgcaagaggttaatcaaccgagctagcttctatatatgatatatgaaagtgtgcataattatttgggcttatagacatgattgaggcagacaagcttgagtgcatgaaaagctaaacatgcaggatataggtatgcagcgatctgcatatgtagaagtttgccatttagcagagttcatgtaaatgtactgaaagataagcgtacgtggtacatttagcttctcaaaaggaagctacatataataatccatacaagtcgttatactaattggagatttggagaactccagagtaataatatgtctggtaatggcttccatcaatttttcatctgatttcttgggcctgcttgaccttaattatgcatatatataatgcattgctgccttaattatgggtgaaagggtggatggtgatacataacgagtgagatggaagaaaaccagaaatgaaggaccagatcgaatagagaatggatcgaaagggaccctgacctagttagtgtacaagaaaaaaagaaatgaagatgtataggtgaaaatgaaatatgtgactacgtactacaaattaatacacaattaattgaactctttcagtagcccccacaagcttctgtggagacatcttgaactaaagctgcatatgaaaaatcagcagcgactctaccacatattatttcccctgcactctcttccttaagaggtacaaggcacaacaaaacttttcctagaagctaagttaacatgaacacactgattaactgaagatgctaacctgtgacctatacatgcaggatggttaatttactcgtgtactagactgacgacacattggatgagagaatttcttgtaaaaaattaatgcaacgttcaccttaaaggagaattaagaagaccttaattgctagaccagactacacaatgcaaaattggacttaccacagtcctttgttagcatgccaaatacaccactcaacccataagtgggtacatttggcgtgaccgcgtgagtgtaattagtaaatatgtgagctgagtaagtatactcatgagagctaggacagatgatatgcatatgagatatgactgacacatgtgtgtggaggaagaagatactgtatttagatggatgcagacttaaggcagccgtggttttctaggccaatggtttctctggagctgcagcgacatgagaagaaatgagcctgtactgatactgtggtgatggtgccggcagagttggagctgtcagagacattgtcatgcctgcagaaaataaggatcgcattatttacttagtactgtattatcatatcaagtgcaattagttaatcgactccattgtagtactaccaacaataaatgcaggcccctctcaataaaaacaataaacaataaatgcaggccaattattcagttgatgttccagatcaggattaatgtattccaacagaaggattaattaggtcaccaagaatggttatctataagctctctacaagagatccatgttagcatatttttctacttggaagatattaaatgaagagagagagcaaagctatctactagcttagaaatagtctatagagaaaaacgagacaatgcatgagagagctatagatacctatgtagacatactattgaggtggtttattattaatctagtctattgttgagatgtacatgttttatagagagcaccttactttaccattgcgggtgctcttagtactccactcctaattaacaataactagggtattactagtactccctccattccaaaatataaggcacaactacccttaatccaaagaccaagaaataattattatcatattgtagtttggatcatcctaataaatataatgcatgcatccaataggattagatagcatgagagtggaggatttaaaaaagtaataatttaatagagaagatatcataattaattgtgtgtttgcatgtatgccttatatcatggaacatgtaagaaaagtggttgtgacttatattatggaatggagggagtattaattagtgcccaattttatttttgggtgagtaggcataacgtcttttttatatgtgataccctcacaagcatgcatgatctcgcgcaaaggattgagtagcgtgtcaatatgcacaagtactcatgcattgtacattgggttgcttgcagattcagacatatatatacagtgcatgtactatacaagaatgaaaatacatcgtgcatgtaggaatgatatatacccccatatggtacggttatgtataaatgtttaacgagaaggatgtttttctttttaaaaagaattaactattaatttcatatttaaataaatttataaaacctaattaacaagatattatgatagatagtataatttttaaggaaaatccaccactaatcatttgagaaattattaatcatcaattttttcataacttgaccaaaccctacactaaatgttaaatatttatagcaggatggagtagctcgcagcctcgaattaatagaaatatgacccccctccgcccctcccccccctaataaaaaaaagctatctcactgaagatatatactccatccgtctctaagatataagtacttttggactttgacatggtcgccaagatgttattttgaccaataatatatataaaaataagatattttaaataaaaagagttgcatattatgatagttttttaataataaatctagcaacatcaattttacatgattgatctttttttattttttactattaatattaatagccaaagttaaaagtatttgacctgtcattatgctataaaaatgtttatattttgggttggaggaagtaaaataaattaaaacatctctgacaaacctgctgcttggccggtagagttaggagcaagagccacagtgccagcgtactgctggagcccggccacggcggtcagctggctggccgtcgtcgccgccgtcggggctccgacagccgccgccgccgccgcgtactggtacatctgagggtactgcatgccggcgtacccggcagcagccgcgttcgccgccaccgctgggccgtactggaagtacggcgagtagagaccgccgccggtaggattcgccattgttagccccgccgccccggcggcggcgccaccagcgaacatctggtactgggctccaagcccaccgtacgcttgatagtagctctgtatagtacgtaaaaatgttgacatgatcatgggtgattaattagtttaccactaattttgagatgcaacattatagtttatgaactagtaatagtcagactttagtaaaatctataggagagggatcgatcgatgaatctctagtagatatatactttatcagcttgcatatatacacaatatatgtatatatgtaaactataacgcaaattgattaaacaaaaaattacatggatgatgattttttttttctgaatggaattgaagtatatatacgtaccagcggatagccgtaatccgagaaataaggtgagtacctgaaatcaattttgcaagtagccaaaggagagtgtcattaatttgctttttgaaatgtacatagaaatgacgtgatgaggtacatatgcatataataaagcaacctaaatacatacatttcgtgaatgaataacctaaatatttcgtgaatgaatacatctggatatctctcctatatatgggactcctaattgcacatggaattacctaaacaaacttggttgataatgctgattattgattataaatttcctaattcctagctgtaaacttgggaactctacattaagtaactgtatgaagcacattaattggtgttcagcctaattgcctaaagtagactaactaatatatgtgcaggcatggttaatttcagtttggagtacagatatatcttaacgtctagtactaatctccggccttaatgtggccaagtgaggtttcatatgaagaaattcatttgcatgaaaattaatcatcttaaatactagtcactaaattaagaacaccaagatctatatcaattagcagagctgcagaatggaaactttgagatctctctagtttcttgctacttttttttcccctcagtgcatgcaggcatgcgcatattgcaggaagaactgagcaagcaagaggggcgcatgcaatgcaaagctttttgtaaagtggcgcgcatgcaactgcatgacactatatataccgaccggtaccccacatgccagacgctgtacccgaggcattatgctatacagtatagtatatacgtacatatacgggctagctatacagtatagtatatactagtagcacgtcaaatgatcgatgaggacacatgcagcatgatcatgaggtgctcgatcgatcgatcacgcctagcttagcttatactactcctttcaaactattttaagtgcagttattgatttatatatgtatccaatgttttaccgtttgctttattaaaaaaatgtaaaaaaattaaaaagtaagtcacgcataaatactatttatgttttatcatctaataataacaaaaatattaatcataaaaaaatttaaataagacgaacggtcgaacgctggacatagaaacctacaactacacttaaaatgcgacggagggagggggtaacagctactacagcaagttgcacacatacactactagctagctgcttctctttcactactcactatttgcacacacatacacatgcatgagagagatgagagagatagtagcattgtctttgtgtgggcacatgcacatggagatggagatggagatggagaaggagaaggaggagctggagatgcacatgcagatggtgatggacggtgcagtcgttggccccctccctccattaaacgagctgaagctgagaccagctagctccaacgcctttaaccccccaaaaccatcctctttacagctagccggccatcttctctactacatatcatatcccagcatgcatgcaatgcaatgcagcagattgagaagcaaacacaagctctatatatcgatctctagctagctagctagctggctggccggtggttagtgtgtgtactattcctacctgcaactgtatatagaaggagagagggtgtgtttagtgcgctaaaattgaaagtttgattgaaattgaaacgatgtgacggaaaagttagaagtttatgtgtgtaggaaagttttgatatgatggaaaagttagaagtttgaagaaaaagttaggaactaaaccagaccagagatcgatatgagtagtttacccatacacattgtaggtcgggatcccctgctggatgccatgatctgccatgctcaagctggcaccaccaccgcctgtctggataatggacttcattgccctcatatgcccagctgctccagttcaattcatgcatattcacaaacaatttatcaactaataaagtacagtattcaattactatgcatggtaataaagtacagtattcaattactatgcatggtttgtaattaagcatgattagtaattggctgctggataattaattaattaattaattacagtcagtatatatatatgaacaggagtattggacaatccaaggacggcagataactgcatgcctgacaacatgctactatacacactgcaaactgcacaagaagcaagcaaggcagcctagaaggctggaattaacgactcccgagaataactaaccgtgctcgcttttagcacttttgcagaaaagctttagctagctcagctggagaccacgcagccttttcattaccggtgaaatactgtcggatgctcggatagcatactttatctagctcgatcgcttgttgttttgatcttaattcatataagcattatccaactaactatactatccagcttgatgacagtgaccggccttaatttggcgcgaagcaataccatatagttagacataagtacttaatgtgtacaggtattactaattagtttacatcacaattaataacttactagcttgattcaagaattagcatatccaaaaagtgactatacaggatttaagcttttgttagtaggaatttgttctcaactaactgatcaatcaaaagggacgcattttttgagccaataatataaattaatttgattctgaagaatgcaatttttgctcaagggaaaatgaagagtatatactaagtttagcagtacgtgcagtatgctcccaaagtatgagcataaaatgatgcacaatacatgttgtagaatctagctaaaagatgcaaattaagccaggaaacgcacatatatgctcctcagttattctacatgatcatcatcaaccttaaacttgtctccacgtagtgtcagttaattatatgatcatcagaaattaagaatctggattaaaaaaaccatgaagaaaagttaaggtgcgtgttttatgtgatagtgatttcgattaccataaggttgcagagacgctgcagctgccttggatctctggaccccaagatatgcaagattgcagttggccctcctcccatcgatcaccgggtacggatcaaagcaagctttcatagcagcctccggctcgcggaatgtaacctagcaaagcagaaataataaagattcagtagagatcgaaagataaccaatccaagatcacaataaaaccatgtagctagctagatatagatatatagatatcttaaaaaatcgatcgatcagttaggttcttcggtgattaattatgtgcaagaaagctgcatatttatcctggttaattaattattcttttggttgaagaattaacttgggaggtgcaactagctagctagaacagctagttggatcgatgctgaaattaaaatccaaattgattgaaatccaagcaaacagaagtagaattgaataggaagatgatgattgattggggaattaagcaggaagagagaaataggaactcacaaatccgtagcccttggatctgccggtgttcttgtcggtgatgacgacggcctcgaggatatcgccgaactgctcgaagtatccccgcatcccctccttctgcgtctcccacgcgagtccccccacgaacaccttcgtcagcgtcgtgtcgccgaactgccccgccgcgccgccgccgccgccagccgacacagccatctacaacctctacctcttcttcttcctcgatcgatcgctcgctccgatctgtacttctacagtaacctggtgatcgatctcaaaaggcaagggcgatcgagaggggggctgatggctatatctatcgaggcttgatatgcaagggaggatgaagagaagggtccaacctagctaggtagctagcaccaaccctagatagcctcgatatggatgctggcctttgctagtactacacctattagcttgagttgtagagagagagaagaagaagaagcaaaagaggaaggagaggagaggccgaaaggaggaggaggaaagaaaagcgaaagctggcaaagggaaaagaaatcaacgagagagaggaagaggaagaggaagaggagaggaggcgggaggaaaaggcgggtacgggggtactctccttactcatccatcgagtaggtataaagaaacatactccctatcccaaaacctattagcttattttggaatggagaaagtatcttctaacttattgtcctcttctgattttaagtaattgacatctaagagatgatctagaataagattagagcgtggactcatctccttcctccttcagccccctactcttcctcctcccctcttcttcttagggttgcaagcgggccaacccgcgaacccgcttataggcaaaattagtaggtaacctacggatcacctactgatttgacttataaatgggtttatggatcggcccacttgtatctctaagtgcagcaagccgaatcacgatatgaaaacctacgggttatcacttatttgacatataagtaagttcgcgtgttggcccgctttcatccctacttcttctccctacattctatcaattatgatccagcggagtagaggggactcaagtcccccagcacccacgctgcactgacacatgggtcttatagctcgtgggccgacatgttagcaacctacgacagatgatagtatatcaaaggagcttctttaataggtatatatatctctctatcccgatggcttgtgtttcatttacttaggcaatgtgcatcaacatatgaatattaaattttgaactcgtttattgtggattattaacctacctctacattattccct

SEQ ID NO: 62154 - DNA, 1596 bp, Oryza sativa
ctgttgcagtacacgacggcgacgccgaggaggaagtcggcgcacggcgccccggcgcggtggttggtgcagaagaagcccaaggcgaaggaggggccgaggcgcgccgggttgaggcgcagcagcgcggcgcgcgccacggagccgtcggtgtaggcgacgtggtggcgcagcgcggcgtcggtgttcgcccacgtcgtggacggcttcgccgtcgggtagtcgtacggctgcgcctgcgcgcggaggaggcagagcgcgaagcccacgccgagcagcgccgcgtgccgcatcgttggtagaaatgcaaggagtttgatggtggtggtgtgtggtgcgagttgtcgtggtggaggcgagtcggaacgtttttttatagctttggattgcgtgcaccgtggttggatgggcgttttccttgcatgggcatgcatggtgcacaccgcgcgcgccgctggttgaagactagtagaacaatctgataccaacgcggtgtcggtgtcaatgcctatctgggaatcaatccaccggagcaaacgcgtagcggtgcattgcgggccagctgcatgcatgtctcgtcccctctgtgtttgactctgctggcttaattcgtttcgcagtgctcaacagcgagcaggttatagcaattgtggcttgcgaccacaacgtttggtaacgttctcccaaagccactcgtttattttaacaccaaatgatatccagggatgcctcaggactataagctagctataaatatattttaataacataaaagagaaatgagaaaaacagtgggttacaaatttataaccaactataacacagatttcaaggcgcgatgtgtatatgacaaataggaccagaaattaatagtgtagtatatgttcataggtaactattgtatgatttaactagtattaaattgactataaatgatttggagttagtagttgactatactattagggtattctcaacccaatgactaggatggtgtccataacattaaataagttgtcacttaggacaaaaaatgatgtggcaagtgaataaatgaggaaagagaaagaaaccatgtcttgcatgagacatggtttctacacaacattcaagacatcatgtgagataagtagcattaaattgaagtatggaatagtggtgtttgtattgaaagagtagtgtctagtactagtttcttgatgatataaaatttatagaaaccatgtctagtgttctgggttgtgactgtccttaaacttgctctcaggccctagattcgtttgtcattgttaacaatttttcgaggagcttagctctggcaaccactggcgattgggtgtcggctaacaatggtgatcgagcacgccacggcgcgtcgcatccgcacgccaagaacgaaacgaaaaatccattaccgcgccgctgcgcacacgggaaagcagcagccaccgcggcagcaaatgcccagcccggaagtagcagtcagcgtctcgccccggcaaggagagatcgtgggcctcatgggccgcagcgtgaaggatagtcgttcttagacaaatgggctacgcaaggagaaatcgtgggcctcatgggtgg

SEQ ID NO: 62155 - DNA, 35641 bp, Oryza sativa
tgccaaagtagatttctcctatgctcctcagtattgcaatactgctcatgaactagctcaaaatggagccacccagatcagtctgttgtttggactgatcccctcccggagtctgtaaatcgcctggtggcttgtgattacactgagccaatcgagtaataaagaggcatgtttgacaataagaaaacaactttgactctagatggggcacaagtgttggaggacatttttttcattttttttttcattctaatgtgtcatagtccaaatcagtgatactatccttaaaagtttaataagtcaggcatttctttttgaaactgataggtcaggtgtttcttttgcacagatgagggagcaacaaagaaactgatgtcttacatcagcatgatgctccaataagatcttcatcgtgctatgttggccactaatcgcagctgccagcaatggggtcccagcgatagaatataaatccacatcaactccttttgaaagaaacaactctactatttcgcagtgtcctgcaaaagaataatttatacattactaacaagaacaaactagaaaacaatgtttatcataggtatagaggtcttcattggtagatatatgttgaaaatggacttggaacaaggttcagctcaatcaggaacagcctagaaacaattattaatagtgattcggaacagttatgttttcaaaaggagtctgttggataacagtaaaaattggattttaagttttcataattttattatctaaaaagcttagcttgaacaaaattcaacatattaacagcaaatatgcttataatcaggacaacaataacgaagtataggaactaaagttgttgtccagaaacatgtagttgtttctttttcatccaaatcatcaatcaaatgagaatcagagccatgcaaacacccaagagagaagcatcattcaagactgtgtcattgtcagaattctatattcgtcaacaattttaagtactccctccatcccaaaataagttaacctagtacgggatgtgtgcctgtccagattcatagtactaggatatgtcatatcccgtactaaattaacttattttgggacggagagagtaacaaactacaaaacaaacttactagtgacaaaatactgatgcaaggacttagtctctacgtgcaatttgccatttagttgaatagttgtgagaacttgttgcaatttttttcacgaaataacaaaaatccagagtcatgactataatatagtgatcagtattttatcacaaggagtgcctctcctgaaacaaccttgcacatgaggggaaaacattctctggtttcatctagctactggccaatagtctgtgcttatccattttaagttttgagttcaaacaatagttcaaattttgatagaaatgttagaagaaaataatggtgaatccaagtgaagaaagaattcacttgcatatgtatcaaatatattgttcaaaatatatgttggactctgtgtgcgcggtgtgtgagaaagagatagatagacctttcgttgcagcagcatgaaaaggtaacactgatttatcaatcgtaggatcagaaccgtgatcgagaagatatcttgtagcagcagctctcccatgaattgaagaaaggcacagtggtgtttcacctgccaagaaaaatatggcataaggaccatagggaacccgtatggtcatatggatcgagccttcaacaatacaaactacaaaggtgcataatgtaaaatggtattgtctaaacaaaaaaaaaaatctattttaccacttagacgtatgggagctcatctacttacaggctgtttagtttgactaaccaacacatctaggacgggttatcgatcacatgatcatcccacaaaatttgaaaatgactccattaattcttcatccaatagcttgggacattatgcagtgcaaacctggaaactactgtaggataaaaaagggacgtctgagatttgtccacgtcatcctcagagtgtgatagacaaatctcagatgtccatattttgatcctacgttagtttccaggtttgcactacatattttccccaatagcttagcatgtactttttagattgaggtggtgatggcccattccattcctcaaatcaaataatgtcatcaaggatcaagtggtgaattcatcatcatcccacttctcaaacctaggtcattaaccccttacgcctttaagtataaaatttggtaccgtatccctagtaggtattgaaagccatctaaaaaaacccctgagatgccaatataccaaatgacgtggagtcgcggacaacaatgtcgcgatggtctgcatcctaaaaatattttatgtggtgaatccactcatgcgagggtcaagtttatcttttgcttccaaagttaaatttatgtaccggcatgaaacattgttttaagaagtggggcattttattactgattttatattcatctgctaagtctcactactcactagtcatgttgtttaccgtggcaaaaccacctcagggattattttgacatcctatgccatcttcctatatagttggtacccactaaggggcatttactcctataaagcaagatatgccaaaagccacatcatcagcaattttaagccatcaaattgcattagtacaaagataatagccattggataaagaagctacttattatccatctaactcaatcatttattagtcgtccattcacctccctttgctccacctcaaaggcacacataacattgttacctacttttgcacataacaccatgttttttcctcccaagtcctgaaagataatgctaacttatttttttcgaatacaactcaaattattgtttaagatgtgagttttgttttattatgcatgcattagatagcatacaattattaggcatcattcccgaacccattttcatatgctttgagagaagtagagatgtgcaaacaatctaattgcaatgatacctagattgtgcatgaaaataatattcatatatcgtaaaaatacacaatgacgctttgaaaaataaagcatgaattgtatcataataccagaggatatatataaagccacattatcatatattctgtatatatgtagagttgcacccagccatttaaaattttgattttgtttgacgataaaactaacaaaacatgtggcacggcgcggggtaccgactagtttataagcatttcaggacgcatgataccggtttttcttctgcatgaggttaagtaggcttctccttttcaaaaaaaaaaagaaagaaagatggggtgcacctggcctcagtagttctaatgttagtaccagtgactccacatgattaatgattaccgtaaaaagtatggcatgcaaggaaataagaatgcacaattactgctcagaatacttccagttccaaggaacacattccaattccattgaagaggttgttgtatgccattaggaattggaattgacaattcaagtccaattatgagacaaggtactgtgtataaatatgaaaccagttatctgctgctacacaatcacggacgctgtaactcagttgaattccaacccacgtcaactctctcgcctctcacgcatctctgcaatggtaccactacttctccaactactgtatgtgcaagacctggcctccccagtcaccctaacaactcctctggtccacaaagtggcagcctccagcacacatgatgacaaggctctccgcattgcttaattaggtgatatatttggtctctctttctttgtgatgattgtggatttgtgggattgagtgggggtgaggggtcaagcaatttgtttcggttttggttaatctgttaattgttgtgacattttttctttcgcaagacatatatatagtttagtagggaccagggcttccaatatagatttcagccatttcggttctaccaaaattcctgaaattttggtattattggcacttttcggacttgaaattttaactgaatttgactaagttttgaccaaattcacagaaatttgagaaaaacccaaaaattcggccgagatagtaactccccccccccccccgtttcaaaattgcaataactgttagggaccgtcctatcgaatctttctgagtaataaaaaaatgatgttaccaaatttgatacttgggttcacgatagttttggagtgtgatttcaatgcaaactgtgggttttcaatgcactcagaaaaggagatatgcaatgcttgcacaatgactaaaattaggttatgttgactgagcttaaaccataactaattataccattttttgaacaaactagtagaataaatcaaactgaaaaaatagaacggaagagaggcaatgcaagacctttggcattgaactggttgacgctgaggtggaggtcctccacgaggtacctgaggacatccatgcttcctcgggcggccgccaggtggagagcgcggttcccgtcggccctgcccgccaccgccgccacgacggcagcctcgccctgcccggtgtccagccctcgcgccatctctatatcaacggaaagaacggtgagtttcgatcggaaaagcataataagcaattaaaccctaagagagaaagggctaggaaatatacgatacaatactcactcctgaggaggcggaggttgtcatcgtaggcggcctggaggagcatcttctcctgctcctgcttccccatcgatcaggctcgggggtgaagaaggcgagagagcgggagcggcagcctaggccctagctagcacttgactggaggagacgagacgaagacgatgcggcgccggcgtgggtttggtagagactgcggagtttggtttttggaagggagcggtagtgggatttggatgatgcgcgcgagtcacgctctgggcccccaacccaaccaggttaacaccattttcttttcctattctatcggtcatctgaattcgcacaagggagtacctatacatctttcgaaagatttttatgatcgtatcacacagatttttaatctttagattaaaatctgatagatataataaaaagcaaaaagcaattaagaaacaccataatggacactaaattaccatatcctcaagaaaaagaccaaatccaatacaaaatttaaaatttatatgcgaagatttaaaaattacagtataacttacaaagttacagtgtaagtttcataaattacactgtaacttacaagaaaatgcactgtaaatttgagtgagaaaatcgagtgagagataagaaaaaatctttcgtgtgagatatagcaaaatcgttcgcacaataatcataatttaaagagtagtaaaggtgaactgaattcgcacaataatataaagagtcggttcttaaatttaagcggaggtgttatataggtccgtaaacttgaaattttcacgttaaaattcataatcttgttttaatgaaccatagctagtccaaatgacgtttgactagagctgaacggctatgtggtactccatgtaggcaatagtttttacttatcccttgttgctacagtagtcatcgaaatccatcaaaatatcccaaacccctgcgtccctttgcatcccccagacgctttcgagggagaggcctgagtagggcgaggacgatgccgacgatcatcggtggtgcgaattgattgaggtgtcaatttggatgcgcgactagcagcgcttgataggcgatgcataatgcgccttcctcgccttcagtggagaagatgaatcggcgccccaaccgccattacctcgccgcctccggataccgccgttgtcatcgcaaccctagctgttgtttggaatgcaaagggatgaagggattttttttttggggggggggaggggaggggcgggggatttcagcgactactgtagcaacatggggttaagtataaaattaccaccatatatgtcaagatgtgaagggggcggatgcaaaatgctgcctaagtagagcaccatgttagcggtcagctccggtcaaatgcgcttggaccggctatattttattaaaataagatcatggaccttaatatataattttattaatttttaagtttattgacctaagtggcatcttcgctcaagttgaaggaccgtcaatgtatcttaatctaatctaaaacagttttcggaaacaccaaatcttaatctttctttgattttatctaatgaaattacctggatgttttttaattaagatctagattatttttttaatatttacgagtgccacgttactcacgcaatttctcacaattctaaggggcaagctttaaaacgcgtgatttgaaaaatgtagaaatagaaatagtaaacaacagatgtgtgaaaacacatatatagaaagagaagccctttaattacactgcataataaaataaataagcagagaaattttgcaagaggtataataaatattagtagagaaaatattcccaagaggtatacctcgtacttatttttcaaaaatataaccgcatgcttaattttctactaataatcgtgtacgtgcatatgaattaaatcaaacatacttcaccgcataggcagacaaagtgaaagctttttcagtttatcaaattgtacaaaatcacatccaacggtactatgttaaaataatccaacaaacaactagaaaaagccatttcacaatatcacaataatagaagagccatttcacaaatttaaaatggtgccaaaaggttatttttttctaatatgggagaaaataatctctaccattataaaaatataataagtatggtttccggtttttttccatccgtcatttagctttccgattttgtggaagatttctcatctgattgatcatagcgcataaaaaaaaagaagaagacaccccgtcattttttttaacgactcgcacaagacggtgtgaagttctattaatagaccagaaaaaaattacaagattacaaccctggaaagtcgtaactaggaaaaggaaaaaagtataccaccacccacacaccggcagcgccaacacacaggtccaagagaaggatagcaccggaccggccgttgctaagcgtgatcgatcgctgctaggctgacaacgaaacatggccgagatcgcccaaaacccaacccttacagtcaacacaaacccactctatccaagacttcaggagttagggagagagggtgagagagaagaatagaacacatctccccctaggccctccgacgtggccaacttgtagtgtctagcacaccgcaacaagaggatgaaatctagagcgagcttgcatcaattggttggggggtttcggctaagggatgtctaaacaacgtcttcaagaagagaagcgacggaaaataccaccgccgccgtccgtcaaggtttcaaagagaaccgagactgggctttcgcctgacatccacacttgagggatgagacggcatgacaacgcccttaggaggggaatgacgcttcgaacgtcatcgttgccgaccagggcgagaccaggctgggttttcacccgccactcaccacctgcgagtccacggctggcacgatgccccaccactgtcaaacttctgccggcacgtgggaccactgcaccggcgccctcaccagccagccttcttgcgccgtagaccaaaccgaacccaccggaagctcctcctcgtcgcaccgtgctcgcctcctccaccgccggcaacgcctcgtcgcgccttgcccgcctcctccgccaccaaccgcgccaagccggcctccagccaccggctgcacctcctcacgccaagccgacctccactgccgccggccgcgccacctcgcgtcgtaacgctccgctgctacctgtcacgcctcaaagcatcgtgccaacctctgacccctcctctagccgccgccatgccggccaagtgcggtcgtctgtcacgcctcctcggctaagcgcccgtcgtctgtcatcgcccgtttccagccgacgacatcgcgtccgcacccacacctagtcttctccttctccgctgcccgactccttgatgtgagcaatggttgtatccgtagtagccatggtcacatcatctccgtggcccgatctttcggtgagttgtagataactacactttgggagaaacgttgacgacccgactacaaccgtacaagacgttgttgtattgcgtcttagcgatcgatacacctctccgtgggttgttgatcttgccggtgcagatcaaccttattcctgtaagcaaatagaagaaacaagcaagaacaagataaaagcaatctgaattgcagataggaattcaatacaaatgataaattggggttccgtaacgagcaaaccgtcgatctaaccgatcacgggattacacggcaaagtagcgaagctaaactttaatctaaacaaaacccgagaaaccctgaagtggtacctagctatttatggatgtgggaggacgacctagggtgcctagggtcgtgctccacctggttggggcgcccccaacatgggtcccacatgggccggggttccaaacaaagttacaagcccaaaggcccatgacaggtgttacagcaccttgtttctttatttgcagatggctagggtggaatttggtgatgtggctagatccgttggaaagaggactccgagagctttccatcaagtactcacgggtcaaaaacggaggtcgtatgcagattcggtggctgtttgaagtcagcagtgtagcaggtggccgaattggatcctagcacttggaggacttgaacttgatatcttgttgttcatccatgatgtgaacaatggttgtatccgtagtagccatggtcacatcactccttccccgcctccacttgctgccgccggcaaccatctgcacgatgtcgccagccgctgccgcatccgccgacgtcgccagccgccagacgccgcctccaccgccaccttcattgccgcagccgacgtccgtcgctgccgccgtctcggtgtctccagccgtcgtcgccagccaccgccgccgcaatcacattcgctgcctcttcgccatccaccacctcagcagtcagcatccaccacaacaccgccaccatagccaccgccgccgtcgccagccgccatcgccaaccgctgccacatccgcgaccgccagccgctagccgccatccaggtccgaccgagttggcgcggatctgggggactccgccaccgtcgccgccaaaccccacgctgccacgtccgccaccaggcgtcgccgccgtcaccttcactccccgccgccagtgacccctccgccagatccggctgggcccggcctggatctggccaccaattctgccgctccgagcaacgcccctggccgctgagcgcgtggagggtgagacaaggccccgtcgccgctgtccttgcggccgcacggctttgccggcacccgctcatgcggcggcgaggcaggggaggaggaggaagttggcggtgtcgcctcccgagtcacctggggagggcgatgcgggaggaggagggaaacgtccttgtagtgttggccttggctaatgatttacgtaccccgtcatatattgtactacaccagatcggtttggactggttcatcaatgcatgcatgtcggtttcgtcatccagtcatcctttcccttcgcaagtcgttggtttggactattattagaacgaaatactccgaggatggtcggtgccgcatcccgcatggcgtcactgttgtcgtgcgatgaagacattgccgtctgctgtacatgacaacatgccgatacctgctcaggttcagtcttttcgccgagctcgcctcaccaagagctcgcctcactgtacatgacagcatgccgatacctgctcaggttaagtttcgcgcgttgacgtagccatgcactaagtgcttccatccagcgtatttcttgagccccattgccggagtacgtacaagtacaacgcgcgtgtgtacgcaaagcatgcattctataattaacaaagtaaaactcactagtacacaaaacattttcctggacagggacccatttaaattgcagacaaaccataactgatcgcatctgggaaaatcgttctcccattttatgtgcggaatcttaagagttttcgcgtgcgggcatcttaagaccaccgcacggaaaaataccctccctagctcctttttccctcacaacacttcaaaaaaaaaattccatcctcacatccttatcctcacctcacctctacctctctctctctcctctcctctcatcggcagcgcgcgggcgacgactctgctgccgccgccgccgccgaggtggccaagatccgacggcgcagcgcagcgcctctccgccgctcggatccggtcttccgccgcccggatccagcggcgccacccctctttcgccctcccccgcgcgacagcgacgatgacaaggtggccgggattcggcggcgcagcgcctctccaccgctcagatccggcggcggtgcccctctcccgccctccgccgcccggatccggcggcacgcccctcttccaccgtaccccacgcgacggcgacgacggcgacgatgacgaggtggctgggatccggcggcacgacgcctctccaccactcagattcggcggtggcgcccctctcccgccctccgttgcccggatccagtggcgctgtacctcttccgccatccgccacgcgacgacgacgatgaggtggctgggatctagcagcgcggcgcctctccgcctctccccgcagcgcgatggcgatggcgacgacgagacaagctgtggcggcggtgacggctacgtcggcgacagcggcgacgatgacgagctgcggcggcagctagggtttcgattttttttttgtgatttttattttcttttttggatttttattttcgcatgcgggcgacataaccgccccgcacgagaaaatgtgactttcgcgtgcgggtgtgcctcccgcacgtaaaaatcgcgatgttctcatacccctgcgtgcatgcgggccgcccacccgcacacgaaaacccattttcaccatatgggaaaatcctttttctagtagtgactttgatgcgccgatcataatgttgcaccgtaattaatctgatcagcatgtttggataatttaggttgtgacaaactgaaggattaattagttaacataagtgtaattgcacaagtgctaatcagacacgacacatgtatgtgtaaactattttcaaagttagtgtaagatcgccattccgtccagttccataattcttaatgttttgaataagattgaggccaaactttttgaataagattgaggccaaacttttataatctaacatcctagaaattcatgttaataaaaaccactaaaattcgattttcttaaaacttttgcatcatacactactggagaaaccatctttggtcggtcgaccaaattccacaataatcccggttgcaataaaaactaggactaaatatattctttagtcccggctcaaaaggttagagctactttttgatctatagtcccggttggtaacactaaagatcatttttagtcctggttaaaaaacggcaggtggtgtcagacacctctattatctctatgtatagtcctggttgcttaacaatcaggaaaaaagatcggcatgtgtggagaggatgaggcgtgcgcgcgagatcgatcaggaggaggtgcacacgatcagttactaagttctatctcctagcctccctcacatttatctcttccttctctcctctcctcactcaccccatctcttcctcttcctcctccagatccgccccctcccctctcctccccacttctcaggcggccgagcggcggccgggcggcggcgaaggtggcctcgtgcggcagatccgggaggggaggtggcaaggcggtggcggcggcctcgcacggagggccgtgcccggtggaggcaggcgacggccgacacggagaccagtgcagcgacaggcggtggaggccggtgcggctgcacggatttttttttcttttttctttaatgtgtgattcgatctgtgttgaatgattcgatctatgttgattagatctgtgttgaatgtgtgattcgatcactgttgagaatgaactatgttgttgtgaatgattttgagaatgcactatgttgctgtgaatgatttgggatgaactatattgttgtgaacgatttgggatgaactatgttgctgtgaatgatttgggatgaactatgttgctgtgaatgatttgagataatgggcgtgagatatacaaaatagaaaaaaaaactgggactaaagatagcgatcttttgtcccggattcttactccggttggaaaatcgggactataggaggttatcaaccgggagtaaaaagcatttctccaccagtgatacgccggatggatattgtggttgctagtgcttgccaaaccgtaaattgtcacaatgggggaaataaattaaagatgtacaatttacaaggatagattatttatcaatcatacaaccatctatgcaaaagacagaaagccaaataaagaaaaggttaattattaatttttgtaatataagttatagatcaaatattaagtaactgaaccatgtcgatagcttgatctcaggggaatacaaaaattaaatctaatttgcctagatatattttcataaaacccacccacatgaaataatagttgtcggtgatatgggcccgaggttacccacgttagggggaaggagcggaggagcccttcctcctagccacgtgtaagtagccgagagacgccccacgtccacctaggggcctcggggtaccccgtcgcacccctcggtcccgacgggttgcgccacctcgagacccccgctcagctgccactcggcggctaagtgggtggaggagggggcgccgctggcgtatttatgaacggcgtcccaaccacgcacgcgcatcggcgtggctggtcgtgcgacgccgcccaagtgattgacgtgcgtcaatcacttggaccggtctgtgaccggtggcagatggataggacgggtggcagcgcacccacgccccgccctatgtcaggcggcgtgagggcaggtttgccccgtcccatcagccattagggctcagcacgtacggccggtgcattcccagtagcatgtgcctacaaaagtcttcaaggtttaatgagggaatgacaggggatgtcccccgtgtcagatgggagacggtgctgggacccacctcggagcaagcagccatattgcttccggtctaaggcataagcgggagtagaacccgaggaagagggaccccctccaggaaagatgagacgaatagaggcggtgcatgtggtatccccttgaactataaaaggaagaccttacccaccaagcaaggggacaacttttgatagcctgaactctaagggaagtacagttaggttttcccaggagcccaagatctcttgtaagaacttaagcatagttccacacacagaagtagggtattacgcttccgagcggcccgaacctgtataatctctggtctcactcccggtcactctcgaccaccttggtcaaatcttcggctaaggttggctcttaatcactcgcgccctatcgcctggtcgaactcacaaaggggggtggtctcatgtcctcccgctagagagggttactcctcgacagctggcgcgccaggtagggggaaacccgcgcgtttgtgaaggagccgcttttcttccgccccaagtttccctccatcctcaacgaccatggttgaggtagtggaggaagaggtggtggcgtatactccctcaccttccggaagtgaggacggtagcgggagtcgcgaccctcgccaccaccgctggaactctccgacccctcctcgtcgatgtcccggacggcaggaggaccccaccggttcggaggattagccctttccccgctggcggacaggggcaggttacgccgcgccggggtgcgacgccgcctcaactacaatgatggcggcacaccccacggcacactctaggctgtgggggctctcctgcggcacccttcggtcgttctagagccggaaaccctagtccggcggtggctggatgacgtgacccacttggtcaccaccgccccgcgacagctggccgccgacgccggcgaccggcccgcgaccactggtacttcgcgtaccacctacaaccctctcctcatcggccaggaggagggcccgtcgttccgccatgatctcacggtggttgacggtcccgacgtcatcgaggcccacggagagccacgggcgtcacgacagtctgtacggggaacaggacgctcgcatcaacatcgagcgccgcagggacaagcaccgtgctacccgcgtggggaaggcacctcctcatcaggaatgtcgcgccaccccacacgaggtggccggccccccacgcccccgtccagtgaggcagggtgcaaggctttcatggcaagtctccggaatgtccggtggcccccgaagtttcgtccgaaccgcactgagaagtacgacggcaacgtcaacccctccgagttcctccaaatctacactacgatcatcgaggccgtggggggcgacgatcgggtcatggcaaattattttcccatggccctcaagggtcaggcacggatctggctcatgacccagccccctgactccatccactcctgggaggacctgtgccagcagttcgttacgaacttccagggtacgtaccctcgcccgggagaggaagcggacctgcacactagggatggcaacggggcggggtggggccgggttgggctagaacgcccgcccccgacccccgacttcaccccccgcccctggccccgattgttgatgcggggtcaaattatcccccgtccctgacctctccggggcccctcaactcgaccggggccccgcattgggtagcatctttatccaatcaacaccaaaaatacaagacaatcatcaatttggcaaaaacaaatattgcacataattgacacaccattaaaaatagcatgaatcgtcgaccgtcgcgcccttgcctgtctcgccggccgccgcaacctcgccggccaccgagcccttgccgcaacctcgccggccgctgcgtccttgccgcgtgaccgggcgtccaggcctgtgcgccgccccgtgcgtcgtttgcattgtcggagggagaggtggaggggacgagctcgggagtcgggaaggagaggtcgaggggacaggacgggagcccggaggggagaggaggggaggggaggggagaggccgaccggcgacggcgagatctagaggtgcgcagtgccccctgcgccgcgccgccgcctccgctcacttgtgtgcgtgatgcggacgggaggggagaccggtagatggggataggggaggctggggagaggataagattagggtttagtaattttgtttatatatctcagtttttgttgggttgggctgttttgggccttctatgggctatgtctcccccgtcccctcctcgcccaaatgcgggtccccggccctgactcccccatgggtcaaaaatcacacccgcccccacccctgtaggacgacgagtccctctgctcgtgcatacaacgtttctgccaggtccgcaacactatcccgtgcatcccggcccacgtggtcgtctatgcattcaggggcggcgtgcggcacaaccacatgctcgggaagattgcctccaaggagcccaagaccaccgccgagctcttccagctggcagacaaggtggtttgaggaggcgtgggcctggaacatctctggctcaggcgcagcggcttcggctgcccccgagccctcttcccgctctaagccgcgggacaagagaaagaggaggaagtcggcccgctccgatgatgagggccatgtccttgccgtggatggtgcctccaggcccctgcgtaaggagaaggccaccggcagcaagccgggcgccaccacccccgacgaaagccgttcagcggacaagtggtgctcgatccacaacacttaccggcacagtcttgctgattgccgcacggtcaagaacttggccgagcgcttcaggaagactgatgaggagaggcggcagaatcgccgagagggcaaagcccccgtgacctccgctggcaaccggcaaggggaggccaagaaaaaggcccccacgatgatgatgacgatagcgaggacctggagttccaggctcctcagcaaaccgtcgccacgctcgacggaggggcgtacgctcacgcctcccaccgcagctttaaggccatgaagcgagaacttctcgctgtggcgccaacccacgaggcggcccgccgggcacgctggtcggaggtgaaactcaccttcgaccagagcgatcaccccacggtgctcgcccgtggggggaagttggcattggtggtttcccccaccgtgtacaacgtcaagctgaagctcgtcctgatcgacggtggggcggctctgaacaacatctctccggcggcctttgaggccataaaggccccggggatgaagcttcagccgtcacttccgattatcagcgtgatgccaggacacacgtggcccctgggccacatcgagctcttggtcaccttcatcgaccgtaccaacttccgcaccgagcggctagactttgatgtggcgaatctcaatttgccctacaacgcggtcctgggaaggcccgcgttggtgaagttcatggccgccacccactacgcctacctccagatgaagatgtcgggccccaacggccccatcaccatctgcggcgacgtgaagatcgccctggtctgtgcggagcagcgcgctgacaccctggcggcggcctctcggccagaggaggacggcagagccccggaggcctccacatcatgtgcctccaagaagcggatcacctcgagcgacgaggtgcctgtcaaggagataccccttggcggtgacccgtccaagaccgccaaggttggcagttttctagtctcatcacgaggcatagaagctaatcccgagaagatatgtgcaatagagaggatgcgccccccccaaagcaaacttagggatgtgcagtgcgtcaccggatgcatggctgccctaagtcgcttcatctcgaggctgggagagagggcgctacccctgttcaagctcctcaaccgctccaggccgttcgtttggatggaggaggctgagcaagctctcaaccagctgaaagcttacctcacctcccctccggtcctagtggccccggggccagaggaaccactgctgctctacttggccgcgaccccccaagcggtgagtgcccccctcgtagtggagtgcgacaaagaccatccgtgaaccacaagcgacgagcccgatcatgggaagggactaggggccccattaatcggtgatggcccctcgtctcccgacggcccgagcctcgatgctcctggcccctaggcatgccccgacgccaccatgggggagcaggaggccctggcgggtggccccgaggtcccttgcgcggatgcgggaggaagccccctggggccccaagaattgactgccctgagactggcgcccctgacagcaaagatagaccccgccgaaaggtgcagcggcccgctattttgtcagcgaggcgcttgaaagtgtcaattaggcctagagggagaggggtgaataggctaattaaaaaaaacaactaaaagcggaagcagtaattttcggatatttccgaaatttttggatatatccgaaaattttcggagtcagcacaaacagcaaagtaaatcctagatctggttgcctacaacaagaatatgctagcacaaacagcaactagacctatagcggctcaaacaagaaaagctagtggagagggaggaagtgaagtcaccaaagatgaagctcacgaggttgttcccgaagttcgaatccttgaggggattctactctctgttgaggagctcactaagagccgggtcttagctaaccctttcctcaagaggttgcactaagcactcctccttccactaagggtatctcttccctttcggagataagatccgaccttcacaaacttctcccggccaaccacaagtagatcggtggctcgggagcgacacctagccgcctaggagtcctcaacctccaagagtaacaaatgaagcaaataactcccggagatgatgcaagtgctcacaaatcttcacgaagtcaacaacaagcactcacacaaacttgaatccacaactctcacacacacaccaaatccaaatcgaacacgggtgagaggggaaacaagaaagcaaggctcaaaagtgctagagagagagagcaagccaagggcacaaatgattggaatggaaccagcagccctcacaagtaaggggagggggctatttatagccacagcccagattctgcccgttgtgcacaataattgagattttcggacatgtccgaaaattccaactcagcaccaacagctatgtcaacgaaggatttttcggacattccgaaaacttttcggacaagtccgaaaatttccagtaccaacaacatcgttctggatgttctcggaaaagtccgaaaataactttcggacaagtccgaaaattgactctactaaagattttcagaaaaatccgaaaatcagtttcggacaagtctgaaaatatacagaaccacttttgccttcgcagtctttttcggaaagtccgaaaatcactttcggatatatccgaaaatttccagaagcgaaaatctggttctgtgtgttttcggaaagtctgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctagaactcaaggaaacgaaaacgtacaaaataccgtttgctcatttgccgtatcacatcacatcaacgtattcggcgggatatgcattacgctaactcattgaggacataacaaccttcacatctgcttaaataaaaatgttagtaatctttaatcgcattgtaattaatcaccaaaatcattaggggcctagatgcactttcagcgctacgggacgcaaaaacccgataccctcaagctcagaaaatgctttatgcagttctgatggcctcgaggaagctacgccattactttcaggcgcatcgggtttccgtggtaacgtcctaccctctcggtcgggcagatcctgcacaaccgagagggtactggacggactgtgaagtgggccatcgaactagcggagttcgatctgcacttcaaaccacgacacatgataaaaagtcaagtcctagctgactttgtcgctgagtggacaccaatggacgatcccgacctacccctcgacccttccccctccgaaggcggggaggacccgaacaccgacatcggggtaatgcactttgatggttctttgaaccttcaaggtgccggagccggagtcacactaacctcgccaagcagggacgtccttaagtacgtcattcctctcgatttccgagcaacgaataatatggcggaatacgatggactcctcgcgggattaagggcggcagcaagaatgggcatccgcggcctcctcgtcctgggcgattctcagctagtggtgaaccaggtctacaaggagtaccagtgcaccgacctgcagatggacgcctacgtccgtgaagtgtgacgcatggagcgccatttcgacggactcgagctccgacatgttcccaggcgcgacaacgcagtcgctgatgagctatcgtgtctcgtgtcagcgcgagccccactccccccaggagcctttgaagaaaggctcacgcagccgtcggcgcgctcggattccccgagggtgcctgatgccgaaatccccacccgacgcctcgcgagccatagtcctcggggcccgagggggtcaaccccgaccccccacgtcaggtcgcctagatggccgacatctgggcatacctcgacaatcgcactcttcctaaggatcacgcggaagccaaaaagctcgtgcgcatctccaagcgctatgtgctagtataagggaccctctacaggtgcggtgccaacggagtcctcttgaagtgtatctctcgggagcaaggcatcgagctcatcgccgacgcccatgagggagaatgcagggcccactcggcctcgcgcattttggtcgataaagcttttcggcaaggcttttactggccaaccgctctccaggatgcccaggactgcgtcaggcgatgcaaggcttgccagttccatgccaagcaaactcatcagccggcccaggctctgcagctcatccctctctcttggcctttcgtggtctggggtttggatatcctagggcccttcaaggcggcccgtggcgggtaccaacatctgtacgtcgccatcgtcaaattcaccaagtggcccgaagcttacccgatcatcaagatcgacaagcattcgaccctcaagttcatcagaggcatcacatcccgatttggagtgccgaaccgtatcattacggacaatggcacccagttcaccagtgaactattggtgactactacgacaacatgggcatcaagttatgcttcgcctcacccgcccaccccaagagcaacaaccaagtcgagcgcgccaacgccgagatcctcaaaggcctcaagaccaaaacatacaacgtcctcaagaagcacggggactcttggctagaagaactgcctgtggtgctgtgggccaatcggaccaccccgagtagtgcaacaggagaaacccctttcttcctgatatacggcgccgaggcggtcctactgtcggagctctccctaggctcggctcgagttgcgctgtacaatgaggcagatcaggatgggctccgtcgtgatgacctcgactatctggaagagcgaagaaggcgcgcggccctccgggtggcgtgctaccagcagagtctgcagcgctatcatcagcgccacgtccgggcccagttactgcaagtccatgacctcgtcctccgccgcgtccagtcgcgcttaggattgagcaaactctcaccaatgtgggagggagcatacaaagtgatcggcgtcccccgaccaggctcagttcgattggccacggaagacggcacagaactacctaacccctggaatatcgagcaccttcgccaattctacccgtgatgtcatgtgtcatttcttttgggctcgggccaacttccacacacccctcgggctgtgcgggcttggccgggggctaccaagtgtcaattcttgtatttcgacatcctttctagcaataaatctttctatttatttaaagccatcacgtgttttctcgttcccttcctgagttttatttcggcttgggagtggttcgtgcttactctcatccctaggcggcgtcgggcaacctgaaaagcgccggaggtagcccaaacgtgggccgtgccccgggccgcggcgaaccccgggggctctgaagggcacactcgatcgtccccgacccccggtcgccgcgactccggcttggccagtcccgctaagcggctcccccgaggtgacggctctgcccctcgccatcagggtcccgagtgctaagcgcgagctcctttccccatccgaacaaacccagggggaaacggaaatagcattccacccgctaagaaaataattggcgaacctcccgatttttccattgcaggcattcacagattgaaagagtgcaagcaagacgaggaaataagatttatgtacatactgggggcggcacgaaagcctaaagtcatcaagtgttcatcacaaagacacagcaaaaaagaagaaagggggcagtcatcgggtgcccgggcctccaagtcctgcgccgctgacgacctcgtcccagtcctcgccaccgccatcgctgccgctgtcttcgcccgagggtagtgcgaggttgaaccgaggggccgtccccatgaagatcgacacaatcacatcggccgcctcttgaacctgctcccgggccaccgcctcagtccccggagggaagtcttcaagcatgcaccaggggaggaactagggatcgtgggcttggtagctcgctaggatgagctccaccgcggcccgcgccagggaagccgacgacgacttgaggaccgtgtcaacctccccctgcaacttctccaggtcgaccgccatctcgtctagccagtgtgcgagcgctggactagtagatggtaacttcttgtcccagcacatcgagatgcccacccgtcgtcccgcgcgctccagccgttcgatggcgtcgtggaggaggccgggccccacgtcgttggtgagacgaagggccctgatctccctggcttggtcctgcatcaggcgttccagagcggcgagtgcgtcctgagccgtggcgagccggtcagctagatcggtgtcactgcgctgctcgcgcgacgccagcgccttctccctaacctccagctcggacgcccgcgctgccatcgctgcgcgctcggcccgggcgccttccaggtggcgagcctcgcggccggctacggcctcctcacgctacgtgggatggtcgcccagccgccgtgccgccacctcgcaacgggtgatctcagcctcgcgctcggcaagtgcggcatcacgctcccgccaagcctcctcccggaggcgcagttcctccgcgcgtcgcgcaaccgcggcctcggcggtggtggtggtgcgggcatgctcggcggcggcctcctcgcggaggcggagggtggactgcgcccagtccagctcctcctgctcgcggtgggtgcggtcgaggacctcgacccaccaccggatcgcggcctcagactcctagatggagcgagcgcgcctctccaggtcagacgcgcgttcgtccaaggtcctgccttgggccgccagcgcctcctcccgagtccgcagggaggccttgacctccgacgccggccattcctgggccgcgaccgtgttgaggaccccgcgggcggcctcagcccgctgcaccaagtcctcggcgtgggcctcatactgcaggcggatgtcgcccagcgcctcgtccagaatgctggaggcgacgagggccgcctgccactccacctccgtctcgcgcatgatggagtccagcgtctcctcgcgcgcctggatctcagccagctgagcctggtgcatcttgcgccctggctcgaccagggcatccacggtgcagcgcccctcctccactcgtgaacggtctgccgcgacctgcgcccactcggcctccagggccacacgctcatctgccagggcctgaacttggacgttgagcccctctcggacagtggagtcggcggcggcgaggacctgtagaaatggctccatgctcacgggaatcggagtagagaagggcggggtccaccctcgtgatgacggagtctagctggtcctcccacgggattgcgggctgcgctcggagcccctcctgcgtgtccgaatccgagggcgccccaagtgtagaggggtgtgggtgctctcagcaccctccacctcgggaccacgagccgactcggtctcagccttgggctcgcgctcgggctcagcctcgacctcggcctctgggccgcgctcctcctcgacctcgatttcagggccacccccgaggtcgatctcgggggcgcgtctggcatccccctcagcctcgctcctggagccgccccgagggggacctcagggccaccgccaccgacccccgatagcgtcctctcctccctcaccgggacggtctcagccatggtggactcagagtcggacctagtgtgaggccctcgggccctgctggagggtcgtgtggtgtccgcggtcccggtttggccggcctccggccaccccgacctttcaggcttagatccccggggagactcactgtcgagccccctcgggaggggatttcgctgcaataaaatcccaggggcgcctgttaaaaaaaacatagagagaaaggcaaagctagagtgaagagagataacggaatcggaaggcggcagatgtacctgcgggcggggagggggggcgtttgaaggtctactccggggctcgatgaagctcccccggcacggctccgtctgccccatcttccggagcctcttattcttccgctccggctccgccgcggcgggacgcttgtggctggtcggtggccggtcgactgtgcgctcggcgccgccgccgtgtggatgggaaggcggctcgaacccagaaaccttccgcttccctttcgggttggcggccgggcctctaccagccccgtggctcgggccaggcgccctggagccaccaccgccggaaccgccagcccgaccgccgcccgcggccacattgctgctcccagcgtcgtcgccgccgccgccgcccccagcggcacccctgcgggaccgacctccggcggtgccaaccgccatcatcacggctaggatactctctcggtcgcggtcgctgcagaggggaaggatcccatccgggatcagcatcggctcgacggtgtccaggctcagcacccgacgaaccaccgcccgcgcgtcttccttgccccaatccaagcattggcccacatgggtgcgcatcgggtcattgtacccagtgtaggcccacgcgccgcgggaccattcttgaaggggcgcgatgcggtggcggaagtagtcgccgaacaccatcgtcgccgtcagtcctttgctccgtaggcccctaaggcggtctaacactgtgtcgtattcctctccaagctccgagaccgccagccagccagcggatcgctcaggtgggccggtggggagccggagacggaggtggtcatgcagcgcggtgtagaaccaatccctcttccagtcgtcccacttcttgcggaggtgggtctcgatgtactgccccatcacccccgcgcggggctgaaagtagcatcctcccaccaccgcggactattgcagctgtgggatgaagaagtactggaataaccgcatggacggcctcaccccgatgaacatctcgcataggtgcgcgaagatgaccaggatcatcatggcattgggggcgaggtgcagggcgtggatctcgtagaagtccaagacctcgtggaagaagccagagaatggcgggattagtcccgccatggcaaaggacaggaggtgcacggaccgcttgtaagttcaagtgccttaatttggttttggtgattaatgacaaatctagttatatgagactaacatttttgtgagcttttgtttgactagtctcatttggatatgaaagtaaaaatgattagaggaatgtattaaacttcacatattctaacttggtctctcttgtggatccaaaatatagtgtgagctccctcattgatcttgattgattatgtgcatatgtgttcctttatatccatatgtatgcacatcttgaggaggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttggtgatagatgatataccgatgtttatgggattaacccctcttttacataagttttaaacaaggttatttcccgataatgagatgtggtagatatgcattctttggtgatggaccttaatcatgacaaggatgaaattcatggagataaagcgatatgtatcacttcttatctcctacttttgataggttcatatatatgatttccatgttattgttatataagtgtgagactaatgtttacttgagtcttatcttatttagtctcctttacattgagaacatggagatcatgaaggtatgtgttttttggtttatttttatcattgctacatgccttctccatgtgtataggataaaccccattggttcttcataacttatgcatacacttgcctctcttgtatatttatttgtatgcatatatttagggggagcaaatcctatacatttattgtgcatgttttagatccacgttgttcacctattatttatattggatctttacatttgagcttgcatacgagtatatgacacttgcgatgttaatgaatactgaacaaacatatccatatctttcatatgcaaccggttggtcaccaagtggaggatgacaaccgatttgttggtactaatgttcttctttgagatgtgcaaaggaataggtctaattgtgatgaggctaatggatgacaccttgggttgatggtcaccaagccaagggcatcgccgtgtcgacaagaatgaaatcaagcttgtgatgagaagaaagtcctgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttggtgtttggtgtagaccggatttgctagataggcggcgtactatcaagaggggtctatgaagcgagcttgcggatgatcttgtgccatattagctcatatgcatgtaggtgcatttggtgggcttgtctagccaagtgtgatgagttttctcaagtcctaaaccaagaaagaagtgggcatgtccaataggagtgagtgacatcttatgggtatgtccggtggatatcctttggagtgtgagccctttatccttgacttaagttgtgtttcttggatggttttttcatgggttggatggtcctttgaataagctttccatagagtccaagaacgccaaattccgagacccgagtcaagagatatcgccgttttactaacggtcggttgagctgaaaagtgacctgcggtctgaccgtgggccttaggccggtctgaccggacctgttagccggtctgaccggcgtggtaaggccggtctgaccgaccccactggtctgttgcactggtctggtttttggtggcgatacagagccgtggacggtctgaccggctactacactacggtcagaccggccaggttgagtgggctcaatgattgccctgtaacggctagttttctagctgttacaaagtagtccggtctgaccggccactctatggcggtctgaccggcggagcacagagttggggattttgactccaacggttagttttggttgttaggggtatatatacccactccccaacagcaagggcaaggttttggcactccattgcattatcttgaacccttgcaagagctctcacacccttgtgcacttagtttatctagtgaggtgttagagagtgagttgagccaatccaagtgcattgcttcattgttatagctagtgtggcacttgatcatcctcggcaagcatcctagacttgttactcttggaggttgccgcctcctagacggcttgtggtggtgttgcccggtgacctctccgaggagattgtggaggaggcccggcaccgtttgtgagtggtttggagttcaccaccttcggagtgaaggaagaactaccccgagtgatcgaggcttgggtagtcctctccgtgggccggctcccgccttgcccaccccttgacgaaggcgacgtgcggtggcttcgtggttgagcggtgaagttgggctcgcctcaatggggattaggaaaccggcgagtttccaaacctcggtgaaaaattccttgtctcttgtcttatttatttgttgcatttacatttgtgctatttacattcatagagacatatttgagcctatatcacttaggtttgcaaaacttaacttagttgcttagttaaccttgcacctcaccttacctagcaacttaggttagttttgtttaagtgccattaagttttaaaaccgcctattcacccccctctagtcggcctccttgatcctacaccgctccgggtaccgcagccgcggccacggctcctccgccctcacgacggcgtcctctggcatgaatttgcggacaaagctcatgtgcttccccgacatgatgcacgaggccggaagaatggcgttgccggcgtcttgtgccatggtgaccgaagagagtgaacaggggttggatgagagatgtggtggttgaggagagagatgtggtggttgaggagagagatgctgggggctgaggtgcaggaatgcgagagtgagaatggcgaaaggaagaagaaggggtctcctcctctcccccttttatactcgcctcgtctgggcctgcctcctcagttctctcagtcgctgctgccgcccccttgattctcgcgcccgctcgtcccactcgccccgctcgtcccactacgtccatgtcccgcattcaatgcggctgacagcggcgtaaccgacgtgaggcgcgcgatgatttcggatgtggctaggcgggcccaccgataatctcgtttcgcgcacctgacggacgcgcgaccgatgcgacgcgaagcgataattccggatgtggccaggcgggccctccattttcccagattgcacgcccccatgcgtggcgcgatcacccatgggcgacctgtcatcatggtgagcacttaaagctgcccacatcggtgaaggctgctcagattccccgcggggcccaccatcacaagacggaggttattaggcaccgcaccagaccgtcccaggtggggtgcggtcggacgtagtaccgggggctgctgtcggtgatatgggcccgggggtacccacgttagggggaaggagcggaggagcccttccccctagccacgtgtaagcagccgagaggcgccctgcgtccacctaggggcctcggggtaccccgtcgcacccctcgggcccaaggggttgtgccaccccgaggcccccgctcagctgccactcggcggctaagtgggtggaggagggggcgccgctggcgcatttatgaacggcgtcccaaccacccacgcaacgcacgtcaatcacttggaccggtctgtgaccggtagcagatagatgggacgggtggcagcgcacccacgccccgccctgtgtcaggcggcgtaggggcaggtatgccccatcccatcagccattagggctcagcacgcacgaccggtgcattcctggtagcatgagcccacaaaagtcttcaaggcttaatgagggaatgacaggggatgtcccccgtgtcagatgggagacggcgctgggacccaccacggagtaagcagccatattgcttccggtctaaggcataagcgggagcagaacctgaggaagagggaccccctccaagaaagataagacgaatagaggcggtgcatgtggtatcctcttgaactataaaaggaggaccttacccgccgagcaaggggacgacttttgatagcttgaactctaggggaagcacagttaggttttcccaggagcccaaaatctcttgtaagaacttaagcatagttccacacataggagtagggtattacgcttccgagcagcccgaacctgtataatctttggtctcactcctgatcactctcgacctcttgatcgctcgtgccctatcccctggccgaactcacaaagggggatctcacgtcctcccgctagatagctagggttactcctcgacaatagtcctttagtatgtgtcatgaaatataagtatacatgaaatgataaccgtgcaaataagttgagctctatctataatatctataaaatagttttattgggaatataattaatttgatatcacatatactgtaccgagtatcaaatattgtagggttccataaaaaccaatttaaaaaggatatgttaaatttaacttgaggattgaaattagatagaattaccctagtcacgtaaaggatgttccatcggaatatttaaaacatatcgtcaagtctctcaggacataaaattcaactcggcaaaataatttgccacacaaataaacggaggcaatgctttattgcctctataatggtcctagttgaatatttaaatcaatataaaaaagttatagcaagtccctgatttcattgggatcaaatctaaattaaattaaggcaaatcatttgtgggaagaaatcaataattcaaattcaagtgaaatatttgaattcctaataaaattttcaaatccaaaatgttttcaatccaaattcctagtctcaactatcaatttgcagtcaagtccctcccttttcgctctattattttccttctattcatctctcagccagcactgttcatggtccaccaaggcaccaacccgttcgatctgggtctacccaagaacgaactctctccccagagcaacccagccgcgccgatactgtacatctcctagcgtagcgtcacctccagaaaacccggcgatacgcacttgcccgcgcgagcgtcctgctcccgtcgcgccagggtcggcgccgcgaccgtccctaaccctagccgcgccgcacccatgtcggacccgcgtcgcactgcaccatgccgctcccgtgtgccgcgtcgcgtccactccgccgcgatcccgctcccctgattctctccggagaatcggcaccacgccgtcccgtcgcgccgcgcgcgttacctcgatcgcctcgtcacatcaccacagtcgcgtcgccatcacccatagcacatcgtacggccgccacgtcgcgccatcgtcaccatgctacgccgcgtttgctggttagaaccgcgcatccctaacccaagaaccctaaccacgccctacgccgcgacgtcgcccgtcaccctcaccatgaccccggcgccgtatgagaataccatcgctccgcgccgcctccgtcggataatgacgcgctctccgcaccagtctaacttctagcccagcatctagctcgactgcccatgtcctagccagtaacttttctatattttttttaaaagatcacattgtttattatttcgagaatattttcttcccactgtgcttgtctcaaacacaacctaatactccctccgtatgcagcaatgatttttcgtgtccaattttaattgtctgttttatttttaaaaaaaataaaaaataaaaatataagtagtcatgcataaagtactatttatattttatcatcccataacaatacaaatactaattataaaaaattttaaataagacaaataattaaagttggacacgaaaactcatgaatacacttaacgtgggacagagggagtattctgcatcgtctcactcggacagagatggcggagaagaaccatcaacttactatcacagtattggatttggaccggtctaaagaagcgtatttgtttaatttctgtcttgatttcaagatgccatcgcgagatgatatatccggaagaggtgctatgagctcttcgaccaaaaattaaaccgaaactactgtttcacgtggcgctgaaaatctaaagcgagcagctgttgtttcgacagaaaaacttaatttcgaagggtacttttgtattgccggtaccaggtttaagagtgagtaagctactacaaattattccccgtcagtataatcggtataaaattatagcgggagctaaaccaaaatgaccaagagcaactaagataaatttagggttgggttacgattttttaggccttcttagcctgttgggccttctaacaacctcaaacaaagtctacattagcccctcatctataaatatatggacccccgcccccacactgtctcagcccttgtgtggaagggaggagaaagaagagagacagagcagatatgtcgcgagtgaaagcgcaagatagaagggattaggtttggaactatagctatagtactctatacctagtacaaatagcaagtctaaaattagggtgcattctttttacggaattgctaaccttcagtcgacatgaaacccatctccaaatcttgcagattttgggccaccggatgagcttcgtgattcgtgccccaggccttctcctctaactccggcgacctcctcatcttctctggcgctgatgacaccctagactccgacagagaactctacggattagggtcccgggttggggtggtgatgggaggaggagagggaagaggggggagttcgccggctttagagggatggccgtaggaggtggcaacccggcggtgggcggtggcagcattatcaaagccgcggggtcgaaagctggcagtgcgccgatgtagatgccaggggcaaagcagaagggcgtgttaggaggaggcggccggtgttgtagccccgttgccggagacggggaagacggtggcgcgccgccgttggcttaaggaaagaagaggaggagagggaggggaaggagaaggggaggaggctggctgggagggggggcggcctcaccggcaccgttggcacctttgggccagccggcgtagtgggcggcagcgcgatggcggtgggggatcgggcggggcgagatggaacccgcgaggggagtggtagtggcggaatgcacgagcttgagaggaaagggaggagagagttagggttgaggttttgcacaaatcttaaaaagcatatctaacggtccaaaatttgaaagatggaaggtgggattttctatcaacatatatgtagacagtcacttctttttaaattatgggtttaggtgattagctgcacacaaaagtatgaaacaagaaacgtgattagcttatagttaattaagcattaattattaaaaatttaaaaaatgaactcattttttaaatcatcctctatatatatgaagttttttacggaacacaccatttatcaatttgaaaaacatgctaaaaaaaacgagaagtagctataagcttaattagctatttaaaacgcatcctagattctcaacgcagcttacaagccaagaagcagcaaatgaattgttggaagaaaagaaaactgatggtgttcaggaggcacgacgacttccacaaaccatgaaatagtttccacatatatagttaacatttaaactctctagtctctagacagagaacatactacgaaatgtgaagagtgcaattggagcttgttaattcgaccacgattaacacgagttgccatctgaagcttgcaagagcacaagcttgtccgttggcggccaaaatgtcctgggttgctgatgaaggacgaacttagctagcaacaaaatagaggctcaacataaggctgaactcaacctctgcgctccattttgtctttcttcatggcctcctcggcatccctgcaaggagaaaaaaaaaagcattgtactacagaaacagaaaaatctctacatgggtcccccttcccacttatagcacgaagcacaggaatcattcaaatggcatgcaagaaattttcccgaaacggtaactaggcacgcatgcacaaaggcaccagggagatcacaagatgctcctttcctgagaagcaaaaaaggcttgcatactaacccgattccacatttataatatacattcttttctactgaatctataatatagtgggctcttcacaggatgaagatccagaataattaccttaaagctttctttatatcttcatttgcagggtccaacttcaagccatctgcaaaagcttcacaagcttttccatagtcctatacacaaaagaacagatcaattttttgacaaataaaatcgaattttaaaaaaaatgctcttttagtcttttttacctttataaacatgaaagctgccccttgtcgatagcatgctttgggccaactgggccgcaacattctgcacatgttagcatcagcaatagccccaatgccggttgacaaacgcaaccagcataggctcctgtttgctagcagggttgccttatcatgagcacttgtgctaagttctattgcctacagtaaaagtacatgcaacttttagcaatacataaaatggaatgtattgtttgtctatattactcacctcaactgtaggtctgtagctattatcatgtcttgttaattaggtaatccaacaatgctagaggtagggatgaaaacggagcggatagtttccgcccgcttcggagaaaaacgaatacggatacctttcgtatcagataattcttagatagttcagatacggatacggatattttctccgtcggatacggataataattcggatatccacataagttatgagacatacccccatttttttataactctatgaccttcaatagacatttttagattttaattgtagttcatctcttatcactagtccacactattaatactatttaaatttttaaaaatatttataaatcatactacattttatataaaatgagctaattatatatgttgatatttgtttctattagaagttgagttggttttcgtgttatgagaaaaatttgtttccgtattcgtgtccgatcatattcgattattactcgtattagagataatctatatttgtttccatattcgagctgtctgtatttgtttccgtgtccggcaaaaaatatgaaaacgaacatggtatgagcattatccgctccgttttcattcctagttagaggtagtatactggtagtattgaaacaacttttttaagggtgaacagagagctacaatgttgacatgaattgtctccaaaaaaacaacacatttaggcactaaagatgtgttgcaatgtcttacgttagtgtagtgttgtactgcaagcgcataatcatttctctcgaaagcctctctagcttgtaatttcagttcagcacttttccttttagacagatcattatcctgagaacaaaggattatcagtaagaacatgcatgtataactaataccaatatgaagctgcatctatgaaacgattggttaacaaatatcacagtcaatgattcacatatcttgcataacctgtaaaatatccagtttgatattccagtactactgctttgaaatcagttactcaactacgaactagtaaatatctgtgcacagcgcataacaaaataacacatggaaagaactctctagctttctataaaagctgggccactcaggccttttatccaaaaaaaacacatgaaaataaatgttccatattactctaaaattgctttaactgttcacattcagtacaacaacaaatatatactgttgtgttgtgctcatcagcctcatcataaccataaccggccacgtcaaatgaagaaaaatacataaggaattaccataataactctcaggggaaacagaagggaagaaaaatacatgagaagctaagtttgcatttgaggtggtatgttactaatatccatgtttgtgatggcactagcctgattttccaaaataattgatggggaaatggacgaaaaagataacaaagctaaaagagttcaacaataatacaaggaaacagaaggtggcaaatgaattggcaagctcatcaaa

SEQ ID NO: 62156 - DNA, 533 bp, Oryza sativa
cagggcccaaccaacccccctgaactacagtgcattgggtcaatttattaaggtgggactaatcacggtgaatctggtcgaccgcccataaccgtgggcacggctattcgaatagttttactctgatcagaggtgtacaactgtacccacaagacacagccccacgacacgttttcgtgcgccgacatgccaccacgacatatcggaaagagactgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacattacaagcccagccgttgcccacgctggcttgtggtaagcatgataaattcttccagggtttcccgcgaaccggtccttaattgccatgggtgcgactagcaaaaccatgcacccacagcccacc

SEQ ID NO: 62157 - DNA, 11706 bp, Oryza sativa
attattatttgtgctctgaaaattccactaaaatttgagggctccttttagaccaaggatgtcgtaggctctccagaccttccattatatttgagagatgaagtgaataattcaaatcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagatgaaagaaacttaagacttacaacaacttaataattacataggccaaccggccaaatagacttattagagaacagcggaagcttgactacccaatcacaagcacaccgactaggggtttaccccattaagttctcatcctagaagaagcaatcggaactcgcatcactcaaagactaagactaaacctgcaaacaaaaggttatatcaacagcaagagtcagtacattaacaagttaatgtactggcaagcacaagtcaatcctactatactacatgtaaggcatatattcaaaggaaggcaatatgtagttcaatttcagcataaagcaagttttgttttgcaattcttttgtaaaggagttgatgcttcaattaacaaagacaagttttaagtttcattattaacttcttcataattccatcataaataatctcttattgccatacttaacaataagtcataatgtatcaccacatacacaactcaacacatttatcaatttcaaaccaatgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccatcacactcttcatgttgaatgtgatctagagatcataacgaagcctttacactacttagaatctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaacaccatatgcacaccacttgctgcccaagtataaaatcacattttacacattttagttcgcaaatacccatcatattcattttattccagcaaaggttcaagtatcaaaaccacattttaattatagatggaatgagcatttgcatatttctaagcatggctaagcaagtagttgcacatagagcatatataaacccattcgagcacaatgaatgtactctaatcatttctaggggttcaaacagcaagaggatcaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttacaatagtatagtcttaggtagtgttatgaaatacttttgtaaagtgatttttattatattggacttcacaggggtgtggagatgtgttttctaagactaacacatttggtttcacaatttttggatttataatgaattctttatgcattttacaagttataacgtgttattggtgtatagtgttttatatgttcatgacttttgagttataggttcagaacatgctacttcctgtttaagttgaataaaaggaataatttggttaactaaaacatttttatctcacctgtttatggtctttactactatggttcatattttataaagtagagatgctttaatctaaactagcaatatattatattaacctagaaattgttatatgagctaagttcttctaattttagtggatggaaatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctgtgttagtaaatctttatatgaatatttagagacttttactacacagcaagtatataatcttatttcataacttggaaatacatgttttagtgattctacagaacttaagtttactcaaattgaagctaaattgggttctacatgaatttctaaagtttagcttatctaaaactaatcattatagagataatagttttagaggcatttgatgcaaagtaagtaattacttttatttaacctaatcagagactgtatgatgatgaatctgtagaatttgattttgtttcaaaatgagttgaaatgaattttctatgcattttataagtttgtacatgtttatgtataacctatcttagataaattttagagacattatttgtacagtgagtgtcaagttttatattcctggaataaagttcataacttcaagaatctacagaaactggaataacttcaaaatgagctatatttgattttatatagattttacaactttgtgcatttttctgctaaacatatatttgtttgggcattttcctaatttttcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagagctagccatggctgagctcgatctggagctcgccggcggcaaacggtggctcgtttgaggttgaggtcaaaagataaaatgaagagcaagctctcgcgattccattcctctagttttcttggttagaggacatcggagtagcgccgatggcgagtgtgagcggcggtggttttggggtgaaagtgcatgagcgcatggaagtcgatttcgaacgaaaaggatgcatgcatgtggtcttctagacttcaggatgctcaccgtgggtcgagctagggttgtcgaggtcttggcggcagcgacgacttgaggaacggctcggcgacggcgctcctcctcaggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagatcggcgttgaggaagaaaaggatgtgttctccgtgttcttgatgtttccggctggggttcttgaggcgttttgaagaggaggttgaggcgatgacaatggcgcagcggttttctctgacgtggatgagaatggccggacgacgacgatggttgatagcggcggcgctccggtgcgtgctccagggcgttggcggtgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagaggctgaggacctctccctcggcctcttcagctccagagtgatgtgtggagttgggcgactcggtctggaggagatggaggcatgactcagtgacttgaaggcgtcgacacgtcgtcaccacgcgtcgacgtgtccaggactcggtcggctctcgatctctccctctctgtgcttcttggtcggctgaggatgagggacagaggaagggcgaactggagaggctgccaggtggggccaagtcgatggaaactaggctagggagagagatatgggtagaagactgggtaaacttgatttttagattaattttcggaattattttctcctctaactttgtaactacataattcaatgtgtggaccaaattaattagtgttgattttactagaggtagatgattacacctagattccattttctttggttgcactcaaaaataatgggtggactgctcacagaaattaaacaaagatgggctattagaaagctagattaaatttttaggaggattaaacagagaaggaaaattctagaaaaattatatttattcacgataactaatctagtatttgaataaattatttcccatgttcacttatatgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctcatcactgtccacataaatttttctatgattttatcttgcacaaaatattttagagaattaggatgacctttgtttgtataagtgttcccacttcataattgcatctaatattattatagggattacattaaatttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcaatatgtacatgtatgcttgatgacatttctagtctaatgttgggaatgaaaaggttttattttgttctcaaattttaatcatgcaatggtttaagttgatcatcacctaaattaaaacggaaatttttggctctcaaaattggagaaattaacctctaactattttgacaagaaattttaagtcctaaaatttcgggtaagttacaaaggagaatttaacaaaaattctccgggccacatttgaatttttcttgtacgtattttagtgtttgccaatttctttccgaattttaattaattctattatttcttttagcgaatgatttttaattcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcagatggaatcttctcttcacccgacttgtccctggttgaacctttagctgacttcgactgggttgcggcacttgaagatggtgcttcagttccagaacttcgcatagtttatatttttggcgtcaacctcatagaagttacccatttcacgttatgcgtcgagatcagctcgtcattactaggataccatgcttgtcatcatgagaatatcatgcttgtcttttacttctaacttgccaccaactgcctcatattagctttcctgctctccgggtgctagctacttctgctattcgatgcaagggtcgataactttgcctttgaattatgtttcttaacagaaccaacttatcccccttgacatgctttgacgtcttcccaaatggctttactgctggacttcttattgtctgatcgtgatcctgccaaatctgaagcttcgttgttagatgtgattttaatctaacatctgtagattatcttcgaacatatcactcggttcataactgggaatagctctcacgaacaagcaactcggattcactttctttacatttggttcacttcctactattctcttcatgttgtcctcagttagcattcaacgtattcctttacaccttcaaccttgatgtgttctttcccgatttctcttatcaatcacctttcgacctacttctttgcccggtaataaacatctttttcgatatcttctatcaatcatcttttgacctttgtcaactaagtactcttcactccgagtgttgtggatgcttccggtgacgaggtggtacttgagcctgctgcctttcagagaaaccttcaagtggttcgtcaaaagctagactggcgattgttacctttgatccgaagaaggcacatctgaaactcttagtccaaacaaatgtctctttggttgatcacttgattttcttcgccatcaatcgctaggttatttgattcataacagattatgggtttacggaaatgagaccctaggtctccctaatcaacaacaaaatgtacacactcacagcacttgcaatcttaacatggatccttcataaacttatcaaactcattcattatctcatgtttctctattattacatgattgacggggaacaactataaaacaaaagtatttgaacactgatataagagtgttatggttgcttctgactagcgctaggcttaacaggtactgcatttgctccagtgaccacttggcgattggcatgtctgcttccttaacaggtactacagttgtaaataactttcttacgctcgggttcttcatcttgtacttgatttcttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgtagggagttgcgtggactgacgtgctggcagctacgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttccttacaatgaacgcatgtagtggcacacgagctggcaacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcaatcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgccaccatgggtctttcgggatgctggcggcatgctgacttgtggcgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctgaccttattgcctttctcattgtcagccatctgttgcaaaggtttggggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaccgaaacactagagggtagcttaggttctgcgacgggttctccaagatcttcactcctgcttcacagctggcttcactgcttccttcacttcgctagcggatcctgcagccttctggagcttcggcagacacttgacgacatcttcttcttcactgacctgaccatctagtactagttgaaatccgaataaggaagaagggagtaaaccttttgcaaatagcattaggggaaggagaaaaaaggaactttcgcaaatagttttatttataaaatatgtccttaggttttatccacttggcttatcctacagtcgagatggctctgataccatcttgtcgcgaccgagaaaattgccttttcccgaacgctagtgtattaatccccgtcctaggaaaagccggggtacaccaaacaaacatgatataaaaggcacatctttattatatcgacaatatttacattattacaaaggcacttcaggcctgacaatcaaaaataaacagcagcggactagcgggcctacggctccatcttcacaggcgctcaactggggtataagccaagactccacctaagacatcttctccgaagcttctcttactgaaggggggagaaagatagagcaagaatgagtacaaccacagtactcagcaagccacactggcagatgcatgattaatgcaagggggtacaaggggtaataatatcggggttaagttttgcagtaaacagcatttaaaagtcacttagttgcccaaagccattttataaagacgatcctagagctacacagtattagtaatcaaggccgtgaacccacacgaacctgccttaacccaaggcctacgatgattcagaccgaactggcaacccgaccttgggtcccagctcgtcccaagccaacccaggccaaccattccacattttagttattaagcaggttttaagaatttaaaacactaacttgggtacattgctaggcttgcccataaccgagggcgcggctattcgaataggttttactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccaacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataatccaacaattccaaagtgtccaggtgatgagaaaattcccaaagtctagagttgtaaaaccacctaatgttgcctaattaatcagcgaagcatctacctaaaattatactagtggtactatgagtagagtgtccactagttggggttttgtttaatctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggctcttgacttcttaaggaaaaattagagacttgaacggtccaattccgagttcaaatggccaagttatggccgtttgaagtttatatgctctttaaatggatatttgcgaatttcttcatttaaattttaatttaaaaactcatttattgcgtcagccgggagagagggcgcgcggaccgggtccacgggagtggggcccacgcggtagcctctcagtccacggtggaccgggtgcacgcggctgacgccggccggcgccgtgggtcccacgcgtcagccgcacccgcgggcgcgggcggctgacggccgggccccacctggcagccgcgggacgcgcccgaaggcggccttgccggcacggccgacgggaggcggcgcgcccgcgcccctatggtcgccggcggcggccataggcatggcggagcggcggccgagagagaggagagaagagggaagcgaagcggcggtcctcggctcaccccgggtcgacggcggtgacggaaacggcgaccgaagcggcgagaggcggcggcgcggttcggatcgacgaggacggcggcgctccgacggtcggcgggcgaaacggaggagtggacgaggtcgacgaggacgcggcgaagccgaaggaggtgatgccgagacgggaggaggtccggggcgacgacggcggcgaaccggagctcggcggcgacggcggagagagaggacgccggtgcgggcttgattcccacggggagagagagcggcgagcggcggaaacggagcacacaggctcggggagcgattatatagcgtcgggagggggagagagcgcccggagaggaaggaacccggcgcggcgatctcggctccattgatgccccggcgaagattgcgggagtaaatccgagcgaa

SEQ ID NO: 62158 - DNA, 4577 bp, Oryza sativa
  unsure (1)..(4577): unsure at all n locations
aggccggcaacagannnattttctcccccttcccaacattatataaacactccccgtgcctccctccaccgtttccgccactgaccgctctctctttcggcgggaatcaagctggcgcagtcgctctctctctcagcggtcacagccgagctccggtccgccgccgtcgtcgccccggaccttctcccgcttcggcgtcgccttcttcgggttcgccgcaacctcgccgacctcgtccacctctccgtttcggtcgccgactgccggaacgccgccgtgcccgtcgacccgagccgcgccgccgcctctctccgctccggtcgtcgtacccgtcgtcgccgtcgacccggggtgagccgtggaccgccgattcgtttcccccttccctcccctctctcgggcgccgctccgccgcgccggtggtcgccggcggcgaccatcggggcacgagtgcgccacctcccgtcggctgtgccggcgtggccgccttcgggcgcgtcccgcggctgccatgtggggcccggccgttagccgcccgcgccctcggatgcggctgacgcatgggacccacggcgccggccggtgtgagccgggtgcacccggtccaccgtggaccgtgaggctgccgcgtgggccccactcctgtggacccggtccgcgcgcccctcccctcggctgacgcaataaatccaattttaaattaaaatttaaatgaagaaattcacaaatattcatttaaagagcatataaccttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatagttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgagggttccagccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaaccctaaccctttatagtataactcctttgtactcccttgcatttattctgtacttgtgggtgtgtcttgttgagtacggtggttgtactcagtcttgctcaatttttcccaaacccagaagaggagcccctagaagatgaaggctttggtgtctagctcgtgccagccgtcaagcgcatgtggtcgtcgccctagtcttccgctgcttctcgtttgtctttgtgtgtgctgggccttcgctgcccatgtaataatttaactatttacgcttccgcttgataaactctgaaatgtatcaacttttggtgtaccttgcctcctgggacaaggaataatacacgcacgtaaggaacgcccattgggttaattccggtcgtgacaattttcttgccaaaactcatttttgtttgaatcaacttttaaaatacctctcaattaggtgaaggaacccttttgaacaaacaaaaccaagttttcacaactaactttatagatttttactttttaaccaaaatagaattttgaagactattatagcatcaatttaatcaaaacacatttaagggatgcaaatgatatgagaagttataacactccccctaaatgagataaccaaaacattactcaagatcaaatttgccaatcaattaagcaccattaaaggatagacattatacacaagtaataacctacacaaggttaggatatagaaatttcaatgtaaatacttgttaccgagatgacattggttcttaatgtagaacaattattcacatccttgattccattttttgctcattgcacaaagttagttcttcaaggatgagttgagcctccaatgcacctccaagtacctaattgacaatctaagcatattttggtacccaaatcacgttgggtccatggatgttagtcacaagagatttagggacccaaatggcctttgtgctagcatgtagcgaactaatcaccctagtagcacaagtgccatttttggccttcctaagcaaattgtgatgaaatgagaggtttggcttaggaattttaccaatgggacaatttttaccaatatgtccctttgcccggcaattgtagcaaagttgagttttgcttttatcttgcttcttgacttgcttgttgccggtttgcctcttgcttgatcgattgctatgatcatccttcttgtgcggacaaaatccaatttcatgccccttctcaatgcaaccgtagcacttccttctgttgattcttgatgtctttcttggaagtgtggcttcatcatcaatcttgcaaggacaacttgaggcaaagtgtccctctttggtggatttgaagaacttgtgagcaagatcctcattcttgctcaacttcttctgtttcttccaagggcaatctctcacatgatgtcccattttcttgcacttgaagcaagtaatggaagctttgttcttgctttgatcttgccccttgctcttgttgttggacttgttatcttcttgatagaacttggtgcaagctacggttgatcccttctcaagcttcttcagcatgctttcacggttatcttgagaaggttgagcattgcaaacaaatccatgatcgatgtatttatcctttttccctacataatccaagtcacatgtagtgcgcagaaaaatatttgcttgagagcaacaagagttagcacatgtaaagtcaacttgaacatgaggcacataggattttaccgttattatgatcacctcatgagttacttctagcatggcatgtgaatccacaagatttccatgagagcacaaaagctcatcatatttttcttgtaggtccacatgcttgctagtgagctccacaagttgagctttaagctctagattttctttctccaaatatgatttctccatgatgcaagaatattcatccaagtgtgaagatgagcatcttggagatgtaaattcttcacttggccattttttcccacatacttctaccttcaaaagattagttcgacaagcactataggaagtagaagtatccacattgacgctactcaccatttcattacctttaatggagacatgtgttggtgaggaggtgaatgtggcaagactatcttgctcattggatagaatcacttgaggctctttacaaattgtcgatgaatttgagcactccacaagtggttcttctatagcgagctttgcctcatcacactcggacttgtcatatctctcctcgagtgtgttccaaatgagatgagcatcctcaagtggcatgatggattagaacacatcttcactcaaagcactaaacaaaatattagtagcttgagcattgagatgtatgcatttctattatgcttcaaatgatatcatttgatcactaggaggagaaatgctcacatctacaactcgctatatttgaggtcccatgaccctaaacacataaa

SEQ ID NO: 62159 - DNA, 1254 bp, Oryza sativa
  unsure (1)..(1254): unsure at all n locations
tcctccgtctcctactattacctctactttaactnttctcccttctctttccgctctcacccctccnttacttttccaacntccgcccccccccaagtgatgcactctatanacccccnnnnnnnnnnaagaaaaaaannaatncgggcgtatacgtcacgccgtcgaagaagctataaccaattattatagatctgcagttcaaaataactgcaaattagagaaaataaaagacgagcacagtttgatggaacacaagagaactacttgctaaagagaaattttacgatccttgataaaatacctgaaggtatcaagtttaacattacaaaatgtggcattccccggtaccatccgaaggatggtaaatttacccattgctaaatcttcaccaatgatccgtgaaaatctgtataatctgcatacagtccttatccttctcaaaccttgaaacctgtatgtatgtctaatcataatcaatctgcataatgtcctacttggcgtaaacaatgcgtggaatttatgatgttggtggtgtgtcattttgccgagaatttatttcagtgttttaagatttgacaggagagatttacaaggttgggctacaattacagatttcattgattaagttttgtccaaggttgaagggttgctttcacgaagacaggttgaaatagactcataacagggtcgttttctttccgtctcttttgtcagagtcacggctccaagtacgcaattcagttgaatagtaagctcacatgaagcttgctcgctcctgtcacttccagaaaagaacccaacggctaggaatagttgaaaccggacggggaaatcacatctaaattgggtgggaaaatttacccattcaccaatgagaccattggggtacaaaggaagaaaggatgaaacgcaattgggagtccgaattccaaggccacaaataaggaccggaacttggaataaaatatttttttgcgcggaacacggaatacccattccaagggggacacccttgtgcaaaaaccaaacgggaaataggtccggggggaatcggcacctaattgggggaattccccccgcggaataaacaattccgggagattaatttattttccaattaaattctctaaggagagaagaactggacggggagggggcaacaacacgggggaggaggattgaatgggaataaaaaagaacctcccaaaccggcccgggggcaaaagaacttgaacacctaaaaggagaggg

SEQ ID NO: 62160 - DNA, 1117 bp, Oryza sativa
  unsure (1)..(1117): unsure at all n locations
acgttagatcccctctgtanccncnnccnggncaactgtgtatctcttatccttatcagtgacctcaaatccatcttttccattccaaatggcttcacagtttccagataagtcaatgtacttgttcaacttcttcaagatatttggacatatcctacctagccatccttttgctttgctcctgttctgttgtatcctgacataaaccttggtccttatgccctcaaacatagatatgattggatgtgccctgatgtcaattatccaattattgaagctctcacacatattgttgtctacactatcacaattggaccctatcctaaaccaagctctactccagtgcataggttcagtgctcatcatgtccttggcaccagcaggagttagctgtgcaagcttggctctacaaaagttgaaaaatggtctacaagatgccttggcacacttccaaaatggcttctggaatgcttgatccctatacttcttcctccaattagcatagatgtgtctagtgcacattctgtgctcaatttgtggcaaaaattcctcaactgcacttacaagtccctacattggtaaacgaaacacatgaggatcaatattcatgtatttttgttgatcatataaaaataagtagatatcaaggatgccttaccttttgttgatcaaaaatataacccaaccagctccatgaggaacaatattcaaatcttttttgaaggagtccaataaaccaactccaagngtcttttgtctctttctcgactactgcccatgcttattggatacaatttggtttgttggggtctccttctaatgcacattagaacttaaccatttgcagcaccttttgaaaaaccacccatttaatcctataacttttctggatctcaactataaaacccttctttggaggccttaaaacatacatatcattttttgtgaaaaacggccaattgttttttgaatccaaaaaatagccccccgctacacgaaaaatcctaaaaatttggttggtgtctaaacactttaaggcctccccctccagcctcaataaaactcttatgaaaaatcacctgattcttaaattgtggagggcccactcgcaacattt

SEQ ID NO: 62161 - DNA, 12642 bp, Oryza sativa
tcacctaaccacatttattgcgatttggctgagcgtgtcacgccgcatgtaacgcagtgtagtgcactcatttatccggtctgtgaccagtcacagaccggtcagatcgcgggttaggtggcgacaggcgatttgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgactccggtcatgtcgtcagcagacagtcacgattccacgtcgcatctgctcccggcgaaagtggaggtagttgtgagccgtcccatcagaaggtgactcggacggcaactatacaaatctccgtccatttatgaaaaggtaggggaagtccccacaaaaaaggggaaaatggtgcatgtggtatccccttaagatataaaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcaaaatacatctcatagtaaaaccagataaccaaagcaagtcataaatcaaaagttcaaaattaaaaaaaagaaatattggtagctagccacgcaatctacgtaggccaccatgctagttaacttaataaagtaacagaaaaaggagtctccacatttgctctcatggtctagaaattctcacattaatcaaaagaaaataagagaaatagaaaaatcgaaggagattaggattaggtagaaacgaaaaaaagaaataaaacatctcacgacacgggaaacagacaatgtctttgaaataagtgtgaactggaatactcctataaaccaaatgtaatcaataagtactcgtcatgccaataaatacatctcatagcaaaacacgagataaccaaagcaagtcataaatcaaaagttcaaaattaaaaaaaatatattggtagctagccgtgcaatctgcgcaggccaccatactagttaacaacataatagatatatataccatgccaataatagattcggacaagtacaagttgcatagaaaccgtcaagcagcttcctcctcccagatatcaaatatacatacaaatgtcatgtcaatgcagtgaatctggttcctgtgtttctgactttcaggtgcaactactgcttgacgtttgtggccacccatcagcttacatgttctagctaagatgatcgagacatcaacgaaacagaagtcggcgaaacgtgagaactcatgagctgaacgaatcttctcttgaatgatcaatcagcagtcaaatgctaaataagtaggagtatcaaggaaactgcatccagatcagtggagtagtttggatggaatcctcttcttcgagatgaattaatgcattgaatcttttgtttgctgatgtcatcaactgaatctgaaagctctgccagccagtcgatcacctttgaattaatctttcttcacacaattgacctgaaacttcagtcaataaaaactgtatttcctcgtaggaaattaagcatcactgttgtgtgatggaggtcagcagttctgaatattcggtgcagtgcaacgaagctgatcaaccacacatgccatgaatatatagtcaagctttcaacgagctagctacgacctggcttgctctcagatcgatcgacaaacttgaatttgtaaggttttgggtggcgttccgcggatcggaaccaccaacctattttggaatccaaccgtctctacttgcgtaaattcaaagaggatctcgttgattttggttggacgtatgtgtacattcaatttacccgatgatttgtgcaagcacattttcaacgttgctgtaagatgcggtcgggaaaaacgaatagtaacagctgatcatacctaagacttataatttaattttgtcatgtctgggaagcttccaacatctagcagttacagcgctttcagaacctttagcccccaaacagtttacatccttacgagcaagatcatgataaaatgaaatacatatacataaggatgtaattttaggggcacatgacgtcgagtttgcccagggccctcgggccctcgggccctcgaaaatatagagtcggctttggtgggtgcatcacttgaaatccttgttcattatccatgcatagatctgaattttgaagtccgggtaatgaggtatttcttatttttagcaatggactgcataacaactacacagattgacaaatcccacagattcttgtgtaaaatcaaaggtgtttttaattattattctgtgatgaacaattgggcattggagattattggttttgttatttggaatttattcacgaagtggttttggagatgattggattcacatgtgatcgtaggattcaatatgttatgtgaccagtcagaccgggctctggtagccggtcggaccggcggcatgcgcgcggtcagaccggccaacccgcggtctgaccggccgacactgtgtcggtttcggtttcgggttgtttgtttggatatccgtgattattttatgattatgacttctagatggatactatacgtatgtaatactgttgtttgctactaatgaatcaagttggagatagcttggtctcggaatatggtttctttgtttgttccatgtgtaagtgactcgatgtctcgggagagtatttgcggtgatggaccgagagttggcttggggataagaccacgtccgtggtggtcagagatcatgcaggatacttaggctagagttgatgcacgtggttgatggagattccatatggcatacgatggagttattgtgtgcgtatggaatgcggagtaaaatttggaaggagtccaaatttggtacgattggttatgtaaagtttctttcttgtactagagggtttcctaaggtatctaggactcttagtatgagtttagttcgtggctttaggctgcctacctcatgtataaatagagggggagcgtgaggcttcccggtatcgcttttgagagcaattgagttgagttttgagttagggttttgagtttactcgaaatttttgttaggagtgctgttggtgcactttgtaaacacagagagaaacaataaagtcattatctactttaagagtttttcgatttgtgtttaccgggtttcggcggtcagaccggcgggagcacggcggtcaaaccggcggccgcgacagcaagcagcagctgatctcggcggtcggaccggagatataatctctttcagaccgacggcaaccaggcggtcagaccggcaggacaactttggtcagaccgcgatccgtcgatttcgagggcaactttttttccgctaaaagtttttggtttttgggtatactaaccattcattcccctctggttggcttagttcttgtgattcgatcctacagcttgatgacatataacaacgttgctaaatcatcctagcacatgccaatccgtatgcttatatattaattcttgcatatccacaaaatcaataagaagggaatataaatctattaattaactggacagaccctccatcgttataaaatgtgacaagttacccattctaaggaattgttttcgcatgtaaactgatctccattctcattgatatatttcgtccttaatcagtactccctctgtgttatattacaagtcgttttttatatttgatcaatttttttagtcgtttttttatatttgatcaagtttatagagaaatttagcaacatctacaacgccaaattagttatattaaatttatcatttaatatattttgataatatgtttcttttgtgttcggaatgttattatatttttctataaatttggtcaaatataaaaaagtttgacttgagaacaagtaaaaaaaacttataatatgaaacggtaacttataattataatatgaaacagagggagtaggtaaccctaatttcttgggcatgacttaggcaaagctgtcggggcaaaaaaaaagaaatgatggttgcttcgtagagagtagggtagaattacgtagctagctcccggtcaactataaatgtctcgtccttcacccgcaatattaatgagcatgtcatctttccgtttcaaatcatgtacacttagagtagcctaattaaccttccaaaaaaatgatttctccgggccatatatgcaaaggatccaaaatattgttttcttctatgtattgactttttgtatcggtctttcgaagttgtccgaatgtttgctctttgagaatacgataagcaaaggccgggattgattcaattatctaaaatcagtggcgaagccagaagggttggagggaggaccaagccgttgcttcccctcgagaattcactcataatcacgttgattatgtgatggacttaggtgtattaggcctactttgacttagcaaaccattttctagcatgcatgcttggtttggcatttgcctctattgttaagcacctatttgccaatgattttttaaaactttttatatgcaaaaggttttttttttcgaactatcaacccaaacattttattatttacaagaggattgaaatcaatatttgcttattattatgttttatcatctattcttatatagatacaatccgccaattgcatttaattgcaacaaaagagctgtcgcatttagccgtgtcatcaaacgtatttgcgattggattaaagtgtgtatgagttatcaaccattagatcaatgtttcttatagtaaagtagtttaaaaaccccaatgcaacgcgtcatattcactattgtttttataatcgttatcactcagcaagttggccttcatcaatatcttaattctggcttagccactgtctaaaatatgtgcaaaggatctagaagacctaacaacccacatgacaacattcgtggatcacgagaaccaaaagatgctgtaaacaaagaaataataatgcaaactatacatgtgtacgtatgtcggacataggagacatgaaggcagcaattgtgcgatctttcaggaattgaaaattacatgttttaatcttaatcaactaccattttaacaaattaataaatataagctcaattggttatgtttttttatagtgaaatcgtggctagatttaagttctagactcacaagtgcttacatttacgaataattatttttttagtgacaggtgacacatcagtcgatggtgatatccgtagtgatttcatcaatctcaagatatattggccagtctttcaaaaatgaaatgttgttataggtaggatctacgtatatgttttcatagtagtgagcattcacacgttgtgagcggttgtgtttatgctgtgtattaaaaaaaactaattagtgaaaatagcaactgcaaataaaaatatttcaaggcagttctgtgcacaatggctcggtgcctggcaagggattttggagtctgcttatttcagctacgggctgtaagccaaaaactaattttaaattttagaattatttttagtttttatgttgtttttgttactcggactaaaattaattttctttcatcagttacatgtacatgtcataatttaatttaaatcttggccgagaacaccggggcgtgcaggttggatgacagacaccggtgtttggcgggtcgcaggagcaggagacgacagacactgaagcgtgtttgtttaaaataaaattgagaagctgatgcaagaagacaggaacaaaattgttgcttgtgcccctcaattaggccgtgtacaaaataaagagtccgaggtggactcttaatcatttagagacgaaatagtaaagaccattatttttattaccattctttcctttaattttctccattctcatgcaatatgattaaattttaagagtcaactttgagtggttgttatgtgtagcaactattttttcttttcctttccaatctctttcatatcaccaaatttacttgcatgataacgaagagagcccgttattaaacatcgttttacatgctctagtttcaatcgtatatatatatatatatatatatatatatatgatgaggtcaataataatatgtgggttcaaacttttcataaatatattagttggaatctttctattttaaggcatcaatgagttatcccatccaaagattccccagcttacgctctactccatcggtagtgctttgcaataccacatttagcttgaagtattgccagttcttagttttattttaacaccaagtcttaatagagtattagcaaattggctgaattgttttgttatttagtgatgatcagctaaccaactaactttggtcagagttgtggctagtgagtctatattttgttttctatcgtttacctgagtcataagctagcgcgtttttgtttcgcttatgtttaatataaaaaaatggcttataaacaatttaaaaagataatagtttatagaaattttgcatacatgttcatagcaaaataaaaggaaatgttaaaaaataaactatgatataaaaaccttaaaaccaactgaaaattaaaattaagttttaaaatttaaattcccgattatgcatataagctaaaggctaaaggatgtggatgcagaatttagagccagagaggaggtgcagagaggagggacgcccaatatttctattgccaaactgaaaaccctaaacgcgagccagatcgatcacaagtgctggaagggactcgtaatgcgaaacctaagattggcatctcaaataagcaaaagaggacaaatcagaagaaaagaccaaggtggtttcagtggcatctcaaaatgcttaattttaataccaattatgcataagcaagaaggtgatctcgtaggataaggctcactttacataatttaggctcttaacacatagtacatactaacttttttaagttcaaatatacaaatataggtgcgtcatcttaattgggtgtttttctgataactgcttggagaggttgctgatattttatttatattgacttgatatcgtggaagagtaggtagaaattcaaaatcagcgtgctcatcgtccttactatctctaggacggcctgtgcaaaataaggccatactacaaaaacaaggacaagtccttggtttaattcatagggatggtatttttactatgcatggttctgcctctcatagtgttttcttaaaaatcctaatgcatggttctgcctccgagactgttttcttttttttaaagaaaaatcctaatgcagattccagaaggaaagttaaattgaggaactcttagtagcagagagttgacgaaatgaagcacgtaaaataacaagttaattgaaagcccatgttaggagcccaacatactgcagatgggccagctcagttgctcaaccaagccacagcccaatcaagtcaaggaatgcaatacaaaaggcagtagcagcaagacatccaagtatcgagcagatcgatcagaacgacggcggcggcggcgatgtcctggttccgggctgaaacctcggcgatctctcttctctacatctcctcctacctccagcttcctctccaaggtctataagctttcagaacttgtattccatagtttcttcctttcttttcccccaaaacaattgttacttgtatggtgtatccttgctattgaattggaagaagtgggtttctaacaatctggtatcagagctgctcggttcatgggatctcttgtcatggaggtgttgggatgacagcaaggcaaggtgggggaagattcaggcaagggaggtgctcatggcattagcgcctgcaacctgttcaatggaatgtctagtcagtatgaggtgtccaaggaagaaattcttcttgtcatgaatgagaaggtaactaaggaagaggcactgcatctaatacaagggttgagggatgccaagcgtcgaatagatgagaagctagatcgattattggagatgttcggtgtaaaggtagacggggaagcaatggggttgaggaattcaatgcctctactaaggagctcaaccccaacacagaggctgcaatatcttcatcaccccaggtaacacgttctccgatgcccaccaagtgttcgacgatttgctccaaccacgacaccatgcctcaccgtggctacggtggttgcatgcgccactgcttctgtgtcatccatggagttggtggttagtgaggacgcaatctttgatccctacattggcatctctaaccatcctaaggagacgcacgccaagtgttcaacggtcgtactcaatagcaacaatggcattgtccagggtgtgttcccactcttgcttggcacactagacattgtttcagcaccggggaagtccacaccagtcatggcattgaagacatcaatggaagatgtcaagaattgtccagggccacatcctcccataatagaatcgagagctagtagatgtgagttacaatcagcaccttggccaacaaataggactggcaccaaggtgcaattgatgtctccatggccacaccccaagcaaatggatgttattgtcagcaatattgatcttcagccaatgccatggccttcattcaatttttatttgatcaaaggtcatcaggatttctttgatgcaataggagaatcttatcatctgcttgctatcaaggaactatggaattattctttgcttgggatcttactgtgcacgagaatcagcacaaagagcttacaacttgaaatagcaagtatgttaatggagcttgtctggtttcaagaaggagaggtgctacagtgattctatttgactggaagaagtggaaatttgtgaatcttggaggatatattgacagtgcaattcctatcatgcaaaggtgcctggctaagcaaaaactagatatacatgtagggctgtcaaaaaagctcgaggctcgtgagcagctcgagcttggctcatcctaggctctattcgagctcggctcgagctccatacgagccgaactcgagcctgagcaaaagctcgcgagctttaccgagccgagctcgagcttctactgagcctggccgagcttgactgtgtataatttatattgcatgttcaccttattaatataataaactaatagataaatatatatatatcactatctatttacaaaataaattagcatgtgttagcacaatatatttattttaatcattttatactcttttattagtgtgattagctagaaaataattatacttatcaagatattattattaaaatatatattatactacttatggccgagctcgacaccgagctcgagctcgactcgagcttgcctaaaagctcgaaggtgcaataggctcggctcgagcttgtgtcgagctcgagcttaggcaaacgagctcgctcgagctcggctcgttgacagccctatatacatgggccttggattgcaggtgatgagaatggttcacttgatttattttgggattgctggccccaatttttttcctttcaatggcagcaaaaatggattggtgtgcatgtgttcagttttgtgtatcctgaaggttccttactcttggttaattttatgcaagatgttagcaagaatggcataatttcttatgacattgaaggaattgcagaatgtactcaaataaggtactttgcatcattacttcttgatattgcaatattgcccacagaaataatgctcacagtaaggcattgggcagtgcatttgatgctgccatggcctccaccccatgagaatagcattgtgctcttgattgatgtgcatgcatttgccaaattagggatagcaaatatggttgaagcaaaggaagaaatgaaattatttgttgctaagttatatgtactggacctgagttgtgcaactccttctattggtcactttggaaatcatggtccctttcaactcttagtgtgcaagatttggcctcaattcctgttatggaagatatggtcctctgaggcagaaataaagctgttaattgttgggcatcctaaacagtacatcgaagacacgattctggtgttagtggaagttagtttgtatgatttgggtggtaattgctccttctttgaggcagaaaggggtgtactcactggtaacaagcatttttatggggtgcagttagaatttctatctgacaagctggtgcaactaattttgtctcttggagaagtcaaggacatcctttttataattatgttgtttttataattatgttgagttgtaggggccagctaccatgtaatcattttggtcatggaattggctttgcaaattctgagactttgagcagcctgcttagtgttagaattgccaaggttgggtggcatgagaagatattaagtgaagggagtatgtcttctattactatgacagcaatgatatggaacatgcagaatgatatggaacatgcaggagcttagaaagaaacatatgctaaaaattatagatgcttgttatgaaagttggtccacaaggaagtggattgatgtgacaagaaaatggctgcactggatgctgggaggtggtgaacatgcaagtaatttcagttggtatctttgttggactttgaaagttgatattaagctgaagaaattattgcaaggggcaaacaagattagcagcaagctcaaaaatggaggggacatccgtgaagcttttgagcagtaaaaaatacaagagaaatcaaaggtggaagtttcaaatttcaaaagttcacttgacatcaacttggagacaagtcgaatttgaaggagagggaatggttaggaactcaacaggctacacatgggccggctcagttgctcaaccaagccacagcccaatctagtcaaggaacgcaatacaaaatgcagtagcagcaagacatatccaggtatcaaacagatcgatcagaacggcaacggcagcggtgtcctggttccgggttggaacctcaacgatatctcttctctacctctcctctcagcgatctctcttctctacctctcctcctacctccagcttcctctcaaagtttccagaacttaacttgtattccatagtttctttctctctttttccccaaaaagattgttacttgtatggtgtatccttgctattgaatcggaagaagtgggtttctaacagcccatcacgtggcagagcctcggcgaaattcaaaggtgtgtggagagcccatttaatttcttattttcccctgttttgcgtcaaaatagtccctaacttccagagcttcgtcgctagtatctagcagtagcaggtgaaaatagtccaatttaattccctcaaacttgttcgaatctagtatcctgaacaccaaaacaactctctggcagcattgaaggtgtcgcacgtaggttgagggagttatgttggagtttcttcgtagcagagtacaggccgaaatctccctaaggtttggctgtcgtgcggacctcagggcccaggccgatggccgagcgcgcacgtcccttttcttctaagatcctctctctgtgccacactgccacacagcaactaattaccactccttaaccgtaaatactgataagcatgaaaggatttattttcacaactaattaaccgtaacatttgcatcatatacactggaatgtaaattaacacaacgtctttatttttattttctaccgcttgtttaaccatacaaaatcatcaaaacatgcgtgcatacatggttgatccacgaaacaaaacggcaccaaaccaaagatgtgtgaaacgaagcagcacacaagaagaagatcatggatcgggtgatgggctagtagaaaacaaaagcaccacgtacgtcgatcttctgtcagtggatgagtacagtaactagcagctagctagctagctacttcccttggcgtgccgcagccgcagcagcagccgcgtcgtcgggggtcttgtgggcgtcacggccggcgacggggtcgccgtgcccgacggcgaccttggcaacctcggtggcgggcgtgccgggcctcgccttgtggtagagcaccaggtagccgaggacgccgaagatgccgaggccggcgagcgccatggtcccgggcccgtacggcatccggccgcgctggtgtagcacctcccctgggccgtggccgcgtccgggcgggcgcatggaggcctccaccccggccgcccggacctcctccgcgctcatcttgtgcgtgtcggtgttgcgccgccactcctccgtgccgctcttcgccatcgcgtacgtacgaattgcactctcgatgtgtggttttctcctgg

SEQ ID NO: 62162 - DNA, 72402 bp, Oryza sativa
  unsure (1)..(72402): unsure at all n locations
aggagcgcgtgcgcgtgcgtgcaggtgctcccctaggcccaccacatgtccacacacacaactccattgcaaaaaatcacccacatattttagaaaacctttattaagagaattcgtttcattttttgttccacctagtgtactcacaatatttcactatgtataaatataatgttgtagtgaactgaaacattcttttgcaacaaatcacccacatattttggaaactctctgttaagggaattcatttcattttttattctatcaaaaatagttcatctagtgtactcacaatgtttcactatgtattagatataatgttgcagtgagctaaaacattctttcgcaatttacaaaaatattgtttttttataaggtgaaacaacgtccaatttaaacgattgaaacattttcgatcacttagtgaaacaattccgatatatttggtggaacatcgtgtaacatttaataataattcaatgataagccaaaaaattttttgtcggaatatatccatgtgtggtcttgttttaaagatttaattgcaatgaatttaatgggtcaatcggattatgatttggatagataatttaagagaaaaattagtttaaagtggttttgcacgtatgcgtagcacccgatttttacacgtatgcatcagaggcctaggcctgatcagtagccccctccgataaaagacgttatcaataggtgttagtttgccgttgcaggtgataaatctttcgtacatcacgtgtgccgtattactgctgaaatatacagagccaatatacggcaggcgtgctggcacaccctggcaggcacgatcccaggccgtccggctcatatgcatggctgtatgcggcctacacgtagatacgtgcaatcgggcataatggattatggacgttactagacaggtagtggtagctggtttgtctaaactagctaccactctatctatgagagatcctatccacctatattttaaataaaattttctcttaaactactcatccgatctacgatccgattacaccgttgtgttcgtaacaattaaatctttctaacaagatctcacataattatattttgatgaaaaattataaattgcttttataatatatctaaatcacttttagctttcactaagttacttcttagacatataaaagtaaatttaataaagcctaaaagtaattacatatattatattatagaagtaacttttataatatatatgtaaattacttttaaagttactaaatttacttttatatgtctaagaagtaacttagtgaaatctaaaagtaatttagatatattataaaagtaatttatattttttcatcaaaatataatcatgtgagatcttgttataaagatttaattgttatgaacacaacggtgtaatcggatcgtagatcggatgagtagtttaagagaaaattttatttgaaacctccaccacatcttaggaaacctgccacgtctgtctctctcattctctctttgtctctctttttcttgcacgctaatggatgaggaggatgacttgtggtgggatggctaggacggttttcctggcgtcgagcgatagcgccagatcgagaggcctcttgaaatagtttttgcgatggattatccgttgatctcttcttggtttagcaccggtctgcttctgctgggcttgctagctactatctccgttttaggttataataacgttttgactttggttaaaatcaaactatttaagtttaactaattttatagaaaaatatagtaatatttttaacccaagataaatatattatataaaatttagttatgaaactatgctggtgtagtaaatattattactcttttctaccaaattagtcgaaccgaaatccacaatagttccggttccactaaaaaccagcactaaaaaggatctttagtcccggttggtggctacaacgggcatatgtaatctttagtcccggttgttaacaccaacgagtactaaagatcatctttagtcccggttctaagcctgtcaggcctatcaggccccccgggatctttagtctcggttggtgcccagcgatcttcttcctcctccagcccgagcaagcttcaaaatttctccaaaaaagaggggaggtcataccaaaatttcttgtgaaatttttgtggtgattatatataaatcggaggtgtctagaaggatagtaacttcatcctccaattgtttttttttgttatattacttttggagcaatgtttcacacatttttttggtctccaaaactttgttgtaagttgatgagagagaaaatttgtgtggggaagaagaatatatagaaattttgtttgtttacttaaaaaagttttattctctagcttaaaatataatgaaaattaatcttaaaaaaagaaaacaaactaaattgaaaattaaaagaagtacaacattaatattagtttataacttcaaaaataataaataagaattgtttgttggattattttataattattgtatgaattatgatatgtcattattgtatgactgttgaaagagtttttaattattttatcattattgtgtcattattgtacggaaatttatttatgtatgatttttttcatttcatgtagatggatcggcaatggatgtatgttgaccggcggtccaaagagtttatcgatggcgtgcattattttttgagagtggtcgaagctaacaagcataaggattttatttgttgtccatgcaataagtgtaagaaccagaaggagtattctgcatccaggactattcatttccacttgtttgagtcgggagtcatgccaagctataattgttggaaattccactgttgacggtcgttatcgatcagttttgaccgtcaatattactaaaataaaggagaactagtaatgcttgcaatgcatatatctgttagaataataaacttccactagtattaggtatactaacctcttgcagggaatgacactaaagtggaggagaatcgacatcaacatagacgataaatcaatcggacgatgtcgagaaccagacttgtgtatgaatgggccaaaaacgcagacttgacacgatgaatcaggccaaaattcacaagtctacgaagtgaagcaatagaggaggtagccagccgaagatgggctggtttgggccagcccatggttcggccgaacccccatctccaccgttgaggccagggtttggcatggacgtccaagattgcaccccaatgacggttagagggtacttcggacaattccccttccacaaccgtcataaccacctctatataaaggcttcactctcttcatttcaacacacacctcaagcaatagctctctcatttctctcaagtttagtttagtagtatctagctggtggaatagaaatagaataggagtcaggagtccggaaaccttcggaagagttcgggtatggctttagcagctttcctcttctcttttgtaagctttgtacttttattagaatactcttctatatacatttatggtattgaaatacttttcgagtatatgagtacctactttacattatgttcatgttatactgaatatacggctagcttatctgggagatgctttagtgcgggtataatgtttgcttatgcaattactctatgtcatgacgatgatattagagtagtatctggtagattaggcgtggtgtctagattacgggatatcattatttggggttatatattgcggatgagaggtgggccgctgatggtgacagctcagtacgggtattcctccgcgccagtatataatcctaagttaattttctggggagggtattcctctgtatttagccccggttgtatggtcatgacaggctgtcgtaaggaactcggcagtcaggggtggcttctcgaagtatcaggagggcatcggatagagggtattagctagtatatcagttaactagaatgtatgtatactatgtatattagaagtataggaatatattttctttctcttttctttccacctagcttagataatttattatgagaatgagttgttaatgcttgtgtctcactctacccttagattatgttaacccctgcttagaatatgattatcacaagtaatatataaattattagttgagttctctctacatgatcttcccacgggataaaataaatacgatactgacggagctcgtggctcctcaccgggagaccgcgcaggcccccctttgccggttcggccgggggcttagggtgagatctcaagctctctctgtatgtggaaagatcgcgtgccaggaagaaacgcgagacacggacgatgtatacaggttcaggccgctgggaagcgtaataccctactcctgtgtttttttggtggatctgtgtaagagcaagttacaaaatatcaaccagccctctcctctcccgggaaaatccaaaaatcccccccttctctttgtgggcatggtcctccttttatctcttaaggggataccacatgtacccttccctttttaaactggacttttcttctttacataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgccagctccagctggggacgagtgcctagaggctctcatcttgacgggacggggcgaggcgtgagtcagaccgccagtcgccacctaaccgttgatctgaccggtctgtgactggtcacagaccggataaaagagcgcgctgcattgcgctgcatgcagcgtgacacgcttaaccagaccgcaataaatgcggttaggtgagccctaccatgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgattatccttctcaagggaagcggtcgggcatgacgccactcataaagcctggtgacaggtgggaccggtctccgtgattgggcagaaacccaacggtctcaaaccacgcatatcggtaacggtgtctgggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccgggctcagcgatgggaagggtataaagccatcgaggaaaagacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccagtgttgaatcgctacatcccctgcgccctccgcaagaagtgggacgattggaagagcgactggttctacaccccccttgccaacgaagcgcgcctccgactcccaagccagcccccggcgccggtctccagctggcgggcgccagtagatctgggggatgactatgacgccgtccttgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccatggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgaggggacggggcggtgcgtgccagccgcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccttcgggtgacgctcaggcgacaacctccggggcggctcgcgacaaggccgtgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatcttggagcttgaagcccgcaaggcggcgctggcggagatcgcccgagaggtggaggaggagcgagaggccgccctcatcgccaccaccgcgatgattgaggcgtaggactccctccaccttcaacacgggagctgggaggcggagctaaagaaaaagctcgacgccgcccagggggtccttgacgccgccgctgcccgagagcagcgagcaacggaggctgaagcggcatcccgacggcgcgaagaggcccttgaagcccgtgccatggcgctggaagatcatgccggcgtcgtggagatcagcttggcggaccgcgaggccgccgccgctatccgggaggcgacgctggcggcacacgaggccgcctgcgccgaagaggagtccgcgctccggcttcgcgaggacgcgcttgctgagcgggagcgagctcttgaggagtccgaggccgcgacacaacggctggcggacagcctgtccctccgcaagacagcgcaggaggagcaggcgcgccgcaatctggaatgcatccgcgccgagagagccgcgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgttctaccaatctggaaggcctcgccccgcaccttaggaggatggcctgggctgtccaacaactccccgaggagctcgagaagaccatcaagtcatcctcaagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattggaatgagcccccaggcccccgccaatcttcaattttttcattttctttcttctttttgtatagatcaacttaatctgcaatcaaaaatgatgaaaaatctctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggccaggacgtggcgctgatggtagcgccgcaggctctgctggtagcgcgcggctcggagggccgcgcgccgccttcgctcttccaagcagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttagcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaatcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaaagtgacccccgcaccggcaccctggagggacagagaaccatcgaactgcatcacccagtgggtggtgtgaggcagctgcgcggagttcgtgctggcctcggggattgagacggtctctggagccggggtccactctgccacaaaatcggcgagggtctggctcttgatagcgtggcgtggttcaaagtgcagatcgaactcagaaagctcgattgcccattttaccacccgtcctgtaccctctcgattatgcaagatttgaccgaggggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctttgctaggggccgtatccccggggcgttcttcattcaagtggcctttcggggcgcacttgtcttctgtgccgatgacctcggggtcggaggatgaaaggggcgaccttccctcagtggcctcggggccgtcctgggggttgggggctcctggcatcgtcggacaagcaggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcagggcccgtaggccaccgtccgactcgggggcctctcctccccgctcgctcccgggccaagttagcacagaatgggggtgcacgaaatgaggattgttttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcacttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgtgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcacacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcagacttggcagaaacgctgaatgtacgagcgaagggattcatcatcccctcgctgtactgcgtgcaagtccgcttcttcacctgggcgtggataagtgccttgaaagttcatggtgaactgctggcacaaatcctcccaggagtggaccgacgcgggtggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcattcggctctccatgccgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccactcacactcggagagaggtcgtgcacctttgcttgcttggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcgtgccaggaagaaacgcgagacacggacgatgtatacaggttcaggccgctgggaagcgtaataccctactcctgtgtttttttggtggatctgtgtaagagcaagttacaaaatatcaaccagccctctcctctcccgggaaaatccaaaaatcccccccttctctttgtgggcatggtcctccttttatctcttaaggggataccacatgtacccttccctttttaaactggacttttcttctttacataaatggacgtagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgccagctccagctggggacgagtgcctagaggctctcatcttgacgggacggggcgaggcgtgagtcagaccgccagtcgccacctaaccgttgatctgaccggtctgtgactggtcacagaccggataaaagagcgcgctgcattgcgctgcatgcagcgtgacacgcttaaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagatacccttggaatactctcgggtgaaatgttacaatggtatatctgtgcgcttgcgaatgaactctgtaaccataatataccaggagtatttctgcgccattgctaggaattatatttctagtaatgacgttaagaaataccaacacccacggtgagcaaggggttgaaatggaagaagatgcctagtaaaaaaaaagaagaagatgaagtggagaacgagaacattccgaattgggctcagtacgctggatttgaaggaaatcaaacgggcgaggtggacagggatgctgacgataacgacgctgcggacgatcttggtcagatgttgtaggacgccaaggaggactgtgaaagtgaaaaggaggcccataaattggagcgtatgttagaggaccacagaacgtcgttgtacccaggttgcgagcaggggcacaaaaagttcttgcaatggaaggcaaaaaatggtgttagtgacaaggcatttggcgatttattgaaactcgtcaagaacattcttccggagggaaacaaattgcccgatacaatgtacgaggctaagaagatagtctgccctctaggactggaagttcagaagattcacgcatgtccgaatgattgtatcctatatcgcggtgaggagtacgagaacctagaaacatgccctgtttgtaaagcattatgatacaagattagacgagatgatccaggtgaagttgacgggtagacaacgaagaagagaattcctgctaaggtgatgcggtatttccctataataccatggctaaggcgtttgttcaggaacaaggggaatgctagaatgatgcattggcacgctgaagaacgtcaacaggacgggatgctgagacaccccgccaatggttcgtagtggcaaaacatcgacagaacatttaaagactttggaaaggatgcacgaaacatacagtttggtttaagtacggatggtatgaatccttttggagagatgagcagcggccatagcagcccgttacgatgtgtatctacaacctccccccttggctatgcatgaagaggaagtacataatgatgtcgattattattcaaggccccaagcaacctggtaacgacatcgatgtgtacctaacaccactggtctaagatctgaaactgttgtggaagaaaaaaggtgtccccatgtgggacgaggacaaacagtaggagtttaacctacgagtgctgctgttcataaccatcaacgattggcctgcacttagcaatatatccgggcagtctaacaaggggtacaaggcttgcactcactgtatggatgaaactgaaagtacgtatcttaagcactgtaggaatgttgtgtacatgggtcatcgtcgattccttgctgcaaaccaccctgtacggaagaaaggcaagcactttgaacataaggcggaccaccgtacgaagcctaaacatcgcagcgggaaaatagtgtttgatatggtgaatgatcttaaagtagtgtttggaaaggggcctggcagccagcctatagagagtgaagatggtcacgcggcgatgtggaaaaagaactctatattttgggagttaccctattgggaattcttggacgtccgctacgcaatcgatgtgatgcacctcactaagaacctttgcgtaaacctgcttggcttcctaggtgtatatggaaagtcaaaagatacactggaagcacataatgatctaaagcatatggaacaacgcggcgaccttcacccggaaccaaaggagaaaggaagccattacttgagtccagccagctacactcttagcaaggcagagaaggaaaatatgtttgaatgcttagagagcatcaaggtaccgtctggatactccacgaatataaagcgaataataagcacgaaggagaagaagttcacaaacctaaaatctcatgactgtcacgtgttgatgacacaactgctaccagttataattcggggtatccttccagacaatgtccgggcaacaataacaaagctatgtgctttcatgaacgcaatttcgcagaaggtcatcgatccggatagattagaagcccttcaaaatgatgtggtgcaatgtcttgtcagctttgagttgatatttccaccttcatttttcaatataatgacgcatctgcgttgtcaccttgtcaaagagatcggtatggtgagtttaattttaaaaagaattatcacatggaagatggcgagtgctccgttctttccggtggcgatcgtcggccatggcgatcttgattcttggcactagctcttctgtgcttcttcatgatgaaggaggatctgataactccctctccgctggggggttggaactttgatttcggcaagtcttttgcttctcaagtcttggatctttttggttgccctgtccatttttctccttatttcagttcttctcctttcattctggttgtggattttgtccgcttcaatttccgtttgactgtcaagtcggttgctattgctctacaagcttgtctgggaggaagcccccatggttttagtgtgctttctcttaaagctaattgtttctcattccaagtctgtaacaagaatgtcggcctctatgtcaactccttccgggatttcacttgcaaagattttcatgtccgttttttcttgtggggtaatggcggtccaaattggaggagagaatttgatctttgggagaaagaggagaatgatctttggtcagttgtttcttacaaaaagaaggttcagcattctgtcaatttgagggctaacaaagcagttaagtttcagattaatcattctttgggcaaaaggcagattgataagccatcggttttcaagagattattcctaggggatcctttccctgttcatcagtgttcttcatcaggtactgttgttcctcctctggtaattcagcctggctcggattcaaaatacattgctccttcgcctaagattgcgcattccgttacttctgttattattcctgaagttattgatcattcaagtccgaggatttctccttcggctagtttgaattctggacaatctagagagtctttgttttgcaatcgatatttggcccatggtcatggcccagccaattgtcgtagcttgatccattgccggagttgttttaactatggccattttgctcgtgcttgtctggcccaaaaaccgtctcgtgtctggagggttaagcccttttggaaggccgaacccagtgggaacagtgtctttgtgagcagtgctctatttcttttggaaagtgcctcttcgtctctgccagtctcgccccccccccctcctcaatttccctcctctgcacagtgcttgtcctctcctcgctgtaaaaccccattagcgcttgtgctgccttcctccagggcgcaccttcacgatgctgacttccggccggagttgtttctgctggagggaacaaacattgaggtcccgtgggaagggcgtacccctcgtgcggacctcacgcttcaaggtgttctccccaactctcaccaagagttcgctgccgttgttgttgatcctcagccgccggagcacctttttggccagttgattcaagaagtggcaaacatcatcgagcatcagcatcacattcatgttgttaggatccagaggtatccccttgctctgtgccttgttcagctaccttcggttctggatagagacattcttgttgccagtggtccggttctgctaggtaattggttccatggtactttcgttaggcatgatcagttagctaactggaggaactcgccatacaccagggagggttggcttatgattctgggcatcccgcttaatcttaaaactggggctattattgaacggatcactaatctttgtggggaattcatagactggcactatagagatagagttctgggcagagtacttgttaaagccagatacaaatctgctaatgaggtgccaaactgtattgttctgggggatactatggcttatgggggcaatggtcaaacatggacctttcatgtctatgtgctgaatggagaacccactgatatgctacctggagatgaagacctactgcccatttggcaaatgatgccacctcctcagcagcaccatcatcataataagcatcagcatcacaatgaggaagatttcaatgctaatcacaatcagaatgaagatattgggggacaaccagatgattttggagcagaaccagattgaaaagccccatgattcagtttcagttcaggatttcactctcgacctaactgtcagttcctccaatgagagagagtttcagaacattggttggcagattattccttttggtctgccaatccctgctttacctatcagaagtctgcttgatttgttctgtcaagctgttgcgaatggagtatttgcaccactgcttttggccttacaaccaactcttttcaggcccatcgtaatgtcacctaggtggtctctgactactacttcttagggagtcatgatcaccattccctctttggaattcatggacagcagcccaagccctatcaaacgctgcacgacaagtctgattgattcaagggtggtcaaggctcttcctttctctggggttgttaatgatgattctgagagagtgactgaggttgttgacaaggtggttcagcccacactactacgaaaaccatctttcgtggtggccattttgggttttcgcgggcggaaatcgcagccgccagaaagcaaaggccagtgaaaatgtcgattttcgctagcggttatttaccgccagccaaaatgcatcctcgttggcggccgagaaaggaacgcccgccagcaaagagatgtcttcgctggcggtagccttaggacggccgctagcgaagacatgtctttgctagcggcggacataacgcagccgccagcaaagaagtatctccacttgcgttagccttaggtcggccgccagcgaagataattcgttgttggcggctcacagtgttttaggccacgtggcacgctaggaaaaatgaagtaaggcttctgtggatggacacgtggcccgacagcaaagatatgtaccgtcctagttctggcacgtggcccgccagtgaagatgcaatttttaaaaaaaaattaaaacattattatatatactattttttcttttcttcgtgtgtgtatttcagagtcagacgtggttgatataactaatcgagctatcgatagagtatgttctctttcgcgtatcttagagcaacgcattgagtatatatgaagcagaataatatacatatatataaatattcggaagctcctatatatatgtacgttgacaaattaaatttgactgacgacataacatttacaagtattttgaatgaattagaaaactctagctatattatacgcctggtccagttaaacagggatttgttctccggcagggctaagactccttcgttgtcaaaaaactgcccaagctgatgtgcgcactcacggtggatgaagtagcacatgtccgcctgaatgttctgaatggatgtatcattgagctctctttcagacttggggaattttggaagctacatcagatcatgacagaattaaggaaattaactattcacaataatacaagttagcgactaatttaacaagtgtgtattacttaccttgtcgtaattcgcacaatatttcccattaacccttaggaactcacaacattaatatccacatagtactgttcccaccggttgcttgtgacactttcaacatcaaaataattataaggtataataggttattacatggaaacacacaagcatttatgaaaattaagtagtactgtttggcatccatatatatgtacttaccggccacttattgcggacggatatgcgttctcttgagtttttgcattgtccgcctcgctggtaataccttttaaatgcactgttttgcggatataattaatttacgttcatcagaggttaaaacacgccatgctaatatcttacttacagatcgataattcttagaaattcctgataggtgttgctatctttgtcgagagaatccaagacgatgacttcattgtactttggatagagaagaaagactatctaatggtcgctgcaaacgaaattgttagtcgagccatgattatatgtatatactcttagtgcatatatattacaacttactcaaaggcatatggggcataaacatactccttgtcctacgtagattcaagcgcaatagctacgtacgtagcgacatcgagcaccttttcaagatgctttggtgctatgtaagctttcctctcttcgggagtcatcgccttgatgtgttccggtaacttcttctcgtctagcgtgtatgtgtggttcggtttacttatcctgcacgggtttaggtaggcgacaggctttttcatcgcttcggcttccacgtaattcatcctgccacaatggatgatcaaatgagctacgcatataggtgtaatgatctattaacacgttcaagtgtagcacttacagacaccagatggcaatcaaattggcgtccagccgcttcctacagtagagggaatgcatatcgaagaaatggacttggagtagacaaggaccgctctagaagatgttcacccccacggcaactgtgaatgaatcgatgcctttcatggtgcttgccctaatgtaccaattgtgccatcttcttagttgccacggtccttctcttagttgccagtcataaatgaatggtttgccattctcaaactcatgtggcacgtctggggaattgatatagttgagatagtcatcgaaggtctgtttgaacccttttaattttctattatcaaattcggcatttatgatatctttgtcccttcctcggaatgccgttaccatataatgtttcttggacgcactttttgctttgtgcttgtgcgtccttaccatcactggcacatcggcacgcttaggttcctctggttgcgattgctctggttgatcgggcattggctgatcaggcaccgcttcaatttcacccgtcgctagctttgtaggctctgctctacatccttttctgtctgaggtgatgcaacgggaggctccagtactggaggtgatgcaacttgtggctctggtactggaggtgatgcaactggtggctctggtcctggaggtgatgcaactggtggctctggtctagagggtgaagcaataggactatccctcggactggctacgactggtggacgtgacggtgacaccggtatccttggtggacgatcagttccatccgttgaccctagttcaatatcattcttgtgccatagtatgaattggtcgacggcatctccaaggtacacaatctgctcagtagttggaaagtcgagctcgtgcatccggtaagcctcaatgaccgtccggacctctaccttggcgtagtcatccggaatgtcttggcaatgaaacctgtggcctggtatgaacctcccagttgcaacgagtattttctttcccaccctgctgaccggaatcaagagcttgcacggagtatcctccgttacatcatcgaaaggatagctcggctcaggctctaaaacagcagcaccgtgcttcattttctgactccagtatatattgcattcgtcacgagctgctgccctagcctgagttcattttctgactccagtatatattgcattcgtcacgagctgctgccctagcctgagagtcaatctcttccttgtagcgatcacgcttcttgtaggtatgagcatcctgtttgaatccatccttccagttagtctttgaggaaactccccgtacacggccagagtgctccggtttgcccaaggcataggtcagcttgtcccggtctctatctggcatgaacgtccctgcctgttgctacgtgacgatgttctttatcttgacagctacctcgtggagcttctgatccttgaatactacatccccctcaggggtgaaggccggtgttcttgcacgcacccagttcctgcttcgtgggttgtgatttttcataggaacgggtttcccagccttctccatctcttcatcttgttttgcccatttcttcaccgcttgctggtaattggtcgatcctaaatgatgtggatattcattccttcttgctagctcagccatcttctggctcttctccttttcttctgccgatgtcttaagggcaacgaactcatcccactgggcctgtgttatccttccgtagtccttaaacggcgtgagtcccttctggacatatttcttattttggtccgttttccagtttcaccacagcttccccattgtgttcaacgcataatccttggctttatcgtcgtctgtcccctctggatattcaaacttgctttgcagcgacgtccaacagctgttgtttcgactctctggaactttcttccaatctttccatgtgatctccacgatatccctgaccaccgccccacattggttgctatacttcgaacatgagtcttccggtgacaagggttcccctgtctcactcatccgcgttagcacgcttacttccttcaacaacatgatgtgaccatggctactatggatacgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggctgcaatcacagaagcaaggtgctgcgtcacctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggtttcttgggttttgatagattaaagtttagccattgctacttgcttgcagcgcgtgtgtcggctagaccgtccgtctgcttgttcttcggaaccccaacttatcatttgtattaaattcctatttgcaatatcagattgctttttatcttgttcttgcttgtttcttcgatttgcttgcaggaatagggttgatctgcaccggcaagatcaacaacccacggagaggtgtatcgatcgctaaggcgcaacacaatgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagttttatctacccataaccagaaaattgccatacaaaataaattttatcctgtacctagccattttgtgccattgcattgtttttatcagtttttgctttgttgagttttgtgttgcattgtcgagtcgtgttgctggtcttagcgtttagttcgtttagagtttcgagttctggtcacgtttcgtaccactgtcatcgcccccgccgtgtctttgttgtcgtcgggacctaggaaaacggaatcatcttgttgtcggggtttcgtttttctagttttcagaagtttttgtcggtcggtcttggagttgctgagttgcatcaagggtttgtcgtctgtattcggccgtgcttgtttctcttgcgcgaggaagaggagagaaagaaaagataacagatctgtttttggaggaagttttgcagactagatcaatcaggttggttagtttccatctaaggccaaactttccaaactctccccacgcgtgaagaccggttagcgccatctccttttgtcgcccactttagctgagtccgactccctccctctcacgtcggtttcgcctgttccgagttgtgtcaaacaccttggtgaatttttgtttggtgtcggtttcgagatccgtttcgaaaaacggaatcagtataaattcagcattccatttttgtataatttttaattttggtttggacttttacagttgagtccttgtaattttcatatttacatttgagtcccagtaatcttgcattgaggtccttgagttgtttttgcagaaaaaaaaaataaaataaaaaaaagaaagtaaggaaaaggcaggaaggtgcataaaaagaaaaaagaaaagaaaagccgcaccaaaaaaaaaaggagagaaaaaaaagaagaagaaagaaggaagaagaaagaaagaaaaaaaaatcagttgtatctttgagctgaagatgatctatcagagtgtgcctaagttgtttctagtgctatcctgtggtatcgcttgtgtctaggctcacgtctctagtacgttctagcctaggaccagcacggtacttgactttgaaccattattcaactttgcattctctgatttgaacatttgctatccctttgctacatatttaagcctacccagagctccacagatctgattgcagccgtacaacaagtgtttgccaaggcatcgatacatccaacctctattggggtgcttggttaagtcggtgtacatcaccattccgcttgctttggtaagaacttgtaagagcttggttaaaagcttgagtgtgtgtgatatttgagctgccactacctagtagttgatacgagcatgcatatttttgtgtgtttcttgtttgctactaaccatggcaggattgcgtaagggaatacgagaacatcgacttctacaccttcgacgagatatgacgacttctccaaatgatgcatatgaggtacatgactataattttgaacaagttgcatctaagttactcttctatgatgggaagtatgattctgttgcatacattgattgggagctagcagtagacaatgaatttgatatatatgatttttctgatgctcaaatgattaaggctgctagtaataagtttacctcttctgcattattttggtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatggtgatgtgcaaacattggaggagcaatcttttgtctcccctgttactaacgttttgcaggaagatcagcacatccaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgctattccttgtgataaagaagagttgtgtgataatgtttcacttatatccatgccacaactagtgaatgaacatgttagttctactatttctttgtgtgctgattctaagcatgttgttcacattgctaatgaagtagaagaacgcgaattgctatcttctttaaatactttgggctatgttcagtttgatgatttttgtaagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttctggataaaatatgcaagctagagagacatgttactgctaatcatattgtctcgagtttgtcttgttttgattgcaagaaacaggttgttttcaggggactgcgcgaagagcaccatatggaaaaaccgaggacggttttccgtgaagaaggggaggatgatgtgaccatggctaccatggatacgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggctgcaatcacagaagcaaggtgctgcgtcacctgtattgggccaatgggcttgtaactttgtttgggaccctggcccatgtggggcccatgtggggtgcgccccaatctggtggagcacgacccttggaccctcttggtcatcctcccacctctataaatagttaggtaccccttcagggtttcttgggttttgatagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcacaacacaacgtctcgtacggttgtagtcggatcgtcaacgtttctcccaaatcgtagttatcacaactcaccgaaagatcgggccaacaacagccttgagtgtcgagaggaactcagggttcatcacaacatgttcttccctcgctcgccccttcttttcttgggtttgcttaaagctgttgtgcgcacgacagctgtagcttcagcttcaggttcagttgcggcttgggctttccttttcgagcgacgtggagcattcaactattgtttgcaattaacgtgactttaattaaaatccatagttcgcagttaatatgattggaactaaacatatattatatgctaagtaccaccggttcggggggaacgtagtcggagtcaacttcattgtcgctaccgccctttctcttctttgcaggagaaggatgggggtcactcggcgagtgatacgatccactgcctggttcacttgagctagacgacgaagattcctccgcgactactttcgtgcaaatatcttcctccatgactagctgagtttccttgcccttgtcacccgtgggttgctcttggatgggtttgtccattgatatcgcttgaaggtgaatttatgtaagttgcgaaatggaatcattttcttattgtaaatccgaaaagaaggcaaaatttagatactaattttgtacaacaactataaatattgttatcgccagcaaactccttgatcgcttaaagcaatcaatgaaattggtaacggcatcaatattacaatccaccaaccctgaccatttcaaactacctaattaagttccttaattatcaaagaatgacataatacaaaatgcatggagaattatggtgtttaggtcggttctgtccatggactacactgaccaatccaccataattcgctatgcattttgtattctgtgatggtttgataacctaggaactacattaaatctacggccaatctatcaattcttccatttaagctacatttcaaaccctaaacctaattaagttccttaattatcaaagaataacagaatacaaaatgcatggagaattttggtgtctaggtcggttccgtccgtggactacactgaccaatccaccataattccctatgcattttgtattctgtgatagtttgataacctaggaactacattacatctgcggccaatctatcaattcttccatttgaactaaatttgaaaccctaaacctaattaagttccttaattatcaaagaatgacataatacaaaatgcatggagaattttggtgtctaggtcggttccgtccatggactgcactgaccaatccaccaaaattccccatgcattttgtattctgtgatggtttgataacctaggaactacattaaatctgcggccattttaagctaaatttcaaacaacacattttgatcgccatagtatcaaactaacaaattactcaatttcagtcaaactaacaaatttgtgcatctaaatattcacccacagtcatctcaatgaatcatattcagatatatatatatatatatatatatatatatatatatatatatataaattgcagaaactatgcacgctttcagatcagcaatggctagcaacagcataggcctgaataaaagaaagtgcatttcattttggaaaaaaagtgcagcaatacatatgtacaggtccatttcattttggaaaaaaagtgcagcagcagaacaattccttttcttaatatgttgagcacaagatcaattttgattgtacaatttaaatcacatttgcaacaagaaaacaaaggacagtactcatacatgcctctatcatcgataaaactcagtggctgcacatctattttagttggtgcacaaaaaagtcagtggctgcacaaactcatacatgcctctatcaacacaaaaaaaactgcatccacccaaattttcaccaccaattaacattcataaaaaattcatcccaattcagccatcaattcatctcatatcacattcatcgtccatcaattttcatcacattcatcatgcatcaattcatctcacatcacattcatcatgcatcaattcatcatttcaattttacagaatggggaggaggagcagaggagggggtgtacctcggcttctcggcacggctcaccgtggagtcccagcgcggcggcgacggcggtggcgcggaggaggaagaggcggcggagctggtcccggcatcgacgacgagtcccggtggcggcggcgtcgacaacgaggacccggcggcggcgatgactcccgaggtggaggcggcgtcgacgacaaggaaccggcggaggaagaggaggtcccggcagcggtcttggcggcggcggcggtgggaggaggaggcggcggagctggtcccggcgtcgacgacgagtcccggtggcggcggcgtcgacgacgaggacccggtggcggcgatgactcccgaggtggaggcggcgtcgatgatgaggaaccggcggaggaagaggaggtctcggcggcggtcttggtggcggcggtgggaggaggaggcggcggctgcggcggaaaaaaggagccggcagacaagtcccggtggtggcgacaactcccgacgtggaggaaggaggagccggggagaggtggagctcgatctgccaccggtggtggtgaagacgccggcccgatcgaggaggagaatgcggcgcccgtcggtcgaagaggagttggatctagcggtggcggtgaagagaaggcgcgaatggatctaacgccggcggtgaaggtgcgaatgaagaagctgtgtccgaaaagtggatggcgcgaatgaagaagaagtcgncgacggtggcgggcgctaggaatatcgctggcggcggcgctcgaaattttggcagcctggcggcacaaattttagggttcgcgcgcctccgggacttaggatattttcagccgcacgcgctagctacttataggcgaagacatcttcgctggcagaggaacgcgccgaccgctagcgaaaacattttcgctggcggaggattccgtgggccgctagcgaaaagggttttcgctggcggcaagcttatgtgggcaaagccggccgccagcgaaaaccctttggtcccacatgtcattctcaactgaaaaaataattttatttatttttacacagatatgattaatttatcaaaaaaataaaatatgattttttaatgtttgcgcctgatatttttttaatgcatgcatacaaataaatttataccaaactatttcttgatccaacaattatcatgtcaccatattccatatacaaaaattcatctcatccatcattgtcacacattataatacattaaaattcatcgatacgtccaacatgatatacataatgaattagcatctaacacttttccttacaccttcatttctcatgtatggctttggtgattcaccaattgattcttcgacgcgtaaaatctcgtttcgaaaatctatgaatagtgtcatgttctcatattgattgtatgcctcgacatcttcgacatcatcaactcccaaaatcctttgttttcccaaaataactatgtctttcttcaaatgagatgggtctgtcacatagaaaacttgagcgacccgatcggcaagcacccatgggtcatccttgtggcctacgttgtcaaagtcgacaattgtcagcccaaagttgtccacagacacgccggctgggtgtttcacccattggcaccgaaacagtggaatctacatatttggcccgtagtctagttcgcagatttcttctatgaatccatagtatgtgctcttttgcccagttgtgtcgattgcttctactcgaacgccactgttttggcatgcacttcttttgtctttcgcttttgtgtaaaacgtgtatccattcagatcatatgcttgccacgaggtatacacacttgatggcccatcagttagcattttaattgttctttcttccatggtatggccatctggtagatcgaggttcttgaaccattcagtaaagtgatgcttgtgtttcttcatgatccatctattagatcgacccacatttgttgcttgtaattcatgcaggtgttgctctatgtacggctccactattgtgagttactgcagcacagtgaaatgagcatctttcacttttttgtagtcattgtcgtggattcttttcttcccttttgttcctttcccagataatctaccttcatgtcgaggtaccggtaaaccaattgctttcccatcttttaggtaatcaatgcaacactcaacgacctcctcgattgtgtatccctctatcatggatccctctgggtgggcgcggttccgtacgtagccttttagaatggatatgtatcgttcgaaaggccacatctgatgcaggtacaggggcccaagtgcaattatctgaggcacgatatgaactatgaggtgttgcatcatatcgaaaaatgatggagggaaacacatctcaagctcgcacactgtctgtatagcgaaagcccggagaggacctaactcttcaggatcaattactttctgagatatggaattgaagaaataacacagctttgtgatgaccagctttatgtgaactggttcgactgctctaattgcaatggcgaggaatactgtgagcattacatgacagtcatgggaattgtagcctgaaagcgacatatccttcatcgacactagtcgcttaatgtttgaggagaagccagtaggcactctcaccctatgtagggatttgcacaatgccattttctcctctcttgtcaaggtgtagcaagcaggcggtatgtacacttttccattattaccttcatccacaggatgaagctctttccttatttgcatatccatgaggtccttacgtgatttcagcccatccttggtcttagttggtatgtccagtatagtcccaatggtgctatcgaagacatttttctctaggtgcatgacatcgatagaatggcgtatgtctaaatctttccagtacggaaggtacttaaagaaaatggagtgcttcttgaatggcacgctagggcttgctggcacttcggcatcatttctcttccgcttatttgtttccttcttttttaccttcccaaaaacaaccttcaggtttttggtcattctgaacacttcatcacccttctatggttctggtgctacacctttctcaacagtgctgtcgaaatattctacttgggagcggtacgagtgattctttcttaagaaacgccggtgccgcatctacacttgcttcttcgatcccttaagatacctgtacacggtaccatccacacaaataatgcaacccgtctttcccttgatctgtcccaatagggaaaacagtgcgggcaagtcattgacggtgacaaagataattgcatgtagcgtgaaatactcccgcaggaattcgtcccaaactcggatcccatgttcccacaaatcatgcatatcctccagcaaagactctagaaacacatccatgtcattgccaggttgtcgtggtccctgtacaaggatggtcaacaagatatacttccttttctgacacagccacgttgggaggttgtacatggttaggagtactggccacgtgctgtgtgagctgctcaagtcaccgaatggattcattccatcggtgctcaatgcaaaccttacatttcttgggtcctctgcaaacttatgatactttctgttagattccttccactgtcttgcctctgcaggatgtcaaatcattccatccttttttcacttttcatgaagccagcacatcaattcggcatcccttgggtttgagaacaaacgcttcaaacgatctttcaccggaaggtaccacatgacaagctgtggaatcttctttttgttactgtctttgcatggatcggactcttctatatcgtcaagggcaacatccagatcctcggactggctacggcttgttttgtattgactactcttgcatgttggacatctgtccaaatcctcgtactctttacggaataggatacagtggttaacacacgcgtgtatctttcgcacacccagtgacaaagggcatataagcttcttcgcttcataggtgcttgttggcagggagttgggttgcggaaaaagtttcttcaacagaaccaacaagtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtgaccagtttgtgtatccctcaacaaatccatgcatcaccaagtgttgctcgattacagatggatcattccaacttttctgatttttgcagtgcacgcatggacatctaatatctttggtcttcttagatgcagcattcttcttagctgctttcatgaatatgtcgactcattcaatgtatgacgcacgatatctctctttattcatccgtgccctgtctgccatctatgcattaattaattaattgcggaaaaaataatacaactttagttagttcaaatattttgaacaagataattaaagctagccaaaaatctgcatatataaaacatacatccctcagacgaattaccaaactacccttctttctcttcttctcttcctagctagctcattcttttgcagttaactaatatataaatctgctaaaaataaacctatcgaaaactagatatatatatggaacatcgatcatgcacaatatttcttgcaaattttgccattttgagctccaaataacaaataaaaaatgtttttcttcctccatgtcaagtattttttgcgatgaaaaatctcaacatacaaccaataaaaatgaaaaaaaagttgacaaaaagagtaggacaaagtacaactaacctctggtacaataaatctttcaaaagattcgagatcaaaaccttgaatgctgttggtcaataccagtgagaggaagcaaccaggctattatcttgaatgctaagctcaaaaatcttagaaggggtcttaaagcttggagcaaaaggttatcaaatctcaacactcaaatttcaaatagtaatgaagttctgacaacccttgatgatctggaagaacaaagacctctagctctgcaggaatggaatttcagaataattctcaaagaacatattctcaagcttttgaattacaaaaatgagttctggaaaaaaagatgtaccatcagatgggtaaaatttggggatgagaacacaaagttttttcaggcctcagcaactgatagtcatagaaggaataaaatctcgcatctcagtttggatgatggaagtatagttactactcatgctgaaaaagaacagattttatatatggcctacaaaaacagaatgggaactcggggctcaatggacatgatcttaaatttgtctgatatggttcgtagaatggaaggcttggagtgtcttagtgagatcccatctacagaagaactggacaggatcattaaaaacatgcctactgatagggctcctggaccagatggtttcaatggcttatttttaaacaaatgttggagtatcataaaacaagacttctatgagttggcttttcagttctttaccaacaatgtctccctcgagaatttgaatcactccttcataacgttgatcccgaaaaagccaactccagaaacagcaaatgatttcaggccaattgcacttcagagttcagcacttaaattcattacaaaaatcttggcaaacagattgcaggaagtaattctgaaactcattcatgataaccaatatggtttcatcagaagcagaaccatacaagattgcttagcctggagctttgaatatattcatcagtgtcatcagtccagaaaagagatgataattttgaaaattgactttgaaaaagcttttgatttggtggaacatgaggcaattctccaaattcttcaggccaaaggattcaattctacctggttagactggatcaaaaatatcttgtcttctgcatccacttcagttctgcttaatggaatccctaggaaaagtttcaagtgtttgaggggagtaaggcaaggggaccctctttctccattgttatttgttctagctgcagatttattacaatccataattaataaggcttcctcaaatgggttactctcaactccaatcccaactagcggtaattcttttccagttatccaatatgcagacgatacattaataatcttgaaagcagatcagagataagttttttgtctcaaagctcttcttaacacatatacaatgtgtactggattgaaaataaattatcacaaatcaaacatgattcccatcaacactgacagtcaaaaaatggaaattttagctggcacttttggatgttcaataggtgccatgccttttacttacttgggtctacctcttggcacttcaaaaccaaatgtcagtgactttgcaccattgattgatagagtggaaagaagacttccttcaacaacggtttatctaaattatggacaaaggctcaccatgatcaattcagttctttcttctttaccaacatattatatgtgctctcttaagctgccaaagaaagtaattttgcacattgatagggcaagaaagcactgtttgtggaggaaacataatgagtcagaaactaggactcattcacttgctgcatgggatctagtttgcaggccaaaaaagagaggtggtctgggaattatcaacctagaaatccaaaacacatctttgttgcttaaacacttgaacaaattcttcaacaaaaaagacctgccttgggttcatctaatatggaataaatactatattggtttggacaagcctccacatgcgcaaattgagaagtgatcattctggtggaaggatattttcaggctaatcccgttatttcaagctatcacatcggtgactgtaggaactggagattctgctctttttcggaaagataattggagcaatcacaatttggaaaatgaattccctgtcttgatttcttatggaaggaatgaagatgtcactgtacaaggatttctgtcagccacagatattggtcaaaactttcacttacctctgtccaaccaagcaattcaagaatggggtaatttaaacaacagattacaaagcttacagattgtcactgaatcagacaaatggtcatatgtatggaactccgattgataccaatccaaaaaagtttatttgatgttctttcagcatcttcaggttgctagaccgatatctatactctggaaaagcaaatgtacaatgaagcttaaagtttttctctggctcatgttgatgaatcgactcaatacaaaggaaatgttgcagaaaaaaacaattcaatatacaaggtggtgtcaactgtttgctatgcagctccatggaaacagagaacatgatacacttatttttcagttgcccttttgctcaacagtgtttgcaacaaattggtattcagtggaatgtaaaccaggaattcttgaacatgatcacttcagctcagatctcttttcaacatactttcttctttgaagttttggcaataggatgctggcacatatggagtagaaggaatgatctcatctttaacaatgttgctctcagcttcgacaaatggaaggatgattttcagaaagagtttgccttgcatatgcacagggcaagagagagggacaaaacagattggcaatcatggatagctaactttacttaatacttctcctttttccctttttgtaaattcttgcatccttgtaactatgttttatttatttatatttaatatagcacagtaggagcctctcctgctgttttcagtcaaaaaaaaaagagatcggtattctcgagccagtgtacctacacaacatgtttcctttcgagaggtacatgggcgttctgaagaagtatgtttgtaaccgtgctcgtccagaggcaagcatcgccaaggggtatggaaaagaggaggtcattgaattctgcgtagaatatattgaagaccttcgcccaatcagggtacctgaatcacgccatgaagggagactacggggaaaggggactcttggaaggaaagcaataatgacggtagacaacaatttattccgtaaagcacatttcacggttctgcaacaatcttcattagtggctccttacatcgaggagcacttggctctagttcgcaccagaaacatcggtaagtccgatgcatggattacacggcatcacattgatactttccccgcgtggctgcgacaacatctcatgggtaacgagacgattaaccaacaactggccttcctggcaaggggaccatctggctcgatcgcgacattccagagatatgagatcaatgcgtacacattctacacgagagcccaagacatgaagagcatgaaccagaacagtgttgttcatatcgatgccatgggacacgatggtacaactggcacgtattacggtgccatcaaggacatatgggaacttgactatggacctctcaaggtccctctgttccggtaccaatgggttaggttgactggtggaggcgtaacgattgatgacagtgggatgacaacggttgaccttaacaaggttggatactcagacgaaccttttgtccttgccaacgatgtaacgcaagttttttacgtgaaggacatgtctagcaaaagaaagaagggcaaaaggcctgacaagccgaagcgccacgtggttctcccaggcaaaagaaaaatcgtcggagtagaggataagactgacgaggattacgatcagtttgatgggcaaccccctttcacggtgacgattgaccctagcatcctcctattaaatgaagacaccccttactcacatagcaatcacaagaaataaacaatagtgaggagaaagtacgtgcggccaaccatcaccgccgatgtattgccgtaattgttgtgtacaagatgtaaactattttggatgtattgaatatccatataaatcaattggtgtatggcatatgttaattatgtatgattattagaatttttaacaaatttaaatcatgcatatgctagttatatatgataattagaatttttaaaagttttaaatcatgtatgtgcttataatatatgattattagaatttttaacaattttaaatcattcatgtggtgtttacatatgattgttaaaatttttaacaattttaaatcatgcatatgctagttatatatgatcattagaacttttaacaattttaaatcattcatgtgcttattatatattatccacttaatttactgtagacaacaatatattttgaaggttttgtcattaattttgtgactttaaatcattttaatgcattatttactattttagaaacccatatgtaatgaaatgtaatatgcagtgcttttatctttagtcccggttcttaatcttaaccgggttcaaaaagaatttggaaatagtgggaaaagatctttagtcccggttggtctcaccaaccgggactaaagatcccggggtatatatatgcctgaggcgcactcgtcttctccaccaacacttagatgtttttctctgatctcggcttctcctttgatgccactgcctagggcatcccccgcgccgacgccgccgtcgtctctcgccatcatctcgctgtcgtcgtcgtcatcaccgccgccgccaccgccaccatatctctggggttgccgccgctgcctgcgcgaactctctctctctctctccaaaccgccgccgcctcgtcgtcgtcgtcattgctacgcctgccgacgccgaccccgactccgccttccgccgatgccgaccccgacgtcgacgcggccgccactgccgacgacgcccccgccgcaccgcgccatgccgccgccgctccttttcgctgccgacccatcaatgccgaacgtgaacgaatgcgaacggacatgaacgaacgcgaacggacgcgaatgaaacgtgaacaaaacgcgaacgaacgcaaacgaacgtgaacgaactcgaacttaacgtgaacgaacacgaacgaacgtgaacgaaacacgaacgaacgtggaggaaacgtgaacgaacgcgaatgaacgtgaattcacttgaacgaaacgtgtgaatgaaacgtgaacgaacgtgaaggcacgtgaacgaaacgtgtgaacgaacgtgaaggcacttgaacgaaacatgtgaacgaacgcgaacgagacgtgcacgaacgagataattaaacgattattaaacttagcatatatatatatatatatgattatatacttgaaaacgtgaacggaaaatatatgttcctttgcgtttagactaatacatttttttgcatgttgcagataagagacttcgtcgtcgtccctcaagccgaagtggtagctaaccctcggaggaatttgcgcaggcaagtgatataaagatatgattatctagagttctaatatacgaaacttagacttagcatatatgattgttagagttttaatataagattattagagttttaatatacgaaacttagacttagcatataagattattagagttttattatacgaaactttgacttagcatatataattatttgagttctaatatacgacacttagacttagcatatatgattgttagagttttaatataagattattagagttttaatataagattattagattattagacttagcatatatgattattagacttagcatttctgattattagagttttaatataagattattagagttttaatatacgaaacttagacttagcatatatgattatttgagttctactatatgattattagattattaatatataattattagacttagcatttatgattattacagttttaatataagattattagaattttaatatatgattattagagttttaatatacgaaacttagacttagcatatatgattatttgagttctaatataagattattagagtttttatatacgaaacttagacttagcatatataattattagaattagcatatatgacctatagaattagcaaatatttcttgtatgaatagatggttgatcgcgatgacgaacagatactataccatacaatcgcagagggaagcagccagtactggaacgaagaagaggggaacgaggatccaaaccagtacttgaacgaggaagggaacgtggagagggatgcggaggggaacgaggatgaggaggctagtggaagtcaaccctccgctagacagaagagggcacacggacaacgaggtgccgcgaagaagatagagggttggcacatcataactgaggtggacgaagacggctgacctagtgccccggcagaagcagccaagaattttgtacgacatagcggttgggttgtaagggataacgtgcctgtcagcaaggtgtactggcgcagaacaagggcacgcggggattatgacagctttgtcccagaatcagagaaagagatgttgtggaccacaatgctcgagatgttcacgctccctgcgggtacggagaacatagtgaaacagtggactcttaagaaaatggcagaacagttccagagcttcaagggagatctctacaagaaatacatcctgaaggggctgacactgaacttcgacgtattcccaaagctaagggatcattgggacgagttcattgcttacaagacagggcaacaagggcaagcgatgatggacagaaacaaagaaaataccgccaagaagaagtaccatcaccacctggggtcaggcggctatagcgtcgcaatgccgaagtgggaggagatggaagcaagcattattgagaggggtatcgaacaggccaccgctaaatggccgtatcgatcgaagttctggtactatgctcacggtggaacgcttaaccccgttgatggctccctgatgttcagcgatcagatacgcgaggctgccagtcgactaacggatgcagtggaagcctcttctcagggcatgttctgacccgacagagagaaggacgagctgtcactcgccctgcagactcccgagcatccaggacaaacacgagggaaaggcgtggttccttggaagattggattcaaggaggacatccacacatacaggagtcggatgaggagcaagagagataccgaggcgaagattgcagatcttgagtacagggtatcgagctacgaggcaagaggaggtggcaaggaaggtggatgaacgcatggccgcacatcggtcccaggatccccagctgtacattcctcctgtaatggttagcccctcaggcaatcgtagcagctgcgcctcaacggggcaggtaggatcacagagcatggacgccatgcaaactcaggatgaaaccacctgccccgttgatgagatcacgcagcggacaccatgtgagctgcatattcccttcaagaacttatcaatcaaggtatgttcgtagttttatgatttatgctcgtagttttatgatttttgacttgtacattccgcaagttgctacttaggttgattactaatagataacctctcatcacgtgaaggtggcgttggaaatggccatcccaacggacccttcagggacttaccactgtaggccggttccagcaggatactcaagggtcgaagttgagctggtggaagccgcgtacgaggacctcgagttggactaccctggaggagacggtgagacgcatctacgagacacaagccacgccattatactatggcgcaagcggtacatcatcctccctaggcgacaagcggcgtctcgtgcaccatctcctccggctccgccatctcctccgccacctcctcctgcaccatctccttcggctcctccggctcctccacctccactgtgtccacctgcacctctcaagacaaggtctcgccaagctccaccgcctgcccgcacaagggcaacgaagaaggcgaaagttgacgccaccaaaaacaaggagtcgccgtacgattgcagtcaagaggagcttaatgcttatgtggcaggagaagtgaagaggcaactcaagcctcggagtcctgaaaagaagatacctgttgacccgagcgtgaagaacttattcaagaaaatgtccacaacaaacaaggaggtcttaaagctatcggactatgaccgaacacttaagaaagcctattacaagaagtccaaactagtcccttagcttggagaacaaccataccaacaggtcgagccgttggtgactggcgaagaaattggcatagcagaattcatttctgacaccagtctaactgtggatcagttgattagaggcgcaccaatcctgaaggcggaagtggcatacaagtttgaactcggtaaaccgcttgtcacgcctgagcagctgtagtccctaccgacacagatgtacaaattccatgaacggtacatggaaatgagtgccaagggtagagagatgttcggagcgaggatcagaaactccgacttcttgcaaggagaagatgttctatggatccatttcaaggatgtcttcgaactataccctctggacaccctcgacgtctctcttctaagcgcattgattttgtaagtatcgttgagttcgatttgtttcgttcaataattaactccttgcatatatgtaaacaataataacttcctttttatcgttgtagaatggagattaaaagggctcgacggtggggggtttacgatactgggttcatcgaccctcggaaaatcaacgccgaaatgatcgacaagtacgagaaagacatagaggacaatctcgtccatctcctgacgcagcagcatttcaagacgttcatactactgccgtacaacacagagtgagtttttactatcgttcgaacaaatttcattcccatacatataacatgtacattttcatatatatatcatcacacgcatattgcagattccactgggtcctgttacttttcgacttggacgcatgcagagtcaatgtctataactcaatgaataaagaggagaagactttcgacaaggttttccaacggatagacatgtaatataattgcatctattcaaaagtcacggggatttttcctattgctattatgcgtatctcggataataattaatcatagcttgcaactgcatgtagggtttgggattggttccgtcaattggtccccgggacttggaaagaaaaacttggatggaggtttaattttctagtgagtacatgcatgatccaaaattatattgaattgaatctctaattacagttaatataagtgtatattaaatctctcgtcctttctcatgtactgtgtaaagcaggactagggaactaacttgtgccgctactacgtatgcgagtatgcccactgcctatcaacccaaatctacaccacacgagagcttgatgtacgtatatataaaccattcaaaatttcattgcgtatcgatttgttgtgtatatatatatatatatatatatattaatcagatttgaaccgaggttcatttgcaccaggaatctccaccgtagatgtgtttcaggattcacacatatgtatcagttggttactgcaggaagtgtctcttcaaaccatttaatcatggtcaaaaggtggtatggtcagatggagaggacagacatgcatgtgctgtattttctccgtgccagaaattcattatgttcacagggtgtctttttttttttccaatcggcacgttaaaacgatatatacaaattaatgatgaatcgagtaatctaattagccttttacgtcagagctataaatgagaaaatcattatgtgtgccatacgtatatggtacatatactatatatatgtatgtgtgatgttagtatatacgtgcagtttctgctgatcactctgtggtgtcatgtgggctgcagggagggcataatcgagaatgcaacctgtaccattcaacctaccaacgcacagccctatatagcagctcaatgaggttggtacatcttgatgctcattagtcacatgatggaacatgtctatgcatacacgcgtcaatcaggtgattggggtgcatatgaactgtggtctatattatccatgtcatatatatatatatatatactagcaaaatgcccgtgcattgcaccgggtaatgccgcgttggataatgtttaactgaatgattttgaaaacggtctaatatgacaataataatcacaacagatttctttttgtttggacaattattccacatatacgtgtatgatatgaacgatgttcctaacacgttagcgtaatgattgtaccatgggaggaacaaatggtgaatgcattaggttactttcatgcaagaatagatggacgaaaatttgtatgattaacaaaaaattctatatttaaaataggtaagtttatcataaaactaatgacaatcacgacagataagattacttttgcatatttactcagtctcatagtggtgatgcatgctttcttaagctgtcaactctcgtgttgcaagcgtgcgatctggtttccaaaatcatatgtcgactcacatggaggaagcaaggcgagtggaagggagatgtccattcagcgccaagcggagcgaagcggcggcgacgcggcctaagcggcatcggcggtgggtggggctccatctctcctcttcctcctacgacagatggtgagcagcacagagcggcctaaacggcaacaggaatccacctctcctcctccaaccggcagcgagcggagcggagctctggtggcgtggcccaagcggtgcctgggagtccacctctcttcctttgatcaacggcgagtggagtggagcggcggtattgtggcccaagcggtgggtgggagtccacctctcctcctcctccgaccggtggacggtgcgtgaacgggggcagcaggggcacggtggtgcgtccacgacagacggcgtgacgggtgttctggcgacacagctgatttgtcgctgctacgctccgaggcagcacggaacgacgatgacaatgaggttaggtgccagatctgtcgccgcctcttcctccgccgccaacatctctgccctaggccaccgccataccatcttctcttcttctccctatgctgccgcttccgccgtcacacgggtgaggggcgtcgcgtggggccatgcccccacccaatgcgtcacttgccctgtgcttcgccccacgcctgccaaattccgacgaaaaacgtgtagcttcatttggctccgcggttttcagtcgggaacaacaggcgtgtgcgtggcgatgaatcttcaatgtggctgctcgggacagaacgcgacatcagtgcactgtgaccgcttaacagctgcaatatgcagctcaagcgaggattcagattgggtgcagctgtaactgcaactgttcctgacgactgcggccatgtttagttccttttaaaaaaatttaagtatacgaacacacatttgaagtattaaatgtagacaaagaacaaaacaaattacagattctgcctgtaaactgtgagacgaatctatttagcctaattaatctgttattagcaaatgtttactatagcaccacattatcaaatcatggcgtaattaggctcaaaagattagtctcgcaatttatatgcaaaatgtgcaactggttttttttcgtccacatttaatactccatacatgtatccaaacatttgatgtgacgaaatttttagaagtttaaacggaagtaaacacagcaacacagctgttaacgaccaaatttggtaatccaaggatcggagatgaagaagaaaccgagatggaattcgagatggaaatcgtcccggaaacagagtgaggatcggctgaagttcgaatcggctacgactaagatcggcagagttcaagtcggacgaggttagccgattgagccgaatccgacaatatgacacaacatatgttgtcggtttaggttgatgtgcttcatgataattgctacgcatgtatagagtcctgagaaggcaactgtatcaattaattaggatattttatgtaattttcttagagatatgtttgggcaaaagtctgccgcaaagacttatggtatcttagagtttgttagagataagagtcgtgtccgatatggacatattttgtaattctcgggtataaatagacccgagccccatgtaatcaaactaacacacgttcaatacaatctcggtgcattgccaccctttttactttcgttttgtttcgacgagttcttactttcgggttgagctgcatcggtttcgatcttcaacaaggggtaaaacttgttatggtggcttgcgttctcgggattagtgcttccatatttatgacactctaatcttttttatgtaattcgtcgagttatcatatatctcacataatctctggcaatatcgctatataacctacaatcggctaacatctgtcagtagaaggcagccgattaggttaaacatcgatgctggcttagattatataagatatccaccactctatgacacatccaacggcttgattgtctagatattattcttcttttcatacttatagctgcattagttgagtttgatcttatgagtcgtgattagaatctcaatctctagcctgcctttgattgccgattagggtagtatcagggtttcagccgatcttacctgatttaactacatttatcttatatgccttattgacatgttaaattcgccctttatgttaatatcttgatgcatttaagtatattaggctttcgtttggtatattttacttgctgtgatatcttaatatagagtggtatcgaagtattagccgatacacgctagatctatcttatcagctatggtataaacacatatagtcttgttattaatatatatttcgatctaagtgatttatactgtctcggcatggcgaccgatctatcgcaatcacttgatttaagtatatatcgatataaggactatataccgttaatatctacagccgatcgagtatatttagttctttcttacttattaatgattgccgatcgatgcatatatgacatcggctcaaagataaatgatatgtcatcggcatctagccgatcagctatcatttatagatttaaccgtggtttctttgtctttgtttcttgttgattgcaggatcaaatcaactggcacgctcgcatacccaaaggcaagttttggacctgcattggagttaagcagatctctcaggcctcgtgttttcacatcaacacgcttttggcacgcccagtgggacccattagaagtcagagtcacaacagcggtctctaatggctgagaaaccaccagcatcactgtcctcagctggcaaagaggggactcctaaatctaaaatcccgaaacctggtacatctgaagttaatgagagtaacatcgtgcccatcactccggactggttgacacccgagcagcagaaggatcttgaggctatgatgcagtaagcacggaaccaattcttgaactcattcatggagacccgcaagggaacagttgttcagaagtataaagtaaaagtaattgctgatgttcccggaacaggttcttccaaggatgcagaagtacaacaggttccagatggtacaactcaatcaagtgataaaggtgttgcagatggttttcaagggattcaaggtgatggctctcaaggggttcaaggtgatggttctcagggatttcaaggtgaaaatcttaaccaagatggcgacactgcatcgctacagtttaacaacttccaagatcggattgactatgccgtgcaacatgctttgattaatcaatctggagtattagtcaacacattatcaaacatggtgaagtcgatggttgatggcttgatagctgaatatcaggctacaggaccggtttatttgccaggaggtgttttcccaaactatcggcccttaatcactaataatcaaccagttgtctagccaattcctcccaatgcaccatcggctcaaccgacagcaccagtatcggctcctgcacctgttgcaccatcatcggcactgggtcaattaattaatcctcggttgttggtgagagagcagccacagtatagtggacaaaatgtgaatcggctaactcaagatcaagttacaactatgttcctaccacctcaacctactgttgacacaatccagcaacagccgattcaacaaacaccaccaaggcagcaggttgtgcagccgattcaacagacaccaccaagacagcaggttgtgcagccgattcaacaaacgccactgaggcaacaggttgttcagccgattcagtagcaaggtttgatgaatgcatcggctgtgtttggaacacctgacgatcagctaaggtagcacgctgcgaatcaagttgtcctagagcatttggtccataacgtgcaaccagatcaaactgtggtacctcaggttattcccgaacatttggtgcgcaatatacagccgaactttcagaattaccattggggcaatttgaattatcagtattagcctccatcgccgtaagttcaatatcagcagggaggaccggctcagccccagtttgttcctcaatacaatcaattcgagaccgtgccacaacaagcacaaggagtgcctcagcaacgaccatgggctgtatgattgcagatgtgatgagagaacagtttaggcttaagccgaaagatgctgaaaatttgtatcggcatccttaccccgagtggtttgagagagttcctctgcctaaccaattcaaagttccagatttttcaaaattcttagggcaggatagtgtttcaacctatgaacacgttagccgatttttagctcagtgtggtgaagcatcggctgtgaatgccttgagggttaggttgtttccattgtccttgtctggatcggctttcacttggttttcttctttgccatgtggatcaatcaatagttgggccgatttggagaagcattttcatagctatttctatagtaggattcatgagatgaaactatcagatttaacagcgattaagcaaaggcatgatgagcatgtgcaggactacattcagaggttcagagagatgaggaataaatactacagcttgagtttaactgatgcccagttagccgatctggctttttagggtatgataactccgatcagggagaagttctcgtctcaagactttgatagtttgtctcaccttgcacagaaggtaaccttgcatgaacagaggtttgcagaagccaggaagaactttaaaagggttaatcatgtctgtccttacatatatggatcagatgatgatgatgatgatgacgactccgaaatagcagcagccgaatgggttagaaacaagaaggttataccatgccaatgggtgaagagttctggaaaagaagagaggtatgactttgatatcatcaaggctgataagatttttgatttgttacttcgggagaaacagattcaacttcctactggtaatacaatcccatcggctgaggaattaggcaagaagaggtattgcaagtggcataattctgggtcttattctaccaatgattgtaaaatctttagacagcagatccaagcggctattgaaggaggcaaaatagaatttgatgattctaagaggccgatgaaggtcgatggcaatccttttcctgtaaatatggtacacacagctggccgaacagccgatggaggaagagcaagaggttttcaggtgaattcggctaaaattatcaataagtatcagaagaagtatgacagacagcaggagaggcattatgaagaagatgatggcggttttgattctcattggggttgcgagttctttagattttgctggaataaaggtatgaggctgccatctattgaagactgtcccgggtgcggcaatgttgcagaaagttcaagccgatcgtataatggaagcaatcggctaaggcaagcaagagttcctgttcatcaaaggttgggcccggtgaaccgagattgtaaccaagaggacgatgaagacaggaagactcaatggtgtccttctggtatttttacaaagaatcagaagagaagggttcaaaggttgaggaacagagagcgttttcagtgtcacagcctgaattttcgtttcaggatttataaattatttaataaattattaatagaatttatattaaatgttcattaatttacaagtgaagttaaatgtgggaaataaaatttcctaaatataaagcatggctggatttaatttttattaaattctccatgattaattatactctctgaaattttctcggatttttttcggagctcaattcctaattttaataatgcaatgaatatttcagtaattatttaattaataaattaatcattaaatggtttggtttcaatattgttaaatactttgagtgtccaagtatgttcaagaattctcgtggaattatttgagcattggaagtatttttaacaattgaaagatcatttcagtgattaatttaattgggaaaagtaattaaaatccccttttccttttcgggccgaaacaggaaaagtttacttgtagtcctcggcccatccttccttcctctctctggtcggccttttctccccaaagtctagtttgagttctcctttaatcaggctgtgcaatagaagcccaatccctgcgccactgttcatcttccagctcaggcagagccgagccagccgtgcccgtgtcctattgccgccgatccccttccaaagtccggccacctcgttgctcctttttccaaattagttgcggcaatggaatcctctcaatctcctcttccttttccccaagaaatccccaaaagtttctatggaaatcctttcctatttcgtggttcaatctttcctttttccagcgtaaaccctagtctttcccaaagtttctcgttgatttgggcccggacccgagctcccgtgcctatataaaggaccccctagtcgtcctctacctatcccctcaagtcccgtcttccgccgtcgccggtcagcgccgccacctccctcggcaccgcaaagtcgagctctatcccgatcgctggttattttgcgccaaatcccaccggaggttgcccgtcgtcgtgaaccggagcgccgccgctgccgccgttgggttcgcgaggaggagaagaagatcgtcctccacttccccgaagctgaaatccaccggagctccatcgtcgccgtcaacccgaagttcgccgtcgagttttgatctccggcgaggccctactgctcatcccgtcgtcgccttcggtcgccgtcgtctccattgggttcgcaggagcaaggtgaagcccggccaccgggttttcttcgccgaagatcactgaaacgtcgccgccattgctgacccgaccccatcgccgcctctacctcgttgccggacgtctgccgtcatcatccatcgtcgcgccgcccctcggtgagctttcctctctccgatgtcgttcatcggtgtagtttatccatagggtcttaatccaaaatctaatttggcccttgtgtcgtcgtcgtctccatgtgttgccgccgggtcaccgtcgtcatctctctctccgatcactttttggttcggtgagacttctattcgtcgtttcgtgttcccattgccacattgtcgctgccacactgccgtgccacactatcaaagccttagtgtcgctccctgcctcagtcatgctgctgcgccgtgccgctttgctgttgccagccaagccacattgccaccgctgctggtgttgcgttgccaccgctgccgcgttcctggcttagtagagccattgctaccgctcggtagccgtctcgctaagtcgtcgttgagtcgctgccgctgctgcgccttgctgtcgtgctctgccgtagctgtgcgtcgtcgtcgctgtgccatcgccctaaccctaactgcgtgactccgccgagtcaccgccgcctagccgaaccaagtcgccctagtgccgccatgtcgcagctgtgtgccgctttaacctagccgccgctttagccgttgctcggtagccaagttgtctagccgtagatgcatcccttaattcctaccggcctattgtttgctgtaccggggctttactgtgaatcgtgtatagctcaccggtttagtcacagccgttgttgagtcgttcgctcgttcgttttaatgaggtgttccccgtgcttcgttcgttcgtccatgttaagtcgtcctttagtttagagccgttcagagccgccggttccgttcgccggtttcggttgatcatttgagtgatcccatgtcacgtagaattgactcgttgagtcagtatctcttgagcttcgcttgcaagattaatctcagccgtccaaaaccaatatatatccgttccctctttttagtggcatattatttctttttaatatatatcatctaccaaatataatctaatctttttcggaggttgtttccaatcttttatcttagttataaatcatttgtaaattgtttaattaatgtggaatagtctttttctttaataggtttaattggaattaaatcttgtaaaattcgtaactaattcatatgaaatcggaatgaggccgttcaagtctcataataaatctaaaatcatgatctacatgtttgtttactttatatgtactgtttatttggagtttcttagtctttttcctcgttttgcgtgttagcatgtagtttctgtcgtttcgaaggttcgcgagtgcgccggaagtgttcaagaagattaattgaagaccgattattgcaaggtaagtcacacagatcccaaacacaattcctttgagcatgttggtcctatatttaaattcgaatgtcaccgggtggtgtgaacctattcctttgttatggccaatttgcattgattaccctatttcttgattacctcgggttacaatttgactagttgagctctatatattgtttcagctagatgttagacataattgcttagccatgcttagaaacattagcacacgattgggataactaatgttcactattacttaatgatggatatttaatggtagctcacgatggtcaatcgtgattggttagttaattaatttgccgactaaaacttgataatggtgggttgtgagcacatggttttgatggtcgtgctcatgacaattaaggatcggttcacgagttttggttgtgaaacattaaccgtgccaaccacaagccagcgtggcaacggctttaccttttgtatagcatggttcattgcggggaccagactgagaagtggcggagataagcccacgggggtcgctggggagtccatgccttgtttataagggggtgattatgatccaggaacggtgcgctgtggtggattgtgttatgcgaggggtactgtcacagctcctttccgaggtatcgtggtggtattgaggcgcatggtgacatgttgtggggctgtgtcttgtgggtacagtggtacacctctggccagagtaaaactagtcgaatagccgtgcccgaggttatgggcgggtctaacaatgtcttttgtgattagtctcacacttctcaccataataaatgatgctataactggtaataatttgattagctcctggtttagaatggtacattcctggattgagatagatctgtacagccgggtatggttgttcaggatggttgggcctgagcagcatgggtgtgctgttcagtgttgattaaaattgatgattaattactctactgttttataattctaaaatgtttgctaaatgctgcttttgcaaatgagccctatattatgccattctttggtatccttgtgcacttgcatatttgctgtgtgacttgttgagtatgtcatatgctcacattgtaataatcaatcaaacctcagtggaagaaaaagaatccagatagagaagacatttggcttataccccagttgagctgcctgagggagtggagccggagcttcgctagaccgtaattccgctgcagttttcttttcttttttaagtatgtaacattgtattattgatgaatctgtatattaaattgtcagtttgtgtacctcggctgattcctggacgagggttttatgcacaaattagttcggaaattactagtgaatttatgggcgtgacattcaggaagttgagcaagaaatcaatcatcagctaaagaagacgaagccaaagcaggagtggcgtgttaagattcaagttcctgcagccgatgaagccacagccgatgaagcaaaaagattggctaaaggaaaaagtgtggtgactgcatcggttaacatggttttcacgttgcccgctgaatttggagtcaaacaagccgatgttgataaagttgaagaaaaatcggctaaattgattttattaccagaacaagcagtctttgagaagccagaagggatagagaatcggcatcttaagggattatatgtgaacggctatgtcaatgggaagccgatttctaagatgatggtcgatggtggggctgcgttaaatttgatgccttatgctacatttaggaagctaggtagaaatgctgaggatttcatcaagacaaacatggtacttgttggcagtatggcatgaggcccttcgaccaaacctgccgaaaccatgcgaccagtaaggattcaagcctaagacgtcaagatcggttggggcgaagcccccatggcgaagactatggagcaaagacggcgaagggcggagaatcgtgcgggtgcctcgtagagccaaagacctcttaggcgaaggatgtaaggcgaagagtgtatgtcgaagggagacgacttcgccatagcaagttcggcctcacgaaggcccagtggcctttgggccaacgatcgcctgacggaccattaggagcccatgtacctcaattacactgtatacccacataaatgtccctttcataagggcagccatgtaaattcccctgtataacctaaaccccagtagcaagaacttgtaatgaggctataaatattctcctagggtcatgtaatagggggatcccaagaaaaattctccattcaatacactttactttctttccaaccactgttgagtaaccacgtctttcgacgtatgcagttgtcgtttcgaaaacagctggcgccgaccgtggagacctccaagcgaaaccactgagagcgaatgccaccgaagagagtcgtgaaggagaaggttacaaggcgaaaggaaagcgaagccggaggggggatggccgccgaaaagggagcagagccttcggcgcccatcgccgaagatggcggagcgccaccggcttcggcaccagcgccgctactaccgtcttcggctcctgccgcctcgttggggcaggtgccgaacacggctgaagcagcgaaggcggcagcggcggcaagggcactccaaaccagggcggagatcctttcgacaagcaaactgctggtgccccaagccgctccgtcgcagctggcagcggcctcgactgcgctcaccgctgtacaagtcaaccctgatcccgaaacacaagccgaagccgacatggaagccatgcgacagaacatgacatgactccaagacatgcttcggcagatgcaagaacagcagcaggcgtacgaggcagcgaggcgggccaaggccgcttcggccccaatcctccagtattcggcaggctacatcccaccccaagtctatccacaagcaccgatccaaccccttccaccacaagccacgcaagcgctagtatacttcgctgggcagccttcgaccgcagcagtacatccgggccctcacgtgcaactgcaagctcagccggtcactacccaagcacactctcaaccgcctggccaagtgtcacaagcgatggcagaaggggcttcggctctgcaagcgcagcttcaagctttcattcaacaatttagccaaccccacagcatttcaggtatagccccttcggcccagccggaggggagtacaggtcatggtgcgcctagttggttgtcgtcgaatcagccgggtctgggggctttgccttggagtcaaggaccgtagttcgacttcaacaatattgctcaggcaccaaccgttccgccgcaagcaccaacactaggcttcgtggcaaaccaagcaccaaaccagtccgccatggcatggccccagccaacattcgacccatccatggcagctcaccaagcatcaccaatcggagctgggcagccgaacaccgtggcccaacctcacgcgcaggccgtgacttcgcctttcgccacaccgtatccgtagcaaggtgccgtgaacagggcagggggcgaaaaggggctactgctgagtgggggaatcaagacccgtccaatcccaccccagttcaagttcccacccgtcccacgctattcaggcgaaattgacccaaaggaattcctctctatctatgagtctgcgatcgaagcggctcatggcgacgaaaataccaaggcaaaggtaatacatcttgctctaaacagcatcgcccgttcttggtacctcaatttagcagctaatagcatctactcatgggagcaattgcgcgatgtctttgtccttaactttcgagtcacctacgaggagccgaagacgcagcaacatctactcggcattcgccagaggtcgggagaatcgataagggagtacatgcgtcgcttcttgcaagcccggtgtcaagtacaagacataaccgaggcgtctgtcatcaatgccgcttcggccgggatactcgagggcgaactcacaaaaaaaatcgccaacaaagagccgcagacgcttgaacacctgcttcgcatcattgacgtgtacgcatggggcgaagaggattccaagcgatggcaagcaattcaagctgagtatgataaagcctccatcgccgctgccaaagcccaagtacaagctcaggtcgccgaaccacctcctctcgctgttcgccagcctcagccggcgaaccaaggataaccgccaaggcaaggccaagctcccataacttggaggaagttcagaaccgaccgtgcgggcaaggctgtgatggctgtcgaagaagttcaagccctccgcaaggagttcgattcccagcaagcaagcaaccatcagcagcccgttcgcaagaaggtccaaaaagacctttactacgccttccacggacgctctttgcacaccacggagcaatgctgaaacattcggcagcgtggcaacgtgcaagatccaaggccgcagcagggagcagctgtcgaagcacctcgcgaagacgttcaagaacaagcacccccggccgaacagcgccaagatgtgcagcgtcgagtaatccaagtgattacaagggccgacccgccgaatcagctgtcgaaatgacaaaagaagatgcagcatcaaatggtccacaacatcacttcggcgggcgaaggggccccacaatatctgaaccagcaaatctctttcgggccggaagatgccgaaggagtaatgttcccgcatcaagaccctctggtgatctcggccgagatagctggcttcgaggtccaacgaatcttagtcgacggagggagttcggccgatgtcatcttcgctggagcatatgccaagatgggattaccgaccctagcccttacccaagcatcggcatcgctccgtggtttcggcggtgagtcagtccaagttctaggccaagcgcaattgctggtagctttcggcacaggcaaaaacagacgcgaagagaaaataatgtttgacgttgtcgacatcccgtacaactacaatgccatcttcggctgtgcgaccttcaataagttcgaagccatttcccaccacaattatctcaagctcaagatgcctggcccggtaggagtgatcgtggtcaaggggctccagccttcggccgcttcaaagggcgatttggccataatcaacagagctgtgcataatgttgaggccgaaccacatgatccggcgaagcacgcgccaaagcccgcccctcacggcaaggtaatcaagatacagattgatgataccgatcccacaaagcttgtatcgctggggggcgacatgggcgaagaagaggttgagaacatcctagaggtgctcaagaaaaacattgataacttcgcctggggccctgatgaggtgggaagtgtttcgacagatctcatcatgcatcacctggcagtcatgccggatgccaagccaaggaaacagaagctacgcaagatgtccgttgatctccaagaagcagcaaaagccgaagtccaaaaattgctcaaggctagggtcattcaagagatcgaccaccccgagtggctggcgaatccggtgctggtgcggaaatcaaacgacaaatatcgcatgtgcgtcgatttcacaaacctaaacaaggcatggccgaaggatgatttccccttgccacggatcgaccaactcgtggattcgacagctggctacgaactcatgagcttcttggatgcgtactccggttaccaccagatccacatgaacccggccgacatccccaagacatccttcatcacaccattcggcaccttttgccacctcaggatgcctttcggcctgaggaatgccggggcaaccttcgccaggcaggtgtacaaggtcctttacaagcagttggggtgaaatgtagagggttatgtcgacgatatcgttgtaaaaagccgcaaggctttcgaccatgtgtccgacctgtaggagaccttcgacaacttacgcgcggcgggtatgacactaaatcctgataagtgtgtttttggtgttcgcgcggcaagttgttgggtttccttgtttctgaaaggggcattgaggcgaaccccgagaaaatcgatgccattcagcaaatgaatcccccgtcgagcgtacgtgtcacaccctaaaaatcctaaatatataaattgttgtttaattggaattatttttaaaaggctagaagagaagatttaattttaattaataaattccaatataaaatggggccagataaaatttcattaaatactttgtttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctcctctctctttcccccggcccaagtcggcccagtccgcagccgtccgcgcgcgcgcgctcgctgtcgctgacaggtgggtcccacctgtcaatcttcgtcttcctcgcgccgccaccaccgcccgaaccctagcgccgcgccgccgccgtctccttccaaattcggccgcgccttttccttctccggtgaaatcaatagaggggaaatgatctccgggatctcctccaccttttctcttttggaatcatcggctaatttcgtttggaaatccatggattcgaggtcgattcggatcggtctctctcctccgaaccctaacctttccttcttgtcgctggtcgccatgggccttcgccaccgcctccttgcccctataaaaggatccccaagtccgccgctacccgtcgccacccttgccttcgtctctcgccgtcggaagcgccctagcgccgtgagaccttgtgccgttgtcgtcgccgtcgctccagccgtgcttcgccgtcgttccagtcgtcgccgtcgctcggggagaccgccatcgtggtcgtcatcgcgtcgccgtcctcgtccgccccttcgccgtcgctgtagaccgccggagcatcgccgtcgtcgtcaagccgaaggaccccgccgccttttcctcgacgccgccgccgtctgttcatcttccgccgtcgttttggtcatcggtgagttcgccgcgtcgcgctctacgtcctggtgccctccgtttatgccgtagcgccgtcgttcgccggcgagcttgcgctcccgagccgccgccggaggtgacgtcgccgctgacgtcatcgggaccgtccgccgtggcccggtcgtggaccgttcgatctcagccgtccgttttggataggatcgatcccgaccgttcgttcccgcgaaccgctgccgtgcacccggtccaccgcaaaccctagccgctgacgcaataaaccctttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcttttttgcttagattccgacgtttccggagagtccgttttcgcaggagaagaatttgaagagttccaaggccagtaaggcaagtcacacagattccaaacaaccctttgagcatgttgatcccgtttaaagctactgtttctattcaactattgcatttattttcgaatgtcattgggtggaattaacctattgtttgttatagcccctttgttcttgcttactttattccttgataccttgggtgtttataactcgactagttgggctatatatattggttcagctagatattagatgtgattgcttagccatgcttagaaacattagcacactattgggataacttatgattcactattaattaatgatggcttactgatagttcacgatggtcaatcgtgattggttaattaattatttgccaattaaaacctgataatgttgggttgtgagcacatggttttgagagatcgtgctcatgacaattaaggaccggttcacgagtttcggttgtgaaacattaaccgtgccaaccacaagccagcgtgggcaacggctttacctttggtatagcatggttcattgcggagcaccagactgagaagtggcggagataagcccacgggggtcgctggggagtccatgccttgtttataagggggtgattatgatccaggaaaggtgcgctgcggtggattgtgttgtgcgaggggtattgtcacagctcctttccgaggtaccgtggtggtattgaggcacatggagacatgatgtggggctgtgtcttgtgggtacagtggtacacctctggccagagtaaaactattcgaatagccgtgcccgcggttatgggcaggtctaaaaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatatcatatactcaccttgcaatcactcatcagaggaagggttctacagtgatgctgatggtgtggaggattaggtgtagccctggtcaagctgcctgtggagtggagtcgtctgcgccgtttatcttatctttccgctgcttagatttttattgattgagcggaactatctacctctgtaatgacattttgttcgcttattaattagagtaataattgtactcaattatcaatttgttattgtgtgcctcggctgattcttggacgagggttcacacacatgtaagcgtttggaattttggatagaaattctgggcgtgacaagttggtatcagagcccccttgaccctaggttatgccaaacggttacccatagaagccctctaaaaatattggaaaagtagaactgttctcctccccttctcttttaattaaaccaaactaatagcacatgcaattcataatctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttagatgccgtgctacaagcctgagtacttgtttggtgttgagggatttgtccaggagttgcgtacgatgtcctttgccataggatttgggactacccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatctctaccatcctcgcaaccacagggaagtgaccgtggcagctaccttgagactgaaggaattgagaatgatgctaccacaaagcatttggttgagatgctgtgggctatggatgaaacccgtgcagagactgtgttagcagctcaagatcgtgaagaccggaatcatggtaagatttgcaagctataggacaaagtggatcgtttagagaaggaactagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcgaatcctccggtcgtcaacgtaagtgatgatgaaggagaagaatccaagcgcacccattccaagatcgagtggggagcaactcaagatgatgaagacgagccgaacgagccttcaatcaactccgatgcccggaagaactagaatgccttgtcaaacagttgtcttagatcgttgtgttagtttgcttgttttaagtttggttgtgtgtgtctcgcatgtgatttacatcagtggtgggatgtaagtccatgcgtttgtttgctttcgagtgttaggtagttggtgagtttagtggtgtgagagtctttagttttgtaataatgaaactcacttaagatcaataaaagttaaattaattctctgtcctaagtagtttttcccggtttctcttcttgtgatcctgcccatgccagatggtgctcactcgcagcaacgggaatggccccaacaacaacaataacaacaacaatggagagaatcccacacttgcccaagtcctggctcaacaggtacagcttatgaacataatgatgcagcaacttcagaaccagcagaaccagggaaataatcatgcacctcctcagaacaagttagcagaatttcttcatgtgaggccgcctactttctctagtaccactaatcctgttgaagctggcgattggctgcatgccatagaaaagaagttggatttgcttcagtgcaccgatcaggagaaggtctcatttgcatcacatcagttgcatggccttgcctctgaatggtgggatcacttccgcctgaacaggactactactgaacctatcacttggcttgaattcaccgctgctttccggaagacgcatataccatcgggagtggtgtctctcaagaagaaggaattcaggtcgctcactcaggggtctcgctctgttactgagtatctgcacgaattcaatcgtctggctcgttatgctccggaagatgtgcgcactgatgaagagcgacatgagaggttcttggaaggacttaatgatgagctttcttacccactcatgactggggattatcatgatttccagaagttagtggataaggctattcgccaggagggcaagtacaaccgcatggagcagaagaaacgccggattgctcaattcaaggcacaacaagggaatagtcagaggccgcgtcttactttaggaccccagtccatgcgacagggaggttcttcgtctgttgttcgtccgcagcgtcagttcttcaacaacaatgcgggcaacaacatccgcaatcaagctccacgccctgttgcagcttcgacacagcaacagcctgccaagaaggagcaaggcagcaagcccgtggtgtgcttcaactgtggagacccaggacattacgctgacaagtgtccgaagccccgacgcgtgaaggttgtccctgcccagagcaactctactgtaccagcatcaaaggcccgtgtcaatcatgttgctgctgcagaagcccaaggtgctccggatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcctgttagaatccaaagaccttgatgtcatcttagggatggactggttagccagatataaaggtgtgatagactgtgccaacagaaaagtaactatcaccagtaatgatggtcgagttgtaactgttcatgcattgtcttctgagcctttaaggtcaagactgaaccaaataactttggaagagattcctatagtccgggagtatcccgatgtgttcccagacgatttacctggtatgccgcctaaaagggatatagagttcagaatagatttggtaccaggaacgactccgatccataagagaccttatagaatggcagccaatgagttggcagaagtcaagaggcaagtagacgatttgcttcagaaaggatacatcagaccgagttcatctccatggggagctccggttatttttgtggaaaagaaagatcatacccagaggatgtgtgtagactatcgtgcactaaatgatgtgactatcaagaataagtatccgctgcccagaattgatgatttgtttgatcagcttaaaggtgccatcgttttctccaagatagatcttcgatcagggtatcaccagttgaggatcaaagaggaagatatacctaagacagcttttaccactaggtatggattgttcgaatgtactgttatgtcttttggacttaccaatgcccccgctttcttcataaacttgatgaataaggtgtttatggaatacctagacaagttcgtggtggtctttattgatgacattcttatctactcccgaaccaaagaagagcatgaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccataaccaattggaaacaaccaaagacagtttcagagattcgcagtttcctaggccttgcaggatattatcggaggtttatagagaatttttccaagattgctaagcccatgacacgattgcttcaaaaggatgtgaagtacaagtggtcagaagaatgtaagcagagttttcaagagttgaagaatcgcttaatatcagctcctattttgattttacctgatccaaagaagggtttccaagtgtattgtgatgcatcccaacttgggttaggttgtgttctgatgcaagatgggaaggtggttgcatatgcatctcgtcagttacgtccgcatgagaagaactaccctactcatgatcttgagttagctgcagtaattcatgcgttgaagatttggcgccattatcttttcggtacttgtatagaggtgtataccgatcacaagagtttaaagtatatttttactcagccggatctgaacatgagacaacggagatggttggaattaattaaggattatgacatgggaattcagtatcacccgggaaaggctaatgttgtagcagatgctcttagcaggaaaggctattgcaatgctacggaaggacgacagttgccattggaattatgcaaggaatttgaaagattaaatttgggaattgtcagaagaggtttcgttgcagccttagaagcaaagcccactctaattgatcaagttagagaagcccaaattaatgatcctgatattcaagaaatcaagaagaatatgagaagagggaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcgaggaaagattttggtgggcaagtatgaagcgtgaaatcgcagaatacgtagcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtggtagtcgacagacttaccaaagtggctcatttcatcccagtaaagacaacctattccggaagttggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgtagacagacggacaaaccgaaagggtgaatcagattttggaagatatgttgagagcttgtgctttagacttcggtggaagttgggataggaatctaccttatgcagaattttcgtacaacaacagttatcaagctagtcttcagatggctccttacgaagcactgtatggtcggaagtgccgcactccgcttttgtgggatcaaacaggagaacgtcaggttttcgggacggacatcctaagggaagcagaagagaaggtgaaaatcattcaagaaaggttgcgtgtggcccagtctcgtcataagagttatgccgacaatcgtcgtagagatctaagttttgacgaaggagattatgtgtatcttcgtgtcacgcctcttcgaggagttcatcgttttcacaccaaaggaaaattggtaccgcattttgtgggaccttataagattgtcaatagaagaggagaggttgcttatcagttggagttacctcaatctttggcaggagttcataatgtgttccatgtgtcgcaattgaaaaagtgtttaagggtacctaccgaagaagctaatcttgaacagatagaagtccaagaggatctgacctatgttcagaaaccaatccgtatcttggaaatagaagagagaagaaccagaaatcgagttatccgtttttacaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctacaaatcctaaatatataaattgttgtttaattggaattatttttaaaaggctagaagagaaaatttaattttaattaacaaattccaatataaaatggggccagataaaatttcattaaatactttgtttaattctataattcctagatttttctgcgatttatttgagctaaggaagtatttttaataaatggaattgcatttcatgaataatttaaattgaaaaaggtttttaaaagtctcttttagctttgagccgaaagtcggcccaaaacctcctctctctttcccccggcccaagtcggcccagtccgcagccgtccgcgcgcgcgcgctcgctgtcgctgacaggtgggtcccacctgtcagtcttcgtcttcctcgcgccgccaccaccgcccgaaccctagcgccgcgccgccgccgtctccttccaagttcggccgcgccttttccttctccggtgaaatcaatagaggggaaatgatctctgggatctcctccaccttttctcttttggaatcatcggctaatttcgtttggaaatccatggattcgaggtcgattcggatcggtctctctcctccgaaccctaacctttccttcttgtcgctggtcgccgtgggccttcgccaccgcctccttgcccctataaaaggatccccaagtccgccgctacccgtcgccacccttgctttcgtctctcgccgtcgaaagcgccctagccccgtgagaccttgtgccgttgtcgtcgccgtcgctccagccgtgcttcgccgtcgttccagtcgtcgccgtcgctcggggagaccgccatcgtggtcgtcatcgcgtccccgtcctcgtccgccctttcgccgtcgctgtagaccgccggagcatcgccgtcgtcgtcaagccgaaggaccccgccgccttttcctcgacgccgccgccgtctgttcatctgatgaactactgtacatctagtcatccattnaaccact

SEQ ID NO: 62163 - DNA, 14355 bp, Oryza sativa
  unsure (1)..(14355): unsure at all n locations
gcatcatcctgaagataagcatagggatcctcctcgacttcattgccatccactgattaaattttgtaatagcaagagtgagtaccaaccgtactcagcaagccatcataacaacagtgcatatgatagagatattcaaggtacggccattggtttatttgcataaagctaatttcacaattcttttcacaagcctattatctagtatagactagtccagttttaattccagtgtttattacacagcaacggttctgttcgccacccctttatcttcccaaagatggcttcccgttaccggccgtaatggttttctggggtttactccttttcttctctcgaggaggtgatccgccagaagaaaatcatcatgcatatcccatcctaatcaatttaagaatttagagtctagccaagtgtaatacatgtcccgatgctcaatatccgcgagcacggctattcgaatagattggttttactcacactgcagtggatgtacactttacccgtactccgcgacttgcccaacacatgagcctacgtcccaacgaatgagacttgccacggcaaagcctttcaataacctcacgttgacagtacccgctccatgaacttgcatcctcatgcactctaggcgttataagtttctaacagtgagaggagttctggcgctcccgggaagggaagactcacacatgcattaagttttagttaagtccagtttacacatggcagtcctaccgatggcgacaccattgtaggcactcgcccctcgcgaccccaccaatggctgccccaccgtaggccctgacccacacacactaagaataaccactatgcagggatactgccttcgcttggctgtgtactccgctaggtctatacccatacgagaagtacggttgtacgagggtcatttcatgcttaacttcatggctcggtgtcacgaccggaaataacccaacgggcgttcctgacgtgcgtgcattattccttgtcccaggaggcaaggtacaccaaaagttgatacaattcagagtttaacaagcggaagcgtaaatagttaacttattacatgggcagcgaaggcccagcacacacagagacaaacgagaaacagcggaagactagggcgatgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaaaggaattatactataaagggttagggtttgcagtaaacagcatttaaagatatttagttgctcaaagctattttgtaaacacgattctagaactgtacaatattatttatcaaggccgtgaacccacacgaacctgccttaacccaaggcctacgatgattcagaccgaactggcaacccgaccctgggtcccagctcgtcccaagccaacccaggccaaccaatccacattttagctgttaagcaggttttaagaattaaaacactaacttgggtacattgctcggctcgcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagaatgtccatcgacccccgacttcgtccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaggtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttgaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccaggtgcacccggctcacaccggccggcgccgtgggtcctatgcgtcagccgcacccgagggcgcgggcggctgacggccgggccccacatggcagccgcggggcgcgcccaaaggcggcctcgccggcacagccgacgggaggcggcgcacccgcgccccgatggtcgccgccggcgaccaccggcgcggcggagcggcgcccgagagaggcgagggaagggggaaatgaaacggcggtccacggctcaccccgggtcgacggcgacgacgggaacggcgaccggagcggaggaaagcggcggcgcggctcgggttgacgaggacggcggcgttccggcggtcggcgggcgaagcggaggagtggacgaggtcggcgaggacgcggcgaagctgaaggaggcgatgccgaagcgggaggaggtccggggcgacgacggcggcggaccggagctcggcggcgacggcggagagagagggcgacggcgcgagctcgattccgacggggagagagagcggcgagtggcggaaacggaggagggaggcacggggatggtttatatagggttgggagcgagagagggcggccggaggagaaggaaaccggcgcggcgctctcgggctccatcaatggcgccggcgagatttgcgggggcaaatccgcccgtttgaacgcgagagagagaggggaaaatggggggaaagggagagggaatcacggggagtgatttccccctctttattgcacgcgggggcggcgggatgcggcggaatccgcggcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcgggggagaggagagagagggagagggaggtggaccgagccggcccaagaaggggagggggggaaaaagggactttttagggtttttctttttataaactcattttaactttgtttatttcttcttaattattatttgtgctctgaaaattccactaaaatttatttacgcattttaggcttttaggaaatatacaaaaatcctccaagccttattcgacttttatatttgcacattttaattgttggaggctttcacacgaattttaattattctcggcacaatttcgaggatgtattttagagtcgttttgggacgcgacactcggtccttaactgaccagggacagcactagccttttccggacaccacccaagtaccctagccgccccggtcgaaaacagtgtttaattttgtttctcttttcacaattcatgttatccttgtcatggcaatgtggtgtccacgcctccacatgccgcatctcaactaccttccctaaggtagttgcccaagcatatagcacttgataaatatgagaatgcatgattctaattagcatgactaagcatttgttcaatatcgactaagtacacacgttagcacggtttgcaatggtcatatggataatcaatatcaaggcatggcatatttaacaagtagggcattcatattcacatatgtatagcatgcaattttatttaaatcaacataattttcgcaataggttcaacatgctcaaagattagtgatgacttgccttgatcgcagtcttgctgacccagatcttcgattaactcagcaactccttcggaatctaaatttacgtgcgaaagattgatttgaattcaattagaattcatattaaatcaccaaaaattcaacagtacaaaaataaatagcaaaagtggttccatcagaaagatcttgattttagatgaatttaggttcaagtttcattcaaatccgagctaaaatgaatgagttatgcttgtttaaagattcaaatttgaattaattcaaacaattgtgaaatggcactgtgcagccgagaggggcattattacagtggctgacatgtgggccatcccccaattttatttccggtttttttttattattattttttttaaaggaaatcctattgtgtcattgacaggtgggtccggccccctgttgactgaggtcaagccggccttttaatccccggtgcgacccgcatgtcattgagacatttacttaaaacctaatttaattagatttctaagcatccgggcctacatgtcataggttcataataatactattagtttggggattactgtgcgctaatgaaatggggtccacatgtcataacccctccctctctcgtgtcttctctctctcccgtcgtcttcaacctcgcgcgcgcggccgaacagaggagcagtgcgcggcggcgcgacggcccgagccggaacagctcggcgcacggcgaggcgagcggcggcgcatcaccggatgcccgccggtggcggcggcgaagcgcggcgaccgttcggcgcgcggcacgacggcgcgcgtcggcgccgagatcccaaactcggcggcggcacgatgaggaccaatgtgagcgcaaccggctacgattcaaccatctagggtccacatggagtatatataagcaaaatctagcctaggttgtattggaacgaagtccccccacggcgagctcaaccatggcgcagtggcggccggtgccggcacggttacggcggcgcacaccccaaatcgagggggccgggggtttctaggtgactaggcgggactactggcgcgagggcttaccacgaagtggcggaacggcgaagttcgacggcgagtggcgcggcgcggtccaaatagggacggacggcggtcggcgacgggcgcaggtgttcgacgctcgacctccctcgcgtaacggctcccggctccctccatagcagcaacgggaacgggcacacctncttaaacaccccgccacccacactggccgagaagccctgtggcggcggcgcagccggcgcccaccaggtgttcgacacccggcgacggcgtgatcctgcccctcttcggtggagcaaaagttttagagagaggaagagttaatggaatgttgagttcggataagaacgagccaaggacaagcctatataagcgagagggagagcgattccttaatggataagggtgatcgatgacgcggctctgtttcgattcctcctaggttcgattcaatgccctgggccggcatgattgcctacgcggtagtatgcaggagaggtctcgctagctggagaaaggggcaccgcattacccagcggtcgcaaccgggggtgacaagatggagacgcgacggggacgtgatggcgacaagagcgacggcgatgggcagtggtaacggcttggatagggggcgccgggctatgccctagggtgacgcgggcacccgtggtggccattatcactccatcccgagggcgacgcgcgaggggacgggatgacgcgggcacccgtggcggcgcagcctttggcgcgggcttttggccgcttggtcggcggcgggcccacacagcttggcatgacgcggtgcggcgcacgggcacgactagtgtggcgcacgagtcggaaggcaggcgcgtggcacggcagcgattggcgagggtggcgccgggtgttcggttgggttaggcacagatcgaacacctggcgcgcaatgaacagtagcgccaggaaaagaaaaaggaagagaagagaaaggataagggaaaaaggaagagctaaattgcaaaatggcttggaattgagttgtaactctacatattttgaattcaagaattcaaacatttgatttgaatatttatttatttattcatatatctaccaaatgattttacccatcacatatacttctaatttcctgatttattgaacctaagaattaaggattaatattattactcttgacctatattccttaatccctgattttataaattctaatctttgtttttcctataacctcatttttggtttatttcaccttaggtcattactaatattccattcgcattatgtttttcttattttgccatattctggattttattatttgacttccatctcaacatacacctcttatagtatttgaattaaacaatatatttgcaatatataaacgaataacaccagcatgatgcaaagtttttaaaaagttcgaatttttagtgatttttattattgaggatttttaggatgttacatctttctcatggggcactcgcgggtggatggtcttcctcacaatgaaagcaggtagtggcacacgagctagcaacatgaccgatttctccacaacgagagcatgccttatgttccattttattctggttgaaaccttggggagacttctcatcttcatcatctgaggagacttgatctgaatcttcactatcatacactctacctccactagctaaaagatgctctgtcaactgtggtgcacctcggaaggaatttcttctctgacgttttgtcattcctggtggaggccattctgtgctggtaatgatcatcttacggacttcatcttcggttcgcattggtgcttttcttttctgctgaggacagttccttgcatagtgcccttgttcatcacacataaaacaaatgattcttgcttcttttgagtcaacatgtgacatggcatgaggggccttctgggatgttggcggtgcgctgacttgtggtgtgagtgcttggactgcctccaactgcacttaaggttgcatctgactccggttcagaattggcgtccgatgctgctgtagtatctctataagcaatttgttctgcttaatcaagtgttggaccactgccacacaattggtgtctggtgcttcattcactcgggagcttgaggtacccatgtcctgacttctgaccttattgcctttctcattgtcagccatctgttgcaaggtttggagagggagagagggaaaacaaaggggagagacagatcaaaaactaaggataggaccttaacagatctaagtcttttgctgttatgatgtatgttaggcttattctgcaagttgattaagcaaacaacctagcatggttacatcacaccccactgatgcaaaccacgtgctacacacacaagcaaggaaacacacgactatcgaaaccctagagggtggcttaggttctacgacgggttctctaagatcttcactcctgcttcacatctagcttcactgcttccttcgcttcgctagcggaccctgcggtcttccggagcttcggcaaacaattggcgacatctttttcttcgcaaaactaaccatctagtactagttgaaaatctgaaggaggaagaagagaataaacattttgcaaatagcattagggaaaggaggaaaaaggaactttcgcaaatagtttcatttataaaatatgtccttaggttttatccacttggcttatcctacagtcgagatggctctgataccaccttgtcaccaccgagaaaatttgcattttcccgaacgctagtgtattaattcccgtcccaggaaaagccggggtacaccacacaaacatgatataaaagacacatctttattataaagataatatttacattattacaaaggcacctcaggcttgacaaacaaaaaaaaacagcagcggactagcgggcctacggctccatcttcacaggcgctcaactggggtataagccaggacaccacctaagacttcttctccaaagcttctcttactgaagtgggggaaagattgagcaagaatgagtacaaccaccgtactcagcaagccacatcggcagatgcatgattaatgcaaggggggtacaaggggataataataggggttaggttttgctgtaaacagcatttataagtcacttagttgcccaaatctattttgtaaacacgatccaagagctacacaatattattaatcaaggccgtgaacccacatgaacctgccttaacccaaggcctacgatgattcagactgaactggcaacccgacctgggtcccagctagtctcaagccaacccaggccaacctttccacattttagttattaagcaaattttaagaattaaaccactaacttgggtacattgctaggcttgcccatatctgagggctcggctattcgaatagatttactctgatcagaggtgtacatctttacccacaagacacatctttactccgcattccatgggcatggaacccgtcgtaaacatgtgacataacccttcacccatcctagccgtgtagtcttcatttgcctagacatctcgattaccgagccgcagctcgcgtagcctttatttggctcagagatatccatcgtcgcaacgacttcatccatctctatccatgtccttttgttcaggactagactgagcaccaagttaagccttacccattagacatgtggttagtacggtagtgctttgcaacagaggcccaaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagttataaaaccacctaatgttgcctaattattcagcgagcatctacctaaattcatactagtggaaccatgaatagattacccactagttggggttttattttcctagggtgaacaaggtaataataaacaatagcaataataataaggtcataacaaaggtaaataggcatggccaaataaaacagtgataacacgggaatttaaataaagcgataatgcattaatttaaatcaaaataattttataaactaggattcaatatgctcaaggatgatgtgacttgccttgctcagagagaacggccttccgaacgctcggcgacgaccgcaaaccacgcttcgggaacctccggaacgacaaaagctacgcgaagcacacaagcaaagctacaagcctataaagaagcaataagaatacataaaaagaaagcacagggttcttaaggatataacaaacattaagagacttgaacgggtcgattcagagttcgtatgaccaagatatgatcatccgaagtttaatgctgttatatgaagatttacggattattgtgatttggtttcgcaattataaaacatgtgtaagtgctaacctggaaaagacaggaaggctgcgcttgttgacatgcagactccacatgtcaacctaagggaccacggtggaccgggtacacagagacggtccgcgggtcgacggaagcggaccccgtgtgtcaaccgaggcgagtagccgacaaacggactccaccagacaccacgcgggctgcacacgtagaaaccacgtggctatcgagcgggcacactaacatggtctccacacgcacaagcgaacgactaccgacaccggtacacgggtaccggggtcgacagccgcacaacgggtacggggcgacaccgaaaggacgaggacgagggcgacgagggagagatccttaccaccacgcgatgaggcgtgggaatgacaaagacgaacgagcgcggcggagacgactcggggacgacggaggcgaacggcgagggaacgacttcggcggcgatccttggacgaaggcgagacgcggccggcgcagggcttgacgacgcggaggcgaggacgaagacgacgacggggctgcagcggcacacttgacggacgcggacgacggacgagaacgacttgacggagggacgaacgccacgacgaccgggaacgacgagaggacgacaacgatgacgaccagggccggcgaggagacgatgatggcagctggcggcagctgcacagagctgaggccggcgtgggacacgccgcagcaatgcccacgacggcggcggcacaacgagacgaggagccggcgaggaggagcggccgaccgaagggacgtcggcgacgacgaggatggagaggaggcgatgccgaggacgatgtcaccagttcgccgctgcgatgccggaggtggtggtggcgcggccgacggcgcacgggtagaggaagggccaaccggggaaattccggcgaggtggatggagaggccggcacggcacggcggtgttccggcgaaaccgaggagtggccggggaaggagacgatgccgcggtatcgaaggaggagacgaaggcgtcgatcggcgtatcggtgatgaacaggagccggccggagacggtgtagtggtggcgacgccactgaacgccggcgagaacgcgcctccggtgctctccgcgctaaacggaggacggcccgggggagaggaggcggctgcgaggctgctggtggcgacggcgcgaccggatggcgctccggcgaggtgggagaggcggctggaggcggccggcggcacaggagagagaggaggacggcggggagaggtggtgaggccacgggagagcgcgggagggggctaaaatgatagaacggagtgagggggttccattgtataggatggtggagggagccgggcatgggagagggcggaacggcgacgggaaacacggccagcggccatggaaggcggccgggaatggcagggccgttccaggcgttagagggcacgaatcaagggggaaattgggggtaatcaaagaggaatcaatggggattaattccccctatttaattttggaatcccatgagtaaatcgcacggatttgagggaggaaaggagctagggttcacgggagagagaggaaggaggccgggcgggaggaggatgatgacccggcgcatgggacccacgcagggagtgcggtcagcgcgcgtgcggcgcgcgtgaggggtgtgcggctcgggaggctggggcggcttgggccggtaggcggcccaggcgggaggggaggaaaagggagtgggccgggaggggaaggggaggcccaagagaaggagggagagaaagagagggaggaagagaggacttgggccgcgggccgagggagagagaaagggaggactttgggccagacttggcccaaaggtggaaggaggattatttttaggtttttctttttaataaactttgataattgttgttgttgcttaataaatattttcggtgctctgaaaattcaagtaaaatttgagggctcattttagaccaaggagaatttaacaaaaattctccgggccacattcgaatttttcttgtacgtattttagtgtttgccaatttcttttcaaattttaattaattctattattccttttagaaaataatttttatttcgggatgaatttatcaggacgtgacaaatgtgccatttttggatgctatgcaagtaccaacatacgcccgttatctcaaggtcatactcaacaacaagagaccgctcccaacaacggaggtggtcaagctaacggaacactgcagcaacctgatactccacaagctccaggagaagaagaaagatccggggtgtcccacgatcacctgctcgatcggggcacaacaattcgtccatgccttgtgcgaccttggagctagtgtcagcgtcatgccaaaaaacgtctttgacaaactcaacttcatggtgttggcaccaacaccgatgtgcctccaactggctgattcatcagttcgttacccggcggggatagtggaggatgtgcctgttaagatacggaatttcttcatcccggttgattttgtggtgctagacatggacatggggaaggagacaccgctcatactggggcgtccgttccttagcaccgcaggagccaacagtgacgtgggaacggggagtgatacagtattaccataatacaaacggagatagagagattaatagttatagagatttacaaccgaggaacggaacaatgcttcatggtcagaatcaagtacaggccaaacccgcagaacattcaagaggtcgaagtggagcaacccaagacggatagcctggtaaggttcatgcagaacttcctgggaaaggaaacaacaatgcccaggaaccgttattggaggacgctagtaaaatcacctgtaccggccaagaagttagagcagccagctcagaggaagccgtcttctgcactaaaatacaaaggtgtggaaggaaaagccaaagacgcccgctccattacctccggagacgggtggaaaatccgtgaactgaatcgaaaggaggtatggtcttgcacgacggactttaaatgacgcgaccttcgccaacaggtaaattggtatgtatccgcatatttgttttcaacaatttgaatttttgcatcaccacatatttgaatttcaaaattgcttttaggacttttgaattttgaggaaattcttcaaatgaatttttcagagcaaaccaaaataaaattttcaacgaaaattcactgtgccacgatcacactgaccgttggattccaacggccgaaagtggggccggttgggcccactaggggttcgcccgaaccggccaggcaacggtcagctgcctcactttttgaggcaacggctagtgggttccacatgtcatttttgaccgttgtgggtatcctacaaaagccagccggccgagagagggaattctaccccatttcaactcattttcatttcctctccaaagtttgctcccaagttcattcatgctttgatagttttcctcaacttcaactctttagttgcatacatacaagttgctttggtgaaactaacaggcgggtgaaactcttgtcatttctaacccccgccgagttagcctgttcttgctccattgtgtagtatgaggaggcaactgtctcgtctgttcaaggggtcgggctctctatcaagtcgtcatgacgagtctagtactcgttcatcagccgatgcctcgatggaaaacgccgacgctccgcgacaactcctgagcgacactgacctcgaccttgtcagtgatcgggagagacaagcctactacatcctgagcgaccgggagtatgctcacacgcgagaatactcaccggagttgctgaaaaagataggtttggatgttgaatttcgttctatttggaaagctgttggttggcagagatttgctgtggtagatgagtctggttctcgtttgcttactttgcaatttctgtgcactttgaaagaaatagaagatggtatttcttttcgccttttccgtaaggagttcacgctcacatggaaaggcttgagtacacttcttgtttttcacgattcctttaaaatcgatctccagaaaggaatttcttggttcaagaaaaataggttttgggaagatatttcgggtgctccaatttgcaagaaacctagaacgaatgatatccataatcctgcacttaggctcatgcacaaatggattgctatgactttgtttcctagagtgatctgagacccattaggggagatgaattaattatcatgtttgccatggttagaaagatc

SEQ ID NO: 62164 - DNA, 5112 bp, Oryza sativa
aatagaaaaagaggagcacgcaggcgcaaggagagagcttgcgcacacaagcacaaaacgaattcagattttctttttgggtggtcatgtagagcctctgcacccttattgtgcattcttctttattttgttttgacccgttttcctagaattcaatggttgggttccaggcattgggcatgagttctcgtgggagccatgcaaacattgtgagaaaatttccaaataggtcataaaacggataaaaatgcttgggcctaaactcacagtttttagcaagcctaatcctttaggaatttccatatttgaaattggacgattttggagagtaccattatgtagtcttgtaatccctctgtttcatatcataaggtgctttgattttttcctagtcaaactttgaccaagtttatagaaaaaaatagtcacatataaaacagcaaactagtttcattaaatctaacattgaatatattttgataatatgtttgttttgtgttgaaaatactaccatatttttctataaacttggttaaacttaacgaagtttgactaggaaaacagtcaaagcgacttataatatgaaatgtggggagtaattgcgtattggacatcaaatttgaagttactgttactggatcatgtacttgattgtatgggactatgggtcgaattttaatgtaatgttcgagtttaaaatttctagttagcgtcaaaataagcccaacaaagagttaagggatggtttatttctcaggttaagtttaaagcttagtccattgctccatttgaaaatctgaagccagttgggatagactatagagcttattaccagttcctttgcattgcaggtttctgatgagagagtaaaccatgatactgtgacctcacatgaaagtgaaattgggtctgggtccatctccacagttagctcaacagttagttcagtagaatcagagaaagcagcttatgaattccttgctcaaactcctatcaagtcaaccgatgcacaccttgttgagttttcagaagctatgagaagtaaggagacaaaagctttacatggcactaccaaattcctgattatctacagttatatatacctttcagtcctttcacttgcattcaaaaaacaaaatattgataaatatagtttatttttaaactgaagctgttgcaaaagcattgcgaccagttgcaaaagggaaagctgctgctcaagctgatgcggaagagtggaggcgtaaatatgaattagagatggcacacaaacagcagagaaaaatcaaaggttagttttgtatacattcgtagttgctattccaggagctatctccaaaaatctaaattggaattctaccttgtgcaggctatggcagttgtgccaataatgaattagaaaagttggccagccaactaacactggagacgcctgcatctgatcaagcgggatgttgtggaaatcatggtatatgttcacatgaggttcttcaggatgaaagtcctggtcctaacccccgatctagtcacaagctggtgagtagaaaggcatcatttagactttcatggggatgcaatggggataaaaacggccagcacaagcatgattttgtatcatttgaaaagggagatataacaacagcagagcgcagcaacaagcaggttagtcctcctgtgctggaacagtcaagaatattattctaattatttcactccagtagctggaataactagaccaatgaatcgtctcttatgcacatctatttctgttacaacgattttttttatttcagattttgctgaaatgggaatcctcgccacaaactgttcttttcataaccaaacctaattctaactccgtgcatgttctttgtgctgaaatggtcaggtgtgttctttgatttttatattttaaatgccctaaatatctgacagatgcatgcacgttttaagtattgtgtttgcactgctaaatgtactatttatttttctgcagatggcttaaggaacataaaaagataaatgttgttgtagagccacgtgttagcaaggaactcttaacagaagattcctactacaatttcatccaaacatgggatgatggtaaggcatttctattgatttaatacattagtttcatgctgattcatattttttcttttgaaatacttcatatgcttaagagaaaaaaaaatggtgtttcagttatgaaccctttccttgtcattgatattctgaaaaatgaaagaactttcatgataactaaattagttgattactgccgaaatggcatgggtatatagtacgggcatgcttttgctttactttatcacccttatgtatcctatcttgttttacatgggggcaaaatttacaatgagaactgaattagttgattactgcttgaattcgagatgtttattacctatgtctagatttttatgaaatcatccaatcacatctcaataaagatttcggtaaaaatccccttctactgcttgaatttgtgatgtttattacctctgtatggaattttctgaaatattccaatcacatcccaataaagtaatatccttgtactagatgtcggtacaaatcattcttggcattgaattggatacacattataaagttgtattttgtatcaaatgggaagattagacatcttgtttgagtaaagtagttctattcattcacctagcactctcccttatctgtgcaactaattagataattctgatagatgaggagaaaaagatgttgcacacaaaggttgatctcattgtaactcttggtggtgatgggactgttttatgggtaagtaaattcaattctttgtctagagttctgcctcaaccactgtatcttttgatcgaatcagaccaactagaggattaacctttttttttttccaaaggtccatatatttagtcaataatcaatattgcttagtttaatggcatatgtggggtagaattggctgacagctgaaatggaaggtctgtcggtgcctgcagcataagttatcatgagaattgcttcttcacagttaggcagagttcttttctgattctgacctatcaaaatcaaaagttggaaggttctagtacaaattagctatcaaaaccaacttacctgatatttattgctttgttcttccatatttaggcgactgattattcctgcatttgaaactataattgcttctcaatttgtactagttactagtttttgtacattgctctgctgggctgacatttaaatacatggtgaatcaatctcttaacaggctgcgtctttgttcaaagggcaagttcctccggttgttgctttctccctaggatcactgggattcatgacacctttccgtatccttttattatggatgttgactgctttctcgatatcgttttgtgtagtgactggttcttactgttttgctatccaatctacatttttagtaagtttggatttggtctaaaagaaacctgcttgttagacgataaatctcacatgaagctccctgctctcctgttaacatttgtgttatccatgttgtcctccttaacatgcttttcagcaagtgagcaatatcgtgattgtctggacaatgtgctgaatggaccatttagcatcacattgagaaaccgtctacagtgccatgtaatccgtgatgcagcaaaggatgaacttgagactgaggagccaattttagtgttaaacgaagtcacaattgaccgtggaatatcatcttaccttacctacttggaatgctactgtgatagttctttcgttacatgtgtacaaggggatggactgatcatatcaacaacatctggaagcacggcatattcattggcagctggaggatccatggttcatccacaggtatgccctacatcgcatgatacatccttagcacttgagtatttactgattaattttattggattatcttcttgggcatttcctaatcacacccccttagatttctgcaataaatcgtgaagcttttttccccttggttctaaaattgtgtaatgtggttcagaagtttagataagttgcactgaacaccagaatctgatctgtttcacaaacataggctaccctgtactacctgtaattcttgtagcaaattagcaatgtctataaattaaccttttgaggcctagttacaatcatgaaatgttgctatttcctttgtccatctgctcaacataacttgtcgactctattttggtggtctcaaatgttgtgctggtatatgcaggtcccaggaatcctattcacgccgatctgcccgcattccctgtcattcaggcctttgatactgcctgaatatgtgaccctgcgcgaacaagtgccacataacagcaggggccaagcttgggcatcatttgatggcaaagatcggaagctgctgtcacccggggatgctctcatctgcagcatttttccatggcctgtgcccacggcttgcctggtggattcaacatccgatttcttacccagcatccccgagggtctccactggaacctgagtaagtcccagtcattcgacggcccgcgtgattgatcccagctcctggatacagtccagtgtcagagttgagagtttcagctggccatcagaagagtttcccacgagtccagctaacaccgagcggataaatgtacctagcagagtttgttgcttgttaccattccatatacatatacatatacatatacatatactagaaggctgctgcgtgtagatttggggtaagtactggggactgaagaatgaatcgaaatagaaagtatcgagaatacactgtgccatgatgaatgtataacagtagatgtggcaggcaacatatactgatgtgcactagcatctgaagtagcatgggagagtagataccggtgacaagtcatcgaagtgtaaaaacacaacatgtatactggtatatatatgtacccccatgatctgaatgaaataatttgaccatggaaaggaaaccctgcgtactctgctgttacagtttggtgttcatgcaatccgccaattgagggtgtggagcagtggaagcttcactccagtttccacaaatcacaactgatgca

SEQ ID NO: 62165 - DNA, 6222 bp, Oryza sativa
aatagaaagtatcgagaatacactgtgccatgatgaatgtataacagtagatgtggcaggcaacatatactgatgtgcactagcatctgaagtagcatgggagagtagataccggtgacaagtcatcgaagtgtaaaaacacaacatgtatactggtatatatatgtacccccatgatctgaatgaaataatttgaccatggaaaggaaaccctgcgtactctgctgttacagtttggtgttcatgcaatccgccaattgagggtgtggagcagtggaagcttcactccagtttccacaaatcacaactgatgcatggatggtgagagcaacaacgcatccctgatttgaacccgtgcgtgcacggtcggtctcggtcagtgatacagtgatacagcctcagttcccgtgcagtgtcgcgttccggcgagagttggattccgagtggccggcgaccccatccggcagccaccccagcggcggaggaacgtgagctcttttgttgctttctatctgtccaacctaccccccctcacgggccttgcccacgccacgcacgccaatccaaccagcgtcccatttccctcctcgtctccccccgcgtccacttctccactcccaccaccaccatgcaacgcagccgctggcactagatctcccacgaccacctcgcctcgccaccatatctgcagctccactcccctcctcctcgttactgctgaaatggcgacgcctatcgcgttactgctgttcgtgctggtggtggcggcggcggctgacagtacgatgccgatgccggtgaacgaggaggtgctggggctggtggtgttcaagtcggcgctgtcggacccctccggcgcgctggcgacgtggacggagtccgacgcgacgccgtgcgggtgggcgcacgtggagtgcgacccggcgacgtcgcgcgtgctccgcctcgcgctcgacgggctcggcctctccggccgcatgccgcgggggctcgaccgcctcgccgcgctccagtcgctctccgtcgcccgcaacaacctctccggcgagctccccccggggctctccctgctcgcctcgctccgctccatcgacctctcctacaacgccttctccggcccgctccccggcgacgtcccgctcctcgcctccctccgctacctagacctcaccgcaatgccttctccggcccgctgcccgccacgttccccgccaccgtcagctttctcatgctctccggcaaccagttctccggcccgctgccgcagggcctctccaagagctccttcctgctccacctcaacctgttcgggaaccagctctccggctcgcaggacttcgccggcgcgctctgaccgctctcgcgcatgggcgccctcgacctctaccacaaccagttctcaggcaccgtcacccccggcattgccaacctccacaacgtcaagaccatcgacctcagcggcaacaggttcttcggcgccgtcccgagcgacattggcatgtgccctcacctcagcaccgtcgacataagctccaacgcgttcgacggcaagctccctgactctatcgcccatctcggctcgctcgtatacttcgccgcgtccggcaaccgcttctccggggatgtccctgcttggcttgccgacttggcggcgcttcagcacctcgatttctccgacaatgcgctcaccggccgcttgccggactcgctcgggaagctcaaggacctcaggtacctgagcatgtcagagaaccagctctccggtgccatcccggacgccatgtccggctgcacgaagctcgccgagcttcacctgagggccaacaacctcagcggcagcatcccggatgcactgttcgacgtcgggctggagacgctcgacatgtcgtcgaacgcgctctcgggcgtcctgccgtcgggctcgacgaagctggcggagaccctgcaatggctcgacctctccgtcaaccagatcaccggcggcatcccggcggagatggcgctcttcatgaacctccgctacctcaacctgtcccgcaacgacctccgcacccagctgccgccggagctcggccttctccgcaacctcaccgtgctcgacctccgcagcagcggcttgtacgggacaatgccgagcgacctgtgcgaggccggcagcctcgccgtgctccagctcgacggcaactccctcgccggccccatccccgacaacatcggcaactgttcgtccctctacctactgtaagtcaacaaattgctaattacatttacaatatcgtcgttgcgttgaggttgaagacgaagacgacgaatcgcgtgacacgtttgatcgatgcatcgggtttgccatggcaggagcttggggcacaacagcttgacggggccgataccggtgggcatgtcggagctgaagaagctggagattctgaggctggagtacaacaacctgagcggcgagataccgcagcagctgggcgggatcgagagcctcctggcggtgaacgtctcgcacaaccgcctcgtaggccggctgccggcgtcgggcgtgttccagagcctcgacgcgagcgcgctggagggcaacctcggcatctgcagcccgctggtgacgcagccgtgcaggatgaacgtggccaagccgctcgtgctcgaccccaacgagtacccgcacggcggcgacggcgacaacaacctcgagaccagcggccgcggcccggcgtcgccgaggaaacggcggttcctgagcgtgtccgccatggtggccatctgcgcggcggtgttcatcatcctcggggtcatcgtcatcaccctgctcaacatgtcggcgcggcggagggccggcgacggcgggacgacgacgccggagaaggagctggagagcatcgtgtcaagctcgaccaagtccagcaagctcgccacgggcaagatggtgacgttcgggccgggcaacagcctccgttccgaggacttcgtgggcggcgccgacgcgctgctgagcaaggcgacggagatcggccgcggcgtgttcgggacggtgtaccgcgcgtccgtcggcgagggcagggtggtcgccatcaagaagctcgcgacggcgagcatcgtggagtcccgcgacgacttcgaccgcgaggtccgcatcctggggaaggcgaggcaccccaacctactccccctcaagggctactactggacgccgcagctccagctcctcatcaccgactacgcgccgcacggcagcctggaggcgcggctccacggcaacggcgacggcgcgttcccgccgctgacatgggcggagcggttccgcatcgtggccggcacggcgagggggctcgcgcacctgcaccagtcgttccggccgccgatgatccactacaacgtgaagccgagcaacatcctgctcgacgagcagtgcaacccgatggtcggcgacttcgggctggcgcggctgctgccgaagctggacaagcacgtgatgagcagccggttccagggcgggatggggtacgtggcgccggagctggcgtgccagagcctccggatcaacgagaagtgcgatatctacggcttcggcgtgctcatcctggagctcgtcacggggcggagggccgtcgagtacggcgacgacgacgtggtcatcctcatcgaccaggtccgcgtcctcctcgaccacggcggcggcagcaacgtgctggagtgcgtcgacccgagcatcggcgagttcccggaggaggaggtgctgccggtgctcaagctcgggatggtgtgcacgtcgcagatcccatccaaccgcccgtccatggccgaggtcgtccagatcctgcaggtcatcaaggcccccgtcgctgcatcgtcagccagaatcgaagctttctgaattctgatcgatctgacgacgccacatcattactcctactaaaccacagggttaatgattccaaatcatcgaatcgatcacttgcattgcattgcatgcatgcatccgcaagtactacgtgttccctagtgcaaaaattgaaaggtctgagcagtaggcagtaatagtagtacgtacaactgttcctgccgtgctaattttctcagggtctttttttgtctctgcttttggatgtcagataaatctcattattattacgtggtgccttgttcgatctacacttctacagttctactactactctgctactgcaagtacgtgacccattactgctgcatcgtttctaaccgttcttaatactgccattggaccattggtgcccagctctggatggattctgtacatgcaacgcatggaaatatgctcacttgtgactgggctgagttgtaacaaagttggcgtgttgcattgcgcccccactacttacatatggacacggttccatctgggagttaatttgtttgtgccatactgccatagttgtcacattagcttagcctgtggttgacgagatgcccatgacttggagctgcatgaggcatgtgagtgcacagctaaagtgtgagtgaactcgggggtccactgcacaaaaaagcatgagaaattgagaagttttgtggataaataaattaatcctctcgcgcacacatgagccctggatatggtcttggaaagaaaataatggaggttgatttggcaccattgataggattggatcttggcattggacagatgttcattgctgcatgcgtacgttttccctttggtgcaggacattgggtgctacgtgacaaactgaccgagtactgtggtagctatcgctctttgctggtgtcatattatatatatgtttctgctaaatctggattaactaatcgattaatcaacttggtttcaagtttaactaacacatggaataaaaatgtcacatcaatgcgttgtataaggccgtgcaggtcattctcatcttaccaatgaactgcgagtctgcgaccccgtgagtgcacagtttttgtaagctgcaaccaatttggtactactatactactattcctacatgtcaaaatgtgattttgcttgtaacataaattttacaatttgggggcacacagttcagatttccgcctttcacctttttttttttgacctgtcagtttactcttttgacgtgtcagttgggtagtttactggtggccccgtacctggaaagattatttggaatgtgaccctacccagctgcactgcttgtacaggatggtcacgtccaatgggggtcggagattaaactccgaacccctttgcctcagctgattatttcccatccctttacggtttggtagctgaaatgctgaatgatgtatgcgccgttgtgttgaaccctttcctaattacaaactgtatcctatacgtagtgtacaacatatgaacagaaagtcagaaactagcgttgtagactacttatatgctagtgcatagatattgtcagtgaatggtgataaatcaagtctagggccatctcaattagcaccttaatttgctgaatcgctgtgaacaaaacaaactgatgcccggttgccaggtaatattgatgatgatctctcagtatgttctgctactatggagtataccacacgttctaatgttttttcatagcccagatctgtacaaagagactttgcagcaataattgatgaaagtcgacaaatacgaagcaacacagagacagaggcatctgcaagtcttgaagctatacacaaactgatgaattcctacgcataaaaacacgtccttactggcaaaaactgttggtttctgaagcacgagaacgacaggagaaatggaagagaggatgactgcatttctcggtaccactgccgtaagagtgaattcaaatgaagaacaaaacatggatcacttaacaagaattctcactgaaatgcagacaagagagtaatcccatatcgaagtgccactagcagtaacacttaacgaggcggttttgtctgatcttggactgtcttgttgttccttgtccatatgctgtaggcttttcattcttttcggggtgagagtgatgtgtccaggagtagagccttagtttaaccaaccgcatcttccagataaattaccaactcttgtttgattttttttttgagggcctgatttgaatttcgaactcgaattgccttctccattctcctagccatcaggtctctctctttttgataaataatgctgtagcagaaatggactgaccagccaactgggttcatggtttgtttgaa

SEQ ID NO: 62166 - DNA, 4859 bp, Oryza sativa
  unsure (1)..(4859): unsure at all n locations
ctctgtcgttaagttttaattctagtgagtctgacaaagtatatgttgcacaaaagactggcagagtactgaggctgagatctaacctttttaaagaacagggtaactgttaactcatgtggatttctttcacagttaactgattttctgtagctcctagttggttctaaactgaaatttgaagcatgaaaactttacaagtgggatatattgaggaaaaaatggcattcataatcggtttcctagggtggctagttcaattgtttcactatgcaggtgttgttgccaaaaataaaaaagatcagtgatatacgtttctgttttggatggcagtaatctatcgacaccttttacccttctatccataagacaatttgttatgcatactaatcttcaatccttccagattggcaccggtgtcacgaatgcactgataaaagcaaggaaggctgttgacaaagagctagatgacgaagttgaagatattccagttttgtcaactagtgttgcttatggtgtatacatggcagtatctagtaacctcaggtaaacattatcttcaaactactcaccatttgtagcatacttaagtcatgctaaacgtgtgaataaatgtcctgtcgttttgttactaagggacctggaggacttaccccaccgttgaaattgttttacctgtttctctcttcaaacaggcaaaccgttgtagagattatacatgaacaatccttgtgcagataaacagttgcttcttttttaaatggattattttttacaacaaaaatcatattcatcaccaggtaccagattttggctggtgtaatcgaacagaggatgctggagcccctactacataaccacaagcttctattgagtgctctatgctttgctgttcgcacgggcaacacattcttgggttctttactgtgagtaatatttacctcgcatgaagtttaactcctgaccttggggcagtaatgttacttactgatgaacttttgttaccagatgggttgactatgccaggtgggtaggcgtacaaaaggttcaagaagaggcctaatgttggcataccgtaagttactacgatatgtattctacaacgtcacgacattcttctcttcatagggaacatctttactggtaaaggcagaagataggcatctccatatgtcgaattcatatcaacagtgtcaccgtatttttcttcatagcctgcaacttgtaagacttgtctttgtaatatacgagtttttgacccaacgagcactcggagggacctgtttattggttgtctttgttctaggattgtcgtgccttttattttcacttatggggactgttgacagcactctgccggagtttactcatgtaatgttgataaaggactgtcagtctgtcaccatagcattcgtctgaagaaaaacactcttcccgtttcactttgcctaattcgcatctttcgtatggttcgattgattctgaaaattatgcaggatcacacacaagatgaggggtttagcacaagtgtcgtctcaaagatacctttctcctatattgctatttgggccttacacacatcataggctgggccgagggagatagcaagatagcccattaacagcagcaaataaaccctaataaaccatgacagcctctcgatctcctcgtatttccccaaacccttgccgccacgatccagacgtccatcgttcccgccgctggtgcagcagccaattgcgatgtcgtcgtggccgccgccgccgccggtgcaactcagcatgcagttcctccctccccggccggagccggccgccgccgcgcgcacgtncatctgctgcacctgcggcgtccccatggcgcccaacgcggccaacacgtgcgccctctgcatccgctcgcgcgtcgacatcgcggcgggggtgccgcgccacgccgacgtggtgcactggccgtcctgctcctcctacctccacccgccgcggttctggctccgcgccgcgccggagtcgccggagctcatgagcctcctcctccgccgcgtcgaccgccacatcgcccgcctaggcgtcgccctcgccgccgcggagttcgtcttcaccgagccccactcgaggcgcctcatgctccgcctccgcctccggggcgaggtcctccacggcagcggcggcggcgtcacgctggagcagggccacgtcgtggagttcggcgtccacgaccgcctctgcgacgcgtgcgccatggcgagagcgcgggccgccgagccccccgaccagtgcggctggtccgccgtcgtgcaggtgcgacagcgcgcgtcgcaccgccgcacgctgctccacctcgagcagcaggtcgtcgcccacggcgccgccggcgacgccctccgcgtcggcgcggcggcggtggcgggctcgacttcttcttcgcgtcgcgctcccacgccgcccgcctcgtcgacctcgtcacctcgctgtcgcccgcccgcgtcgtcgcgtccaaacagctcgtctcgcacgacacgagtagggccggccctaggggggtcaggccgtgcggccgcccgaggcccccaaaatctagggccccccttatatacacatataatatatatactacgtactatataattttagtctatggctatggatctatattaagtttgacagctaaatagcccaatatagaaaatgaattttagtccatcgtcacgcctatttcagcgaagccgaagcgatcttcatttgactcccgttgcttcgcctcgatcacatcacgccacttgcgtcgtgccgcctcaatcacgtcacgtcgctcgctgctcctgcactctcggcgacttctcgacttctcggcgtctcgcaaacggaaacaagtcggcaaatcgtggctcgccagtagccacgctcgtgtcgatcatccgccgatcgccttctcttctcactactgctatttatttctctttgaagttttaaaatgttatatatatagataattttatcacatcgaatattaaatgttgtatgactatataaatatatatattagtttatgtgtatatatataggggcctccatataagtttttgccctggggcccaaaaacctaggaccggccctggacacaaggcacacctttgccgtggagctttgccggtgtgccgcgacgacctcgtcttccttcccaaggaggcgtcccgcgacctcggcggcctcggccccatcgtcctctgcgtcaaggtcaccaacgcgctcgcgctgctcgacacctccacgctccgcgtcgtccacctcggcatcaaggagtacgacaggtgcaggctcgagcccgcgctcaccagccggcagctcgtcgagtacgtcgttctcgacgtcgaccacgagccggagccggccgccggcgtcgcgtacgcgcaggtcgcgcgcgcgtcggacttgggcaagaacgacaccatcttcaccgtgaggacgcacctcggccacgtcctgaacgccggccaccgtgcactcggggacgacctctacggcgccaacgtgaacaaccatgacgtcgagagccatggcttgccggatgcagtgcttgtcaagaagatcaatgagaagggtagtactcgtaggcagctgcaggatggcgacggctgcaggagaaggaagcgagacggcgatgagatggaagagatcgccatggggatcgggtgcattgatctgaacccgcctgatgagaaggagcttgatgagttgctcagaggacctcacaatttgagggcatctgcagtcacttcaccgtgcctttgtcaggcccacatgtccccacatgtcagtgacaatggcacgatgaagtcgactacggaggatctcaatccaatttgaggctactgctgctacatatagttgcgtttattttctactaggaattggaaggtcctttttcctttgtgaacgactattaactttcagatataatgttactgaattggcaagctataagtgcaaagagagattcagacgagtgaatgtgcagtgaaattgctagaatgaatgcattgttagcagattgccacaaatgttttgcaagatgtcgcagggttatattggttgattaatttaagaaaattttattccctaataaggaaatatggacaactgatgaagctaaaaatgataaatcaactaccaaaaagatatgatgggtccgatatatgaagattatccttatatgcattcatggtgagaatgtgtttgattttaaatggatatccttatatgcattcattgtgttgtgtttgattttaaatggatatgaagcatttttaaagtaggcaaactttgataatccacttacagcaaaatctgatgggtccgatatatcaagattatccttatatacactcacggtgaggacgcatccgatttaagatgtgcaaccagaattaattcatttgttaatgcactcccactacatataaacgtcatgttagcattcacactattttcactcctagctagttggatttcccgcgcaattttacatggctatgtaatttgaacagaattatgtttgctatagtttacatacaactttaccactcaatcttcatctttataaattataacctatatacctaagatgatcaaattgtgctattatttttctttttattcaatataaacatggtaatatcttaggcacttggagtaaaacatggttccatttaactctattttaataatataaccaataaatagatggacactcatatattttaacgttggatttactctgagacacatcatatataagtttttggggttggaatagaaggggagtagtgatgtatttaagagagaaatagtgacttatat

SEQ ID NO: 62167 - DNA, 17391 bp, Oryza sativa
ttatttttcataccatctaaatacttataaactttaatatatgatatatcaatctataaatatgtgccttcaaatttgatcatcataaattatagaaaaacaaaaagtaattaaactctaactcacatatatttgctaatagttattttcttaatactgtaaaagtcatatttaaatttgcatattttgtgaagtgacacataaaatattaatctatctttttttaggaaaaaatattaatctatcttgctattttatttttaaacttttaataaactagtatatatataagaaacgagaaataccttcctgatagattataagagtttcccgtttcatgatcactctcttatctcttagtccatctaaaactctaaatatatattccttccgtcctaaaatataagaaatctataattgaaagtgacatttcgtcaagctcaagctcaggacgaaggccttcttctcccgtgagaacactatcctccctccggtcccatggccactcccggtcatcggcagcatgcactgactgctcggctcgctgccgcaccacgccctgcctgcgccgtcgagttgctcagcccaaggcgcgcccgctccttccgccgcgtccgcgaggccgagccggcgaggctcgtgcgcgccgtcgccgcgtccccggcgtggccgctcgtgaacgtcgtcgccggcgagcatgtcgcggccatgatgaccgccgtcggcgcgcggccggtgcccccggcaggaggagtacctggaggagctgggcaaggtggcgaagctcgccgccggcttcaacctggtcgacctgttcccggagtcgcggctcgtgcgggcagcgcaagcggcccacgggaagatccacagcatcatggacgccatggtccaggaccatctgaaggcgatggaggagcgcagagaggaagtcgcagatggcgtcgtcgacgacggcgacggcgacggcgccgatagggatgaagagctccttagcatcctactgaggtttcagagggatggtgggttagggatcactctcacaaacggaaaccatcagcgcgacagtgtttgtaattaattaagcatgttaccatctcactctagctcatttgtcaatgtcacccgcgaaaggtttgtctcactctttttgtattttgcgggaacgtcctttttttcatgctagttaaatagttataaaaaaaagcaaagatagtttgatatttgatatatcacctcacaagtatatatacaaattcaaatttgacttcttaatgttgtaacaaaataatgtaatatgatttaatagtaccagataataacttctagctagtctagttttgtaaagtcctgtgtagataccatctcatatctataattttagggtatcttggctggcggctctgatacaacaactacaactgttatgtgggctatgtccgagctattgaggtgccctcgcgcaatgcaaggtagaaacaaggtggatgaggcatacatattggagggtcccttcaatattacatgcaattggtcatcaaagaaacgttaagattgcaccttccattccctttgcttttcccaaggttatgtaccgaaacatgcaagataatgggatttgatgtacccaaaggaacgatagtcattgtaaataattgggcgattagtagggatgagcgatgctgggaagatgcggaggatttttgacctgagaggtttgaacatgacgataccgattataatggtacatattttcagtttctttcaggtggttttggtcgaaggatgttcccagatttcatatttgcacaatttaacatcgagattgcactcgcaaaccttctataccatttcgattgggaattgccatgtagtgaaaaccgaatggagttggatatgactgagtccgctgggttgacagcttctcggcttactgatctttttggctaaaggcaactcccatcgttgccacagcctggattgttggatttcttgatatttctactaggagctagctagctctacttgtgttttaagaaagaactttaattagcacttggtattttgtaacccgttataataagtcatacattgtgttttttcgactgttatttttctggccatgcatgcatgcatggctacgactagaaatatcgaccactcttgctagtagccacgattatgtgccacagccacagaaactaggcatgcggctgcagcaactgctgcaaaaaatcgcagtcgaacaatgtcattatcatgtggatgtactatagaaaggtatcatcttttttgagggaaaataaagaggcgtcatcatccgtaacattatgactataggacccatttagttatgcatcaccatcatcattttcaataagtgcatagagatgagttgtataacacacgttaaaccagtgtaaatcaatcatataggtacatagtgtgttagctccggccgtggccattttgacatgcagttttatcttttactgaaccttttgtagttttgtcagcagttggatgtgcatgcatataagtgattgcatgggtcgtagctaatgggtgctacaacatgagtctactccagggtttatattttcgttttcactatttctatcggtccgaaatagttttatttttttaacaaaatttgatcaaatttgatgaacaaatttttttcaaagtctaaaaatttgaaaaccccaaaaaaacatttggccgaaatcatttcttatcgcagggtccgataaacccaaaattttggaaaactcaattcaaaattttgaacccttgtctagagtctagaccatgatctagaaatcaaacgcatgcagtgctagaaatcaaacgcaacaaacgcaagaatatatttaaatttggcggttgtttttttttaccgccaaagaaattagttggcaaaaaaaaatacggattcttgtagtagctagcactactacgaaaaggagtttttcgtgcggtcaaaaagggtttagcgtgcgggggggggaggggggtgtgaacttcacgcacccaggtgtttgcaaaaattgctatttttgtgtgcgggtggcgcacccgaatgcgaaaactgattttcgcgtgcagggtggttaggtcgcccgcacgcaaaaataaaatccaaaaaaaacaaaacctaaccctaaagctgtcgtcgtcgccatcacctcctcgcggtcaccgtcgtcctcgccacgcctcctccccaccgcccgcaggccgctgccagcgctgcgccggccgccaccgccgctggatccacgcggatctgggcgggggatggccgtcgccgccggatccgagcgggggccgatcgccgttgcccctcgccaccttccgcatgcgcccgccgacgcgagcacgccgaccgccgcctcttgcctcgctcgccgccacgcccgagcggccgttgagccgctcaccgccagtcccggcgccacctcgtcggtgtcgccaccgagccgcggagaggagaggagagaaagggacagagaggagaggagagagagatgagtggaaataaaagggagagaggtgaaaaatttaaagtgaatgagagggaaaagaggtagaggtatttttgcgtgcggacctctgcgaaaataatcttattttcacatgcggtccatttaagaggattgcacgcaaaaatcgatttttccgtgcggttctattaaagagccgcacacaaaatggatgacgattttcgtagacgtgacctgttatggtctatctgcaatctaaaaaggttcatgtacacaggaaaatcgtttttgtactattgtagatatcattatatattgctccatcccttatcttggattgatccataccaacaataattgtcgtagcctgtcggatgaatccatacttgaaagagaaacatagatactatgtgcagaaaatgatatgtcaactattgcatagtaattgtattattgtaagcacaagttaggtcgattaacgcaataatggacccaaatcactgataattaagaacgaacgtgcttttgtgcttgatactgtgagtcagtgaccctaacatgcatgtacactgttgtttgttgagagcaagacaaacacgtctggattaaactagtagcaaagcaagtatcacgaggaccatatagaattataaatcgtacgacatagctatcaaactttctgtaaaaaaaaaaagaagaagacattgctccgaaattatttttcaccgggggaaaattcagagtactagctagtacgtgtatatagatcgatatatatctatagccactgcaacttccaactatatatatatgcagcacagatcgagctcacaaacaataaagatgataaaaatggccggaatagtggatacagcagcattctgcaccttgctgtgcctactcctcaccctcgtggtcttcaagctcaagacggcgacctcttcccggcacaacgccggcgtgaacctccctccggggccatgggcgctgccggtcatcgggagtatccactgcctgctcggctccctgccgcaccacgccatgcgggagctctcccggcggtacggccccgtcatgctcctccgcctcggccatgtccggacgctggtgctgtcctccccggaggcggcgagggaggtgatgaagacccacgacgccgcgttcgccacccgggcggtcaccccgacggcgagcatcctcacctacggcgcccgcgacatcgtcttcgcgccgttcagcaagcacctccgggagctccgcaagctgtgcacgctggagctgctcagccccaggcgcgtccgctccttccgccatgtccgggacgaagaggcggcgaggctcgctcggtcggtggcaacggcggcgccgcccgtcgtcaacgtcagcgagctggttaagatcatggcgaacaacatcatcatgacggcaatcatcggcgacacgtgcccgcagcgggatgagtatctcgaggctctagacaagaccatggatctcatgaatggattcaacctgatcgatctgttccccggatcgcggctggcgagggtgctcggtgcccgatccctgcgtgcaacgaagcgggtgcatcagaagctccatcaaatcacggatacgataatccaaggacatgaaatcatcaaggacggcagcgttggtgatgacaccatacaagaaacagtaggaacacacaatatgcatgggcatggccataagtgtgaggacatccttgacgtcctgctgcgatttcatagggacggtgggcttgggatcaccctcactaaagaaattgtcagcgccgtgttgtttgtaagtactccctctgttccaaaatataagcattatagcataataacgagtcaaatatttttaactttgaccattaatagaaaaaaataaaaaagatcaatcacgtaaaattaatgttactagatttatcattaaagaaactatcatatatgtaattttttttatttaaaatatcttattttatagatattgttagtcaaattagtatctcggagaccgtgtcagagtccataaatccttatattttgggacggagggagtactcaaattcaaacttatgctcaacctccattcctacaattacttgtgtcgtgctatgtggtaatggatcatatacgtaatatctctaggagaatatggttgtagtcccactggctaagaatatttgattatttgattgatgtttagtacaagatttagtcgtcaaatacttttcactagagggagtatgcatcataattacaaagtttatggagtattttttttaagaaagtgtaaatttgaatttatcaggatcttttcgctgctggctcagagactacatctacaacaataatttgggccatgtccgaactcgtaaggactccccatgtgatggagcgagcacaatctgagattcgtcaagtccttcaaggtaaaaccgtggttagtgaagccgacatcgaaggccgactccattatctacaactggttataagagagactcttaggttgcatcctccggtaccatttctcataccgaggttatgctctgaagcaaatagtaagatcatgagatataatatacctcagggtgctatggtgttagtgaacatatcagcgattggcagagatgagaagatttggaaaaacgcaaatgagtttaggcccgaaagatttaaagatgatatggttgattttagtggtaccgactttagatttattcctggcggtgctggacgaagaatgtgcccaggtttaacgtttggactatccaatattgagatagctctcgcgagccttctttaccactttgattggaaattgcccaatgacgcaagctcatgtaagctagatatgagagaaacgcatggagtcacagcacgtcgtcgaactgagcttttactcaaagctactcctttgtacacataattggattggtccataaaaaattcatgtacgctgtgaagacgaagaattggtctcttaataaaccattgccaattaatgtttgcctaaatttgtttctatcagaactgaaggataattcatgtacatccgttgttttgccaaccccttgtcacaagtcgatctgaaatctagactctattttgaatgatgagccaagcatgaaatttgcatttccccggtgcccagactttctagattaaggagttgaaacttgtgctcggtgttctttgacattgcgcatggtaggccaaggaagtcgtgtagagtccgctacttgcgaatttccgggtaatctggtctggctctccgatgcctaagtgaacattccggaccgcttcccacaggacaaccagttgttcgacgaggtctagtgtaataggcgagtgtgattccagagccaggtcctgaacctagacgtcctcctcctttccatttcgtagagacctccctctgtttttagagatcgcatagatcagcggtataagttttttgggtcttacttgtacttgtacactaagttaaaaaaactcacttgagacgatataagtttaaaaatttactccttttaattatttaatattagatcattctttaatattcacgtgtttttaaattctttaatattcacgtgtttttaagtactctcttcatacacaattaatcatcatatttggttccgtggccgcagtgacggttcggttcctgtgcatgccgcgcacatgacgaacgaaagttgagaggggatttagctaatcttgccctaatcacatggcattaaatccatgcggtaaaaaagatgccggcgatttaactgatttcgggaaaatctcaaagggctaaacggtatgtgttttgtaaaaatttctatagagaatttgctttaaaaaatatttatttattaagtttgaaatagttagagctcagttaatcatgcaataatagctttaaaacgagagaaatcttgcttctttctttcagcaacaaacgcagccaaacatggataagaacgaatgaacgtccttttttttgaaacaatatggcaggctttattcattcaatataattacatcgttcagtactagagaatcaaggattgggctcatcatcccaagtactctctccatatcttacttttgtcaccaaaattaaggagaaattaaataatcttacatgttacaaaatcattgactgaaagcaagcatgcaaccaatgagtatttagatgacttcttgggttctaatcaaacatttaatttatctcttcatttaagtcttgaatgcataaagactacaaatagaaataatttatttaaaaaaactcaaatgtgaaatatgtctaatttttgtggatgaagggagtacaattttgctttgactgcatcgctctccttgctaaattatgtgctgcttggttcgcctccctattgcaatgctcaattgttatatcttgaaaaccgctccaaattgtagagcaatcatcatataaggccgctgctaaatttgtcgtgaaacctccatccttcattgtctatacgacctccatacagtcttattggataattagtcgattacaccctatgtgttgtgcaagcatcaacccttctttcaaagcataggcatccgccatcggtgcatcaactaagtacggcacatagctgtgggaagcagctaggaatccaccagtgttgtcccttgtaatcgttcacacgctgccgcaccccctgtcctcatcaaaagctgcatcaacattgaccatcactttcccctctggaggcttcatccatccttgccttatctgcgagcttttcttcattgttgctttatatatagttctttgttagtgccacaatagacatagctgatcttgaaggtcgctggatgatctccccgtgtacatgttgccggcgttgccaccaattataccatccggcagtaagtactaattcaaccaatcccacgtctagtgcgtcaacctgctcttctcttcttatgagatgtcttcgatgattactgagcctgaccgatcggtggcaagaaagcgttgtaatttctcctagatgccaagtgatctccagacttctcttgcacggtgacacgtggaaaatatatgtttgatatatatcctctcctccattcagacaaaagggggccgtgtttagtttccccaaaattctcaactttccatcacatcacatcacatcaaaaactttcctacacacataaactatcaacattttctccaaactactaattttctcctaacttcctaacttttccaccatgcatcctcccgattctccgatatatctattctctagggtagctcggcaaggtataaaccccttcaacgctggcgcgccatccaaaaattttaattttccccagcaacacttcaatctccacaaattcttccacagctaattccgtgaagcagtactagcttgcacttgggccctatttagatcccacataaaaattttacgccctatcacatcgaacgtttgaacacctacataaaatattaaatataggctaaaaaaataactaattgcacatgttgcgactaatttgcgagacgaatcttttgagcctaattacgccatgatttgacaatgtggtgctacaataaatatttgctaatgacggattaattaggcctaatagattcgtctcgcggtttattgacggattctgtaattagtttttttattagtgtccgaacaccccatgcgacaccctatataataaccgatgtgacacgctaaattttacacccctgaatctaaacagcccatcttgctgttctactgacaatgataggcagaccgcagaccgaacgtcctttgatcgatacagtgaaactagtaacgcatgcactgttgtttgttgagacggacacgccatctgaattaaagtactatagctacgccaggagcaaattaacaaagtatcatcatgactatataaaattatagacccttaattatgtttttaaggtaagacgtcaccactactaatactctctctacccctaaatatttgacgctgttgaagtatatttaacaataaatcaaatgataagaaaaaaattaataattacttaaattttttaataagataaacggtcaaacatgtttaaaaaagtcaacggcgtcaaatattcaaagacgcggggactattagtagtggtgatgtgcattatcacatcacctctacaactaacatcgggtctcgcaatttataatatcacactatatttcaataagtcctcaataaatattggcttctccaaattttaaaatcatctatttgttcaataagaaaaatcatagtattatttacgttaaacaaatacttattaattgattttataaactagaaactcaacttgtttgccgttggaatgcgcgggtttaggctatatataggcatatggtgctgcaactgcaacttctaaacggtgcagcaagcaatagattgagctctcgatcgaaccagcaaataatggccggcatcatggacagtactactgcatcctactacaccaccttgctgtgcggcgccctgctactcgctgccgtcgtcttcaagctcaagacggcggcagctttttcccggcacaacgccggcgtgaacctccctccggggccatgggcgctgccggtcatcgggagcatccactgcctgctcggctccctgccgcaccacgccatgcgggagctctcccggcggtacggccccgtcatgctcctccgcctcggccatgtccggacgctggtgctgtcctccccgaaggcggcgagggaggtgatgaagacccacgacgtcgcgttcgccaaccgggcggtcaccccgacggcgagcatcgacatcgtcttcgcgccgttcggcaagcacctccgggagctccgcaagctttgcgcgctggagctgctcagccccaggcgcgtccgctccttccgccatgtccgcgaggaagaggcggcgaggctcgctcggtcggtggcggcggcggcgtcggcgtcgtcggccgtcaacgtcagcgagctcgtcaagatcatgacgaatgatgtcaccatgagggctatcatcggcgacaggtgcccgcagcgggaggagtacctcgaggctctagacaagaccatggatctcctcgccggattcaacctggtcgacctgttccccggatcgccgctggcgagggtgctcggtggccgatccctgcgtacgacgaagcgggtccatgagaagctccatcaaattacggaagccataatccaaggccatggaatcaaggacacggttggtgacgaacaccatgagtgtgaggacatcctcgacgtcctgctgcggtttcagagggacggtgggcttggaatcaccctcactaaggaaattgtcagcgccgtgttgtttgtaagtactcaaaatttcagtcttaattatacccaacatgactctttttctacaattacttttggcatgttctgttatagtcttatgtatcatctttgggggaataattgtatatatcgtacaaagcttacggaatgtattaatttaatcgttaggatctttttgctggcggctcggagactacgtcaacaaccatactctgggccatgtccgaacttatgaggagtcctcatgtgatggagcaagcaaagtatgagattcggcaagtccttcaaggtaaagccatggttagtgaggcggacattgaaggccgactccactatctgcagctggttatcaaagaaactcttaggctgcatcctccggtgccaattgttatacccagattatgctctaaaccgaatagtaagattatggggtatgatatacctcaaggtacttcggtgctggtgaatgtatcagctattggaagagatgagaagatttggaaagatgtaaatgagtttaggcctgaacgatttaaagatgatattgttgattttagtggtacggattttaggtttattcctggtggttctggtcgaaggatgcgcccaggtttaacatttggagtatccaatattgagatagcacttgtaacccttctataccattttgattggaagttgcctagtgaaacagacacacatgagctagatatgagagaaacctatgggctcactacacgtcgtagatctgaccttttactcaaagctactccttcctatgcacgattgggttggtccaccaatatgcagatatacagtgtcaagtgtttggtctatgaataaaataatattgtccatatatatttatttaattagttttcttctattataaatggaggataagtatgagttaattaggaattataaatgtggtggctacaatgagctgatggattcgagactttgatgtttcttctgtctgatttgtggaaaccaactttacaacacttatttgatttttccgttttgcgtcgcattgtctaagaaaactagctatttcactttttgcattgagctttgacacgagagatcttaagctcttgttgtaattaagcacgtctccatgctcagagagtcagagagagcggcaatttttgtgtagttttcatggtttcgttaacttgttctcgtgcaaacaccactatttcatacttaaatttaatgctaatatcacataatgtcttggatgtagtgtagaaactatgtctcgtgcaaaacatagtttccttctctttcctcatttattcacttgcaacatcattttttatcctaagtgtcagcttatttaatgctatggacaccatcctagtcattgggttgggaatggcctaaacaaccaatcgaacgggggtgcaaaatccaaaaaataacggagttgctagaaatatggcgccatatgttacaatcgatttttttcagccacttacacagtagttacacctcgtttacaccccacttacatatgtaattagtatgtaattttcgaatttacatatgtaattttagtacttacatatgtaattttgatacttacattgtaaatacactaaaattacatatgtaatttacggacttacagtataaatacatgctgactattttttgatgaaaaatatggcgccataaatatagctacacccaaaaataataataataataataatcccgtactagtagtagctatagttaggcactgttaatacgtccaagtgttggacttgcggcccatgagatcgtggacgatgggcttgagtcgacgcggccgtgctccgggccgggatcacgcggccttgtcgtggtctcctctgatgcttcctactggcccatcacgagtattgatgggccgttcttccatctggatttccccttaggcccggtcctgcttgacaaatgagaaactgataatttagctgctcatctgaaacagctggtacatctgtgtataaactacacgcaaaggaatactccgagtaactaataaaccgatacataatagcgtcgcggctggcgaaaggtgctcagcagccggtccatgcgagcggcgagagaggcgcacgcacgcacgaattcactccatcttgggcgccatgatccaggaccacgtcgtggacatgtagagcaagggcggggcggctgccggtgacgacgcggacggtggcggcgcgagagaaagagtatcttctcgttgtcctgctgcgtcttcagagatgggagcatagagacaacccatactacggaggttatctgcacgacctttttcgtacgtgtcactctcttgtacccccatctatatctatatcgtcctccctccgtcccatgaaaaaccgatattctaataaataattttagatatgttccatgtcaaaacttattgtactagaaaacattacatcatattttagattgatttttatgggatggatgtagtagtccgcatgaatataaatcaggcaaaagacgagttttttctttgaaggagaggattttttttaaatgtccatatagtaagataagattaaatataggcaggtagtgccaggattaaagttttagcatcacacatgtgttatatatatcatgatttggatttttttttctgcgggcttgaaaccacaaccacagcaactatatgggctatatgagagtttatcaaaaatccacatgcagtggagaaagcgcaatcagatatacgaaaaatccttggaggcaaaagcattgtcgaagaggcagacatcgaagggcaacttcattactttcaaatggtgaacaagagactctaagattgcatcctcctgtgccattgcttcttccaaggttatggtctgaaccttgtaaaatcatgggttatgacatacctcaagaacacagcaatatttgtgaacacatgggcacttggtagaaaataaaaaacactggattgatgcaagtgagttcaggcctgaaatattcgaggatgggcatagtcgatttcaatggtttagacttcaggtttcttccttgtggtgccggtcgtaggatttgtcttggtttgatgtttgaactttctgatattgagctcacacttgcgagccttctttatcattccagctggaggttgccaaccagatcatactctaataaactggatatgaccgaagcaaacgggatcacaactcatcgtagaattgatatttggttagaagcaactccttttgttcctagaggctaaaaaaatatgtggttggtttgtgtttatacaattgtactatcttttaaaacttatgaaccatggcgttgcggttggatatcctaacttatatgtagaaaagacatataatacgacgtgtgttttattgcttaaatatgtgaatgtcttttttacatgtgtttttcaagtgtatgtaagtcaaatcaaaactatttactagaagctactccttttatacctttgtccacatgattatgtgggttttaaaatattaacatcatgtgtgatgatatatgatgtatgattggtctttgtgtgatgtaagttggcaataatttcccttgccattttgttttgtgccaatctacaagacaataagagcaagtttaatagtatagcccactgctagctccaaaccatctataattaatgtaatagacaattcatacaacagttgcttactatactattaatatctggtcccatctgtcatacacacattacgtcttgtagtccgtgctgcagctggctacagatctgtagcccgctgctcttctctctcttcctttatctctttaaaatatgtttatagttggcttatagcctgctattgtacctgctctaacctgatttcccctcttcaccttgttgcacacgaataatgtattttcctgatttatctcgaccatattctgtactttaaaatgtgattttaaccaccattctcattagaatgatatagaaacatatcctaaaatgaattatatgtaactctattttctatctggacatgattgacctcacgtttcaccgtcggacggagggagaacgtgaaggcaatactgtaattaacccagaagaacaggggtataatagtctcatactttaaaccctagagcaggtaaatcaactccgccgccgccgtcggcgagtccaaaacccttctccggccggtgtgtcgcgtcgtcggccatgaagcggaagcagaagcccgccgccgccgacgccgccggcgaagtcgacgccgacgagccctcccaagccccgctccctctcgaggccttctcgggtgacgtctgcgccgcctcaccgcgcgctacggccgctccaccgacccgcagcaccgtcaccttctcgacttcgaccgcgccatacgctccattctcgtcgacgacggcctccccgtgacgccagcatcctacctccccgccgccatttcggccctccaagccgccggctcggctgaccccgccgccgcttccgcccttgcctccctcctcgtcatcctcctgcccaatatcccctcgtccccatcgtctctcccgccagcgtccgcctccgaatctgcctcagcgctcgccgtcttcctctcctcgcccgatgcatcccagctacccaccggcaccgtgcgctcggtggtcaagtcccttggccatttggctttccatgtcgacgctgcagccgattggggctctgtggcctctcctctggaggctctccttgctgcttccgtcgaccagcgggccaaggtgaggacgctaagagcttttgccacacatacttgaggaccatgctcatgtggttgtcactctttgcttggtaggttcgaaggtgtgcacaggagagtgtggagaagctatttgcgcacttgaaacaatgtggttgtgggaagaaagttagtaatgctgcaattggcatgtttgataagcacattgcatctgtgaaaaatcatgtcaatttgaattcagatgcttctgagggtaaggagatggaggctgcaaatatgctaagtgcaatggttgttgtagttccatacctatcaaagaaggcaatgaagactgtgttttcagaagtttatcagctgttaaccccttgttttagtccacttacaaggcatgtcttgaagcttatggagaccttgttggaccatctgaaggctgagaatgttgagtcagacttggtgaatcttatcccattgttgttggcatacctgaattatgatgaaaagaagcctgatgataccattgtcgcagcattgaagctgatgaaaaattgcttggcgaaactagttggtcgaccaaatttgtggatggaggttcttccatctgcatttgaggcagtttcaggtctgtgcatctacagtttcacctgtcaacatttcaatatgataatgcttcttttatgagttttcagttgacatacttgtgtttgagttattatggttatcattgatggggcacgttgaacctatggtcctcaaacatgtttcctccagttccattttgcactggtgcatctgagggggaaaaaacttatctctttgctctttcttgacaacgacagttaactaactttgagttaccacatgctaatgttgtatgctgcctttcttctaatgaatacttatgtttatcagataagagttggtattcctgcggatcaacccattttggtggatttagttcactgctattgttctgataagtgtatttagacattgtcttgtctatatatcatatatggttggaaccaataggtcaacatgcattgagctacatcacccgccaaaacaagaggcattggatcatcttcatgcttaatcacaaccatccattccgtagttactctctctcattaattagcatatatctcaatattcattgagtcacttagtgtagttatttctataaaaagtcatggcctcatccttttattaacacccttggatggtgcttttacaattcaaatcagtccataatattttgtgtgtgtgtgtattgaaattttgcaactgcattgcacagaacaatatcctgctgcaatgtgtggggtgtcatctagttcattatatgtattgtaatggataacagtcccagagctaacttggtaaaattttgaaatgggcaggatacctgattctggacagaaaatgttctgaagatatagcaggactgctacaagactgtattgattctcatattgaccggaatattattttgactggatcacagttatgcgatcgtgattatgagagcttaagtgatgcggctgctgttaaatcaatctgttcatcgattaataacatgctttgcgcatgtgcttctcctcccaatagtatcttaacaacggccttggttttgtttctgaaacttggtatggcttcaataatttcagtaaagtatcttttgcctataactgtaccagtgtatataataaccattcgagaatatgtagaagactagaactgtagaagtaataacctt

SEQ ID NO: 62168 - DNA, 19749 bp, Oryza sativa
ccgtcagaagttggcgctgccctgcagtccgaatccaccccgcgcgaatcctcttccctttggatcctctccatcgttcctgagtaagacacgagtgcacgcgtctccggggtataaagaagaggaatatgaactcaagaaagaactcacctgataatttagttgacgtgcacgagcgcgggtaataggaccatcatgctgtacatggaggcggcgtggatgtatcgatggtgtacatggggggaacgtggatgtatcgatggtgttgatgtcctcatcatcctccccttcttgcatttgagtcgtcctcgactcaagctcatcttcttctcccaaatacagcttcaaatctgcaatgttaaatgtgggactaaccctgaaatctgcaggcaaatcaagcttatatgcattctcattaatctttgctaacactttaaatggtccatcagctctaggcatcaatttagactttctcaaattaggaaatcattcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcatgttgcttagcatcaaaattcagtttttcagaagatggtaaaggcatcaaatcaattggaggacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaaaagtcatatacaaaccatgtggatgtaagcgtgacttagccttttgacatgtagtgcagcgagcaacgaacctgccaacatctcttcgcatctgtggccaaaagaaatgactagcaaggatgtcatgtgtcttcttggcaccaaaatgtgccatcaaaccgcctccatgcgcttcctgcaacaacaacaagcgaacggagctagctggaatgcatagcttgttagctctgaaaacaaacccaccattgatgacgaatttgttccatattcttccatccttacaatgcagcaacacatcattaaaatcagcatcatgcgcatattggtctttgattgtttccaggccaaaaatcttatagtcaagttgtgtcaacaaagtgtatctcctagacaaagcatcagcaatgatgttctccttccctttcttgtgtttgataacataaggaaaagattcaataaattcaacccatttagcatgtctacagtttagtttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaataccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgtagcaatggtgctgaaatcctgcacaaagcggcgatagaaccccgcgagtcctagaaaactccgcacttgtgagaccgttttaggagtcggccaactctgaattgcctcaaccttggcttgatcaacctcaatcccctgcagagttacaacatagccaagaaaagaaactcgatctgtgcaaaaggtgcacttctcaaggttaccaaataaacgtgcatcacgaagagcattaaaaacagcacgtaaatgattaaaatgttcacccatagacttactgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatctaacctaggaataggatgacgatatcaaatggtaatgttattaatagctctacaatcaacacacatacgccatgaaccatctttctttggtaccaaaattaccagaaccgcacatggactaagagactcgcgtacataccttttatcaagcaactcatgaacttgacgctgaatctccttggtttcctcagggttggttcggtatggcgcacggttgggtagggaagcacctgggattaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcatagacaactgaaggtgatgcaatcaactcattaatatcagatttagtagcaagtaagcatttgggtttcaaattgattgtctcaggtttcttgccattagattgggcttttttatcactctcacatttggatttggcagccttagcaacatcatcacgcaaaatatcttcaggagacatgggatgcaacacaattttcttatcatggtacagaaaagagtactggtttgacctaccatgatgcatagaatccctatcaaattgccatggtctacctagcagaatattacatgcttgcatgggcacaacatcacattcaacaacatcatggtaatttccaattgcaaaattaatgtgcaccagttttgttacctaagccttaccactgttgttcagccattggatgtagtatggatgtgggtgcggtttcgtgctaagtgaaagcttctccaccatctcgctgctagccaagttgttacagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgcgctcttccggtggtcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcgttcggcctgtggatgccactgaagaagcactcagtgctggctgagcagcctttgtcgctgacttgtcactagatggaggaggtgctgcccgactggttgcgggtgtggaagatggagaagcagtacggccggccggaggagtggtgcgtgtctgccatgatgaagttttacctgcagaaaaaatagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcatcctcagtttcctctaaattacaacgaagaaagcccatttgtaactcctgataatattcctctacactgtctcaattgttgcaacctattcagcaagtcacgtgcatagtaagaaggaacaaatctagcccgcatgacccgtttcaaagcatcccaggtttgtggcatgttattaggatttttcttgccatgttctatccatcaaaccaaagcaaaatcggtgaactcactagtagcagctctaactctagtgttctcaggaaactcatatcatgtaaatttttggtcaacagcaatctcccaagagaggtacgcatcaggatcatattttccatcaaaaggaggaaacttaaatttaattttagaaaaagcatcatcattgttgcgtacctcgcgtcgacggcgaccacccatacctcgtcgattgttgtgtagccgtcgatgatctcgagcatctcgatcatcttgctcagtgtcagcaatatattcatcctccaaattatcctcgacgtactctccgtcaatgtcatcgtcattacccccaccattgcctccagcattgagagcatcaaaatgcctcacaagtgcagcaaggctagtgtcaatgcgggcgaccgctgtctccagccctgtaagcttagtgttggtgaagatctgcgtggactccaattgtccaatcttctcatttgtcacctgcaaatctgtctcaagtctttctgtgtgctgcttcactttccttgtaaagtattggatggtgcctttggtgcgtggggaatgagatgcaccctcctcatctttattctctggacctgccatgatttagaaatgaaggacaacaaaacaatggagtatgtaatgtaagccctacacaactattgggatttagcttttgcaagatgctcactctcacttcactcgcaacttgtctcacaagctcttaccagttcttaccttgcccacaggagggggacagcaacccataagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaacggtggtggaaggtggtgacaaagggggaatggtggggtgtgctcgctggatcctcttttttttttgcttgctctctctagtgctgaggagagagacacaactttttttttatttttattttatttttctgatatttttttcacaaccaggagcacactggaaccaaccacagaaaatcttatctcaaacggacaaagtatgaagcttgtagaattttttcaaagttctatgcgaataggtcccgaagcttctcgccacaaaaacaaaattttgcaagaggaatttggcaattttaaatttgccgaacccggcgaagtgggggagaatcggatgtaactttttttttagatgtccgtggatatattataagcctaatttcgagtccgtctgaaaaagatatgactgttttaaggaaggtcactcgaatcagtgttctatttcttttctagtggcggcaagatacaagacaactcacaaaagctatcggcaacagatcaaacacaaatagaaagtgatttggtgggtgactgcgacggcaatgacggtggtgatgacggaaaaattgatgaaggtggcgatgtgcggtggtggcaagaactcgaaactctaatcgcctaacactaagaccagcaaattaacacaaccgatgcaatcgaaaactcaacaagccttaactaagcagtactagtaaaaaaaagcacaatggtctataggatcacgggaaaactaatctactatttttttttgttggccttttctggactataggaaaaaaaaattaatgacgaagggaagggtaaattctctcaccgatgaaccacgctctgataccatctgatgcgaacccgctagggtttgtggcccgatctttcgatgagaggtaagggataactcgattggatgaagacgacgttcacggcccgactacaaccgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtagaacaagcactgaaattgctagataaagatgaaagtttcactatcaaacacaatatggtggggttccgattacaggcagacgggcggtttagccaacacgcgcgctgcgagccaatagcaagtagctatctctatcatcaaaacccgaatgttcttggcggcgactagaggtataagaagaggggaagaacgaccatagggtcgtgctccaaccctaggacgcgcccctaatgggcccaacttggatacacagcccattgggccaaaagaggtgatgcagcaccatggacagaaaacagtcgggagtaaaatgacaattgcggccgctccagaacagatatggaaatgtagctggatccatttgaaagtagacttgataagctttccatgaagtacttgcacgcccaaatcggagttcgcatgaagtcatggcggccgtcagaagttggtgctgccctgcagtccgaatccaccccgcgcgaatcctcttccctttggatcctctccatcgttcctgagtaagacacgagtgcacgcgtctccggggtataaagaagaggaatatgaactcaagaaagaactcacctgataatttagttgacgtgcacgagcgcgggtaataggatcatcatgctgtacatggggggacgtggatgtatcgatggtgtatatggggggaacgtggatgtatcgattgtgttgatgtccgcatcactttcctaacatggtaaggctgacaggtggtatattggaatagaggttaggacaaatttcactaaggtttctctgctagttgagctgaaatattttcctttctaacctggaattctggagccaattttttcaatgagagggatgaaattgtcacatcttgattttcttcttatgatttataaattatttaataaattattattagaatttatattaaatgttcattaatttacaagtgatgttaaatgtgggaaataaaatttcctaaatataaagcatggctggatttaattttcattaacttctccatggttaattatactctctgaaattttcctggatttttcggagctcaattcctaattttaatgatacacagaacatttcagtaattaatcatatattaaattaatcataaaatggccctcttataattttgctaaatatttatggtgttcaagtactttcatgatttttcttgaaattattcgagcattggaagtattttttaacaattcaaagatcattttggtgattaatttaattggaaaaagtaattaaattcccccttttccttttcgggccgaattaggaaaagtcctctcactctcggcccagtctcctctcagcctgctctccctctctttcccgaagtccattttctatccttcgttcaatcgggccgaggaaaaggaagcccagcgaaagtctactttagctcctcagatactgttcatcttccagctccagacagagcccgagcccgtcctgtgcctgtgaagccgacgccgttttctccacaaatccggcctctcctttcgatcttttccgaaatttgttgaggggatttgtttcacttatcctcctctatcttttcccccaagaatcggactttatcccgaaaaaatcaacgcggaatcgagctcgattcgtgtttatctctccaaaccaaaccctagaaaatcccggctccgattctctcgttgtagggtcaatctctagctctcgtggctataaatagagtctcctccctctcctctttcgtttgctaccctcgcccgagctcgccgtcgcccgtagcaccctaaccgcctccaccctagcgccaccgccggcgtcgatcccacgtggttgccatatcatcgccttttcagctgccgtccttgccatctaagtgtcacgtcatctctcagatcccacggggctgccatctaaaatgttagatcagatcaatccgagccatccaattttggtcaggccaaagttgatctcagccgtctaaaatcaatataaatcctgttatcccttttcaatggcatattagttctttttactatatatcgtctactaaattcattccaataattttcggaggatgctttagtcttatatctcagttataaattatttgtaaattgtttaattaatttggaatagtcttttctttaataggtttaattggaattaatcttgtaaaattcataactaattcatatgaagtcagaatgaggccgttcaagtctctaaattcatctaaaatcatgatctacatgtttgtttactttttatgtattatttatttggtttttattagtctttttctctgttttgcgtgttagcttgtcgtttccgtcgttgcgaaggtttgtgaatgcgtcggaagtattcaagaagattaattgaagaccgattattgcaaggcaagtcacacagatcccaaacaaaatcctttgagcatgttgatcctatatttaaattctctatttatttcaactgtgcatttattttcgaatgtcaccgggtggtgtgaacctattcctttgttatggccactttgcattgattactctattccttgatacctcgggtaataaattgattagcttgaaccttatatattagtttggttcagctaaatgctatatatatatatatatatatatatatatatatatatatatataattgcttagccatgcttagaaacattagctcattaatgggatgaatcatactacattattatttatgattatatttaatggtatctcacgatagttaatcgtgttatgataattaattgataattaaaacttgtcaatggtgggttgtgagcacatggttttgtaggtcgtgctcatgacaattaaggaccggttcgcgagctactgttgtgagacattaaccgtaccaaccacaagccagcgtgggcaacggctttaccttttgtatagcatggttcattacggggtgctagactgagaagcggcgagaagttcatgggggtcgctggggagtccatgcctctggttatatttatagagggggtgattatgatgcaggaatggtgcactgtggtgagttgtgttgtgcgaggggtattgtcacagttcctttccgaggtatcgtggtggtattgaggcgcatggtgacatgtcgtggagctgtgtcttgtgggtacagtggtacacctcaggccagagtaaaactattcgaatagccgtgcccgcggtcatggacaagttgagcaatgtttttcgtgattagtctcacacctctcacaataattattgatgctataactggtaataatttacttaactcctggtttggagttagatctgtacagccgggtatggttgttcaggatggttgggcctgagcagcatgggtgtgttgttcagtgttgaataacattgattaattactctactgtttttcaattctcaaatgcttgttaaatgctgcttttgcaaatgagcctatattacgccattctttggtatccttgtgcacttgcatatttgctgtgtggcttgcggagtatgtcatatgctcaccttgcaataatcaatcaacctcagttgaagaaaaaggatccagaaggagaagacgtttggcttataccccaattgagctgcctatgggagtggagctgaagcaatcgctagaccgttattcggctgctgtttttcttttggtttgtaagtatgtaacgttattattatgatggatttgtatattaaattgtcagtttgtgtacctcggctgattcctggacgaggattctatgcacaacttagttcggaaattactagtgaatttctgggcgtgacagaaatctaccttccatagttttctaaggtgaagaggtaggctaagtaactggttgggaagccttgaacagctcctaggaaatccagcaacaactgttgcacatcaatgttttcacaagcaattgagagaatttgagttttgtgcgcattgttcttgagactagttgctatgccaaagtgttccataatggtttttagattggataattcctgggctgttgggtgcaagaagaaagctacatcatctgcaaagagagaggttctaaacctcaaaggtccaccattgagtggggataagattccgtgatgctcagcttgttttataatgaagttaaggggctccattgctaataaaaatagtaatggtgagagaggatctccctgtcttaacccctttgcacgttgaattgcttggcctgggcatccatttaggatgatcttagaggttgaagttaaagagtgaatacatccagtttctccatctcagcccaaagccaaaagttgttagcacctctattatgtattgccaacttacagagtcgaatgcctttgagatgtcaagtttgagcaacaaggtgggtgttttccttctatgcagtctcttgaccgggttttgcacatacatgaagttgtcatgtatagctctcttccttatgaaagcactctgattagtggaaaccatctcttgtaatattggtgctagtctatttgccaagattttttatattattttagcaaaactatgaattagatttatggtgatgaaccctgagttcctctcgacactcaaggctgttgttggcccgatcttttggtgagttgtgataactacgatttgggagaaacgttgacgatccgactacaaccgtacgagacgttgtgttgcgccttagcaatcgatacacctctccgtgggttgttgatcttgccggtgcagatcaaccctattcctgcaagcaaatcgaagaaacaagcaagaacaagataaaagcaatcttatattgcaaataggaatttaatacaaatgataagttggggttccgaagaacaagcaaacggacggtctagccgacacgcgcgctgcaagcaagtagcaatggcaaaattttaatctatcaaaacccaagaaactctaaaggctacctagctatttaaggaggtgggaggacctctaggtcgtcctccacctagttggggcgcaccccacatgggccccacttgggccggggtcccaaacaaagttacaagcccattggcccatgacaggtgacgcaacaacttgtttttgtatttgcggccaaacaagatggagtctgctgataaagccagatctgttggaaagaggactccgagaactttccatcaagtactcatgggccgaaaacggaggtcgtatgcagattcggtagccgtttgaagtcagcagtgtagcaggtggccgaatcggattccagcacttagaggacttgatcttgatatcatcttgttcatccatgatgtgagctatggttgtatctgtagtagccatggtcacatcatcctccccttcttcacggaaaaccatcctcggcttttccatatggtgctcgccacatagtccattcaaaataacctatttcatccaatcaaaactagagaaactcgatgttgtgtgattagcaataacatgtttctctaaatccgaacaaatgaaaactctatgcaccaaatatattcctctatcattatattcgccaaagatatggaaaatagcattagttggacatggcaaatcagacttagcatataatttctccttcaaattatcgagctcacaaaaatcatcaaaatgaatatagcccaaaatattgaaagaagatctcaattcactctcctctacttcatcatcaatgtgaacaacatgtttaaaatcagcacacaatgaaacactagatatagtatgttcattcactagttgtggcatggatataagtgaagtactatcgcacaactcttctttatcacaaggaacagaatacaaatcaacttgtgacaaaggcaattcagaagtaggttccactaaagtttgctctaggtcagcatggaaagtggaaaaatgtaattcatcagaagcatactcaccttgagtaatttctgcaccatttaatttaccttttatgccctcttcagataatgtagctgcatcagccatctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcactcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttattttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagaatggtaacttagatgcaacttgtgcaaaattatagtcatgtacctcatatgcatcacatgaagaagtcgtcatatctcgtcgaaggtgtagaagtcgatgttctcgtattcccttgcgcaatcctgccatggttagtagcaaacaagaaacacacacaagaatatgcacgctcctatcaactactaggtagtggtagctaaaatttcacacacactcaagcttttcaccaagctcttacaagttcttaccaaagcaagcggaatggtgacgtacaccgactcaaccaagcaccccaatggaggttggatgtatcgatgccttggcaaacacttgctgtacggctgcaattaaatctgtggagctctgggtaggcttaaatatgtagcaaaggaatagcaaatgctcaaatcagagaacgcaaagttgaataattgttcaaagtcaagtaccggtaccgtgctggtcctaggctagaacgtactagagacgcgagcctagacacaaacggtaccacaaaatagcaccagaaacaactcaagcacactccgatgtatgaaagcaaactcaaagatacaactaatttttccttttgcttctttctttccttttctttcttttctattttcttttctttttcttttctctttttttttcttggtgcggcttttcttctctttttttatgcacctttctgccctttttttctttcttttttttgattaattttttttaccaaaaacagactcaaggacctcaatgtaagatcacagggactcaaatgtaaatatgaaaattacagggactcaactgtaaagtccacaccaaaattaaaaattataaaaaatggaatgctgaatttatgccggttccgtttttccaaacagatctcgaaaccaacaccaaacgaaatttcaccaaggtgtttgacacaactcggaactgagataacgtgatttggagagggaggagggagtcggactgtcacggtggtggtgggtacggtaagtgggagggttcggcctggccctccacaagtggaaaccaaatccaatcaaaaaaaaaactttccttttcttttctttccttttttttctttccttccaccccaccgaatccaaactgatctgctatattcctctattcttcctcacacacatgcacggcatagccaccaaacagaagctatgcaactcaagaactcaaaaactaaccgacaaaaacttctgaaaactacgaaaatagaatcgtggcagcgagccgattccgttttcgtaggtcccgacgacaacagagacacggaggcgacgacgactgtggtataaaatgtgaccagaactcgaaactctaaatggactaaacgctaagaacagcaacacgactcgacgatgcaacacagattcaacaaagcaaaaactgaaaagaacaatgcaatggcacaatatggctaggtaaatgatacaatttttttttgtctggctattttctggttacaggtagaagaaaactcaccgagaaatgaaagctctgagaccacctgatgaaccctgagttcctctcgacactcaaggctgttgttggcccgatctttcggtgagttgtgataactacgatttgggagaaacgttgacgatccgactacaaccgtacgagacgttgtgttgcgccttagcaatcgatacacctctccgtgggttgttgatcttgccggtgcagatcaaccctattcctgcaagcaaatcgaagaaacaagcaagaacaagacaaaagcaatcttatattgcaaataggaatttaatacaaatgataagttggggttccgaagaacaagcagacggacggtctagccaacacgcgcgctgcaagcaagtagcaatggctaaactttaatctatcaaacccaagaaactctaaaggctacctagctatttaaggaggtgggaggacctctaggtcgtcctccacctggttggggcgcaccccacatgggccccacttgggccggggtcccaaacgaagttacaagcccattggcccatgacaggtgacgcagcaccttgtttttgtatttgcggccaaacgagatggagtctgctgatgaggccagatctgttggaaagaggactccgagaactttccatcaagtactcatgggccgaaaacggaggtcgtatgcaaattcggtagccgtttgaagtcagcagtgtagcaggtggccgaatcggattccagcacttggaggacttgatcttgatatcatcttgttcatccataatgtgagctatggttgtatctgtagtagccatggtcacatcatatgggcctgtaatgatctgccaatgaggcatcgcccttctttggcaacagaccgatgtgagcactatttaattcctcaagctagttttgatttaggtcggtaaagaattttattgcattgaacaggtccagcttgatgcgatcccaacatcttttgtaaaaggcgccaatgaaaccatcaggccaggggcttttttagatggcatcaattttaaagcctgttctacctcttccattgtaatgtcatcttcttgatcctgcaagtcaaaactgttcactcccaggttttgctagttgagtgagaaaactctgttatgcaccgttccaagccttttgtagaagtatgagaatattttttcctctttttcctggtttgaggtggcaattccattttcagtttgcaaggattagatgaaattgtcccttcttcttgcactggctttgatatggaaaagcttggtgtttgcgtcccctctcctaatccaagttagtctcaatctttgcctaattttgattttgtttaaggccgctagtcccagcactttgcttttgagagtggaataaaaagttctctcgtctgtggataggtttctactttcctgggccaagtctagttggaagatgacttcatttgcaattgcaagttgaagtttaatgtcaccaacctgcttcgactcccatctttttaggtctcttgctagtctcgagagctttaatctaaagattgccagggggtttgttgagttcagaggcctatagaaggaggggtattgcagccaaaaactctcaaatctaaataccttcactcttgcttgctcgtcctggccgattagaagcataggggtgtgaacaaaacaaaagctggaaaggggcaagagtcttgagtgctgaaacagaatgtcacagtcaggggtgcaaaaacatcgatcaatctttgtttgtgttgggttaggtgcacgtcacgacggctacctcatctgatcaaccccaaggcaaggatgatcaaggcaaagaaccaatatcacacaacgagcagagaaggaagtctgcgcgggagagacagcctaataaattgtataactcgagtgtgtggactcagtgatattgggctgggccactgtaagcgagtgaggcccattagcgcaatgctataagaggccggcatggactggattgaatcgaacaatgtagaaacacttttcctgaaactaattcaaatctctcccaattctattgttgttcttccccaaatccctcttcctctgctgctcttgttccagtctcaattccgattccttcctagctaaaccctaattcttagaagtcgtgacaatttggtatcagagccgtaaacctggagaagccacgctacatatctcgattgcaactccaagtcgaagctatggagaagcagaatgtggatttcggcaaggtgctcttggagattcaggagttattgggggcgctgaatcgtgcacaggtcgagactcaagcggtggtcgtccagcaggatcaaggagttagcagttggagacctcaagtggaagctgcggttcaagagctgcgctgggaggtcgaggagatcaagcaacaattggatctcgccagcaaatcacagcaagcttccgcatcgacgctttcccctcgagttccgtcgacggacgaggaaaggaaggcaccgctgctgcccacgccaccgccaacttctcttctggcctcggcggagggtggaagcaaatcggctcaaggccaccattagcttcagagttaccggggaaagacttcagggggaaacatgaccctgggtccaaccccggtcaagggtacgtatgattcacactccttgcagtttccaaaatttgatagttcgggggttgaaggtataatcaccgtgttccaaagttggatttccctaaattcgatgggttggatccccaggactggtgtatgaagtgtgagcactatttcaatgtgaataacatgtttcctggtttgtgggtgagggtagccaccatctattttgtgggaagggctgcatcttggttaagatcttctagggctcatttgcgttttccgatgtggggggatttttgtgctgctgtgtcggagaaattttatcgtgaacaacatgaaaatttgatcagacagatggatagtattaagcagtcgggaacggtttgggagttttatgagaggtttgatgaactgatgaaccaattactagtttatgatcctggggtgagtgcaaaatatttgactcatcgatttattgaagggctgcgaagagagattcgtaatcctgtactcttacagagaccaaagaccctcgaaactgttttgtctgtttctttgttacaggaagaggtgttggagaatcctcaagtttccagtgtcaaggaagtcaagagaatggaaggcaactctagttttcgatcatcaggcaagggaccttggccattgccgcaaccaccagggaagagtggaagtttctctttgatgaatcgtcctgaagagaaaagaagcactgatactgttcgcagtccgacaaattcaacagataaagtgactgctctcaaggcttatcgccgagcccagggattatgttatatttgcgtagagaaatggtcccctactcataagtgtgctgcatcagttcaactcaatgtggttcaggagttgttcagtctctttctggagggaggagctcaggaaagtcaagaaatctcaattctatcatatgctaaagccggtgaactaatggcgatctcagtgcaggcaatacaaggttgtgagccagatgggactatgcgcatgctagggtaggttcaaggaacagaagtgttaattctagtggattcaggtagctcagggagttttataagttcacaaattagcaacttgttttaaagggggtacaatctttttgtttgacaaattgtctgtcagagtggcttattggtgggtcgcctaaactgttgaacctttgattcctcattgtgagtggcaagtgcagggtcacagatttaaaaccactttgagaattttgccttttatcaactatgacatgattttgggtatggattggctgaaggagcacaatccaatgtcagttaattggtctcagaaaactatcaaaattaacttgttgggagcagtggtgactctaaaaggggtttagtctgaactgtctaggtgtgatttgttatcagcaaaggagatgcagcaattgcaacagaaacaagcagtagctcatatggtccagctttgttctccctctcaagctgaggtatctgaagaaatgccaagtgccattcatttattacttcaggagtttgctactgtttttactaagccaaaggggttgcctcccacaagacaattcgatcacacaatacctctgattccaggggcacaatcggtgaacatgagaccctatcgttacacacctacccaaaaagatgagatcgaagctcaagtgactgaaatgttacagaatggcatcatacaacacagttctagtccctttgcatctccaatattgttggttaagaagaaagacggatcatggcgtttttgtgttgattatcgtcatctcaacgcaattacagttaagaataagtaccccctgccaattattgacgagttgcttgacgaattgtccggtgctaagtggtttacaaaattggatttacgtgcgggatatcatcagattcgaatgaggactgaagatgaacacaaaacagcattttgcactcataatggtcattttgagtttagggtacttccatttgatttgactagcgcaccagccacttttcaaggggtcatgaacagtattatgtcctcattactttaacgttttgtgcttgtgttcatggacgacatcttaatatacagtcgcactcttgctgaccatatcaactatctaagggttgttttccaaattttggtaaaacatggtctgaaggttaaacagagcaagtgctcttttgctcaacagaaactgtcttatttgggtcacagcatcagaccaaatggggttgctactgaagaagataaaataaaggctgttaaagattggcccacacctcagtcagtaaaggacttaagaagtttccttggtctagcaggttattaccaaaagtttgtgcgcaactttggtattttcagtaaaccattgacaaatcttttgcgcaaggatcagcctttcatttggaatactgtgacagatgcagcttttcaaaccctcaagcaagcactaatatcagcacctgttcttgcgatgtcggatttctccttaccatttgtagttgaaaccgatgcatcagataaagggattggcgctgtgttgatgcagaatgatcaccctatagcctttctcagta

SEQ ID NO: 62169 - DNA, 2533 bp, Oryza sativa
  unsure (1)..(2533): unsure at all n locations
cgggtgttgagcgcccaaagagaccagagacctcctgcgtgaaagagtccaaagagaagaccttccacaattctccccaaaaagaacctttctccaccaaatagcacgtgcgcaatataattatgcgcgggtgtgattattttagagcatcgatacctnttgggcaaggaaggggtaacaaaaaaaaacgccaacggcggaaccgaggttcaagttttgtggccacaagtggccataaggttaagnataagcataaccacccaanacccagtgtaacatggaatataacnggaataccttccaatgaannaagctggnattggtatgnnaggtggtttacttgagncacaatgttcnacggtttcagnaaggtatgtgnccggtgncttagacttgcgagccaaatgagaaggntgcaatnaaggccttgtagnananggtgcaanacaaaggttgttaaagggtcggaaatcatgctttcggcctntggcgtttttgtgggaaagtatatggccagaagacctgtaccaggaaccttctacaagtgagaaagaagtgggtgttgtatttaccaaactcggtaccgttgtcggctgaaaacacttgagncgntggcgaacttgtgtgtgggcatactcaacgaactcacggatatggcgatgaacatgggatttgtggcgaagagaaaacgtccacttanaatgagtaaaatcttcaaccatcactaaataaaatttgaagccagaaatgctcataacaggagaagtccatacatcgcagtgcacaagttcaaaaggagaagaggtactggaagtggacttattaaaaggaagacgagtgtgtttccctaactgacaggcatggcaaagggaattatttgtcttggagcgaggtatggcggataaatgttggagagtggtgatggcaattggacccggatgaccgaggaggcgatgccataacgtggaggaggtggcgaggttgcactgggcggcgatggaaggtgcagcggccaggagggtgtagagctcgccatggctattgcaatgaagaatcacgcgcctggtccgagggtccttaatagaaaaaccaaactcgtcaaactcaatggaacatttattgtcgcgggtaaattgacgaacggagagtaaattgcgaaccagagggagcaacaagaacatgacgaaggtcaaatctagtggtgccaatagggagaaaggaagtgccatttttatcaaccggaatagagggaccattaccaacggtgatataagtgtgtgagttggggaggcgagtaacgagtataccatcggtggaggacatgtgcgaagtggcacccgtgttgagaacccatgaattggggctgtgaatcgtcatttgattgagaacggcgacgaggccggtttggtcccaagccggctggacagaccctgcaggcggcggcgaggagtatggcccggtgaaggcagtgtgggcctgaggatacggcccatgtatcctggcgctgggggcacgccagggttgctgctgtcctgcccagggcaagaagcacatccatggtgcggcttagcgtggagcagggatggagaaagtgctggtgccgaagctgttgccgccgttgttctgtccaccatggtggccgccgaatccactgccgccgttgcccccggagttgcggttgttgcggccgccgttcttgcccttgttcttgccgccgttgccgccgccggcgcggctctgctgctgcccaccgctgccagaggagtggcaagtgcccctggcgcagttggagtaggtggtgttggctgtgacgagggcattctcggactggacctgcacggaattggcgttgcaaagctccttgagaactagcgtgttcctcaccgaggtgaaggacgacaagacaggggcgctcgcgatggtgtcggccgtgctggtgaagcgcgagttgacgccacggaggaggttgaggacgagcagggactcggtgacggggtggccgacgtcgcggagggcatcaaccgcttgtaagttcaagtgccttaatttggttttggtgattaatgacaaatctaactatatgagactaacgtttttatgagcctttctttgaataagctcatttggatatgaaagtaaaaatgatgagaggtattgttttaaccttacacaattctacttggtttttttgtgggatccaaaattaagggagcttcctcatgactttattgactttatgggcaattcggtcttcatatcaaatgatggctttttggggggagctattttatatttgttttatagaactttcctggtttgaaataattttattaccctttttatggttattggggttttttttccaaaaaaaaaaaattaaaaacttgttaacaaaggaaaaggggttgggaaaagaaaaacaattttgggttaacctttttaaaatgtgaaaggttttcccaaataagagggggaggccctatatacagctaatgttggaaaacaaggtcacctctttcacttataggcaatt

SEQ ID NO: 62170 - DNA, 9146 bp, Oryza sativa
cctattggacttcacccaagcggctactttttcttcatgagaccacttgagattttcatattttcctcctcgcccatgtcgagttcttcagctgatttgagttcctcaggaggatcctctcttatggccaagtcgtaatccaacaaagctaagttaagacgcatagtcacccttttttcaatatttttgttttcccctctttggtttttagtctgatttacgtgaagtaatacatgtatgcttcatcaattgtccagatctagtagaaatgatgttgttttatttagttgggtagttgggagttggtatcttgtggatgttttttcatcatgttgttcaatatattattatgtaataattttgctagatagatctagttctttttcaagtttgtaggtctgaatatgtgttggatctgtcgtctcttgtggttggatgcatggtatatggttgtgcttgttgcattccacgttttgacaatgtataatgcatattataaatttgctatttgcatagatggtagatatacgtcataacgttagatcctaatggctaaagctgctggtttagttgttacaatgtgtgcctacatgattttcattatgaggagagctaggcaacgccatcactaggattttctatgggccattgatggaaagggacttaattagacaaaccaacccattttttggctgtcatttgttgcgccaaagagagctactgtgggactcttgttaacaatgaaatttggtaagccccaaagtcatcatcggcctagtgtcactatcggcttcagagtcatggaatcgaccgatgggaattatcaagttgtcaatagtaggattcttattatatttggttaaggaaattaatatattaaagaaagcttatccagaagtggccgagttcaaggaggatgtggccgagttcaaagaaattaatatattaattaggaagaatctgttagtttccttttatctttaggaaagggtatttagtgttcaataaggattttatgttttacttttatctttaggaaagtttctttcttgtccgagaaggactactatctacccatgggtataaatatgtacacccggagtcattgtaaactatctcacgaataaatacaactactctcggtgatcgccaccctctttaccgaggtttttacttatcatccggcgaaacttagcacctgatgcggggttgcatcggcttttgatatccgcgaagggtaagtcctacgttccgccggccctggcaattgtattggcttcatcggcgtcgttcaaggctgcatcagcacatccgacctcttggattgctatggttcggttgatatatttgcctacctatttatcatatatcttagttaatctagtcttaatatttcaatttagccgtatcggccgattctcgctttagggtttatgccggtatcggctaaatcgctttaccagattatattagctaaggtatctaccaccctgaaaatcagccaaaggctttattgtctagatattatgtttcttttcatacttagtgctgcatcagttaagtttgatcacttcgcgcttagaaccgtaatctttagcctacttcttgattgccaataagggtttcatcggggtttcagccgatgagttatctagacattacatcggcttacaaggattgcatacaagttagatttagccgattgcaacaaaggtttcagtgtttatctaatcttgtggattttatgacatcggatattcagccgatgtatgttttaacttacggatcagtgcttattctatcatatcattgttagccgattggtttctactggatattattatcgttttattacattaccattatccgattgtctttatattgttatctacattggacatatagttgattgctcaaaaccctattgacatcggggagtatcgacatcggctggaattactccatcggcttgtctaccgatcggctcaatgatctgttatttgtatatcttgtcagttgtaggatcaaactgactggcatgctcgcatctcaacaacttttggacctgcactagagctaaacagatctcccaggccgttgtgttcgtcgacttagttcgcgccaacacagacctagcaccatcagccgagcgcggacttttcatcaacaactccattcacagctcactggaggaacaggttgccatgttccttctagttgttgaccacaatgttagatttaaggctttacaacccatttttagaaggtcaactgagacagttagtaagtacttcggagaggtattgtatgctgttggtgagctgagaaatgatttggtcaaaccaccttcaagtgatattcctcgaacaattcttggcaatagaagattcaacccatattataaggtaaaacaaatattatccacaagttacgtttttttcccacaacctatcctaacatttttcatgccaattgggattgtattggtgcaataaatggaacccatcttctatgtcagcagcgtttaggggtagaaagtgtgttactacccataatgtaatggctgcggtggattttgatcttaaatttacatatgtacttgttggctgggaagggtctgcacatgatgccctcatacttgcatatgccttagagagatgatggccttagtgtcaataatttagagtgtcaataatttagatcttcaggattttttttttgtcatctggtaatgattgagcacattttatcacatgttaggcctcactactgggaacccatttttactactggttcggcaaccccttttagtctcggttgtacaaccaggacgcacaatccggaactaaagatggtaattttaggcccggttatttcagtcaggattaaaaatcgatctataccaaccgatactaaagatggtagcgactagtggctagtgctaccatttttagtactggttggatctatttgcttttttttaatgttttttttgttgcttgctgcttttttatacatatgcatatatggtgcttgctgcccatatggtgcttgccttcaggcttagccaatggctctgtttacaaacgtggcccttctgctcacatggcaattagcaaggcacaactaatttgcttggatagagtagaaaactcttagggcatgtataacggtctttattagtggtctctctctattgatgcaagtaaatttaatgacatggaagaaagagaaaggagtatggttgttatgcatgacaacggctcagagtcgactcttagaatttattagagcaaatttcgttgtatggtggtgaaagaaaggaaagaagagcaagaaaaagtattttaatacattaatgattagagaccatattgtctctaactgttataggatgctagtctctaaataacgtagagctcgtaactaactctacctttgtgcatgaccttatgtcacaactgtttcatgtattatgtgttcccttgtgtaccttctgtttaccattatttatggtacttccgagcgcagatttttcgatatcctgtgacagtttaaatgctgcctgtaagtgaatatgatatgtcatcgtccttagccgcgaaagtaagaatctgtagttcttgtttgagaagtttggtagcctaagttttagtccctggcagtttaaggagtcccccgcgtcgccccccgcgtcgggcgactcgggcggcgcaacccttgccgccgccgccgcccttccccgccccttcctctgccttgccgccgcctgagcgagcggccagcaaagccggcggctcccaaggacggcggcggcggggctcacggcggccatctcccgagctcctggcgcgggcggacgcagaggcggtggccgaccggagcggcgccggcgtcgaggtgcatggtggcagatccagcgtcgccaccactagatctggcgcacccgcagctagatccggtcgcggaggcgccggcacggcgtcggcgaggcgtgggcgcaggcggccacgacaggcggtggcaggcgtgccggcggcgcaaaaggcgcgggcggtcgggcggcagcgtcaggcgcggacagccgcgttagtcggcggcaggcgcgacggcggcgcaggcgcgggcggccgcagcaggctcggaggcgcggctgctttggccggcggctcgatgcctggcggcgacggcagtggtgcccccagatccgtgcctctcggccggatctggagggtgggagcagtcggcgacgatagcgacggtgtggcgacggcggcggcggcagttggcgacggcggtctcggccggatctggacgccggcggtagttggcgatgacggcggcggtgtggtgatgacggtggcggcggcagtgggccggtgacagttggcgacggtggtggcggtcgcggctgtggtggctgccgtgtcatctggcgatggcggcggaagacatggcgtcgggctgctagctgctcggtggtggagggtgacagcacagcggcgatttgcggaggcggtggttggcgtcggtggcagcggcgacggcggctgtgactctggaggcggtggcgacgtcggcggtggggaaggagtcaggggcgaggtggctgggtgttcggcaaccaaggctgtggtggtggtgaccgtgtatacggtcaccggaggcatggcggtctcggttgactagccaagggcgtgggagacggctgcagctggccggcgcggcatcgttcggtggaggggtcggaaaccggcttggcacaaagaagcgcagccgatggcagcagaggccggctcggcgcgagatgcgcgagcggcggaaatggaggccggcttggcgcgagaggcgcggccgatggagggaggctggattgacacgagaggcgcggccggtggagaaggccggcttggcgcagagaggcggggccggcggtggaggaggcgacctaggtgtgaggaggagctgccggtgggtgtggcgcggtctttggcgcaagaaggctggccggcgggggacgccggtgaaggggtcccacatgtcagcaaagcttgtggagtggtggagcatcggtgcgccagccgtgcctttgttggtctagtggcggtcggccacgcttagcggcggccgatccggtactagccttctcctgggcttgtgtattggcgatatcgtcgtgtgggtggtggtattttttttcttttcctggttacgattctccagggttgtaatcttttattttttttcctgctctgttaatagaacttcgtaccgtctcgtgcgagtcgttcaaaaaaaaaagtccctggcagtttgatgtctggtccagagatgttcatccattgcagcttcgtgcactgcacgaaacatgaaattgatcgatgcatgtatataagagtgggaaaaaaggttgtttggaatcttccattccttatttctcgcttcgcttctctactcctacgtgaatctaaaaaccaatttattttggaattggacggactagatgtgtgtgtaaaaaatcgttaacttaccatttcttaggtgttcatttttgtctaaaattacaaatgcaaatacgtttggtccctgtttgacttatatttgacccgttgactactcggcctatgtattttcttttctcattttaattgtaataacaaagagcaaaacattttttcttactatttaaattcgtccaaaaaagcctatttccagaaaaagctttccatcaatagtagaagccccctaaaacttgaaggagaaggtggaaaataaaagatgaaactaacatgttgtgggagcaagagacgatcgcagccgtccatccgggaaccgcgccgatctccagccgtcgatcgggctccacgaccgtttccccccacgccgcccgggcccaccacccccgtcctccttccgttccccgtttcctccctttctctcccggtctcccctcacctctttattacgctctctcctcctccccgacgacgaggcaacccagcgcgaggcgagccgcggcgactagggtttcgtcgcgccttcctcctccttctcctcctcccccaccgccgccggcgacgacaaggtatgcccgcaagcgcgcctctctctctctgtcccacttaggatcccccgcgggtgtctcctgctacgtggcggtgttggatggccgggtggtgtccccgatgctctggatttcgtgcgaatcctagctagtaatattagaggtttttttttttgttattgttggtgatgatgctcatatgctgtagaggggggttggggtgtgctccatgcttcgcggattgctggctctggatgcttcctttttttttcgtgtgtaatgcatcgtttgcttagttgatcgagttgtggtgtgccctgtcgccagacattgccctaatttctcagcccggctgtatgataaatctgaaatgaaggtgtctaatatgtaggggtgtcaccaggaagtgaactcctcgttttgttcaagttgcattatatattttggaaccttatggtagctctatttttgtgctggagtgcggatgtggaatacacgtgtgccctgttataaactattctattatgatgattaggctgttattggttgaagttgggtgatagatttggaactcaacgcgataggttgttataaactattctattatggttccagctacagtttgcagttgttccctaattgttgaccctttttttttcatctgaattatagattgcactgttctggaactaaaattgatgtggactgtggggtcatctttactaagtgctaatcatactaaaatgttttataatcccaattccaagatttagttttctggatggcaacttttttttgatcaagcagtatgagatcagtttttggttgttgcaatactttgtctaggacctgatacacttgagacatagtactgtggcaaacttttatatggtggtctgtgactttgtgtgctgtaacttatacagaaaaccaactattatgtgacagaagaaaaggacaaggagatatctcagctagttatttctcattagttgataatatttttgtactgcctttttggttgactgatcctcatagtaggtatgttgtatggaacaagttaatttctcagcagaatttggtagacatgaaatgatgaatgctcacaatttgtacacatttttaccaagatttctttgcacatttgaaaggtctactggagcgcaaacaatggagcggtcttctcagttgaatccaaatgccactccctttgtgcctcccccaaggtcttcgtttgaagaaagcttgagcggaaggaaggcctctgagaagcaagtaggtgattcagaaaaggatgagactgctgacaagtcttctgaatatgagctcccagattccctttctttggacgactatggtgaaagcctaggaaagctcaacatttctgcagaatcttcatcaaaaggagctgctagtaccgcgcttgatccatcgcactacgaggaaaatggtgttgataatcatcttgctgtggtagaatctctctcgaagatgttcccagatgtgtctgctgacttcattgttgaagcactgagggcccatgattttgatacagaactaactattgatatgcttgctgatctggtatgtaaattcctatttcgatcctctgtttatggcacttctagttattatcaccaagtgttacatcactaatgttgtccgcacaccttacaaataccatgaaactgcatgctgactgccacttttgttgttgacattatttctggcgatatatatttattccaagggaaacatttctaacaatctttcttgttgaattttccacttcagtgtgaaggtgatgattaggggaaatctgctgaagtgtcaggaaagtagcagcagcagtatcgctcttcatccaccttggcagaacaattactcttcagctacatgttattgaagtcaatcttcgtgacaatcaagactgaatttcgtggcgtacatcttattgctgctgctctaaagaattcagtattgtttaggagccaaagcaacaatgaccgtgttttgggtttttagttccgggtggaacagctattttttcagtattagagtctgcttcatgttgatggtttcacccagcagtttatcgtgtgatctgttgcaacccttttggtgtagctgaacctccccctagctaagcatttaggagtcagcaatagtgtgcaatttttgctgcaatgctgtgctcttaccatgtacattctggtcttgctgcattctgtgtagggagatgaaccattccagattctgttatgatgcattatttgaacagaacagatatgcgcatgaagagatatctatctcattgcagttactgaatggagaattggagaccatatggtcatggttatgacttatgaaacctcaacgttatcttatggatatcgtattgctctcgctttttatgcaagttgttgtcgtcaatatttgtatttcgagacgatgtatatatatgtgcagataacctccctctcccgtttcgatgcagataacctctccatcttccatatcgatgcagatagacgcacgctgcacatgtaatgttgttccatgaggatgcgtgacaatgaagcggcaacctttctgctatattggagacccaggggggttggatcgtgccgattatgttattgtgtacatagtagagcagattgtttagcagatttttgagaaaattaactttcacctatgtatgagaaattcgaaacatattcaggccttataatcaagacaaattttgctacaagacaaacatctgctaaacaatataggtcaaagtaattaaagtaattgcgggtcaaacatatgacaaacatcagcaaatatccaataatgtcaaaaatggatatttgctgatggacatcgctcgcattaaagtaataatttccggttgaataggaaagagaaatcgcgtttttgaaatgtcaaaaatgcccttgtgcccacatgttagctcttctatctcttttctctctctatcccacatgtcagctatgacggcaggcaggggaggtctggcggtggtggtgggagggcgaggacggagcggctgcgatgacaggagagtgacggc

SEQ ID NO: 62171 - DNA, 2466 bp, Oryza sativa
  unsure (1)..(2466): unsure at all n locations
cccaccaccacaaaagaagggggtgttggaaagtttgtttttaaggagagacaaacgtaggttnccataagtgggaaaaacacaataaaaccctctggtggttagaaagggttccgggggttcacacaaagatattggccgggccgcggttataagatgataaattattggtttgccggacgccacaaagtttcattgattaacaattagaggttataggcgcggccttcagccgatgttgctttaccctgaaaacagtgttttcatgtaatttgcagccggttggtttaactggattatattatggtaaaataaactatcaacagccgatggctttatatcataatctcatgggacatatagcggagtgttaaaccctatccactatcggctggtatcggcatcggctgggattgctccatcgnctgtcaagccgatcggctatttgatctgctgttatatatcttgtcagttgcaggatcaaactgactggcacgcccgcatctcatcaacctttggacctgcactggagctaagcagatctcccaggccggtgtgttcgatttttttcgtcaacagaccggcagagcacatagttagggatttcgactccaacggctagttttgatggttgggggtatatatacccactccccagcaacaagggtaaggtttttgcactccattgcattatcttgaacccttgcaagagctctcacacccttgtgtacttagtttatctagtgaggtgttatagagtgagttaagcccatccaagtgcattgcttcattgttatagctagtgtggcacttgatcatccttggcaagcatcctagacttgttactcttggaggttgccgcctcctagacggcttgtggaggtgttgcccggtgacctctccgaggagattgtggaggaggcccaacgccgtttgtgagtggtttggagttcaccaccttcggagtgaaggaagaactaccctagtgatcgaggctagggtagtcctcttcgtgggccggctcccaccttgcccaccccttgacgaagggggcgtgcggtggcttcgtggttgagcggtggagttgagctcgccttaacagggattaggaaaccggcgagtttccgagccttggtgaaaaattccttgtctcttgtctcatttatttgttgcatttacatttgtacaatttacatttatagagacatatttgagcccatatcacctaggtttgcaaaacttaacttagttgcttagttaaccttgcacttcaccttgcctagcaacttatgttagttttgtttaagtgccattaagttttaaaaccgcctattcaccccccctctagtcggcctccttgatcctacaccgccgtcttcatgcactgacaataatcggcgacggagagatcgccttgggtcatggagtggaactcgtgatgcagatagatcgcgcgaagctcctttgtggcttgaaagagggtgtcgatggagatccacaagtcccaagccgattgatcgggcttcatggcgaggtcgaggacgtcgtctgcgacagaaccgaaaagccagctgcggaggcagcaatcgggctgttcccaagcagcgtcngggtttgcgggaggagcagcgtcaagatgatcgaggagaccaaatttccacacatcgagcggaagaagcccttcacttgttgtagttggggtacgaagctcgagagaaattggacatgggacttgacggcgacagtcgcatacgggttgatgaacaccggggcgacggtagaggtggaagacgacgccgtagaggagtcggtgncagcgaaggtagccgagnaagtgnacatggtgaggaaggaggggcgcancagccaggnaggcggcagcgctcggtggacgcagcgaccagaggaagcggcgctagagcagtactagaagaggagaaaacttggaatctgataccatgtagaatggaatggggagaacacctcacacccaatgggaggggtggccatgcattgatataggaagcacatgtacatgatcctcaattagaggagaatacaaggaaagagacaattcaatacaatatgtacatatatgtcaaagtattcctaatagtaagggatcatatatgctacacaggggaatctagatttcaatcacctgaaattttacaaaatttcagtcacttttttgctgccactagatgtgcaacctacggttgatagcccttcacttcagtcctgtcttctcagcccagatattcttaacttgtgaaatttctatacatgtgttgtgtaattcctatacatgtattgtaatctttgtgtactagtggttcgctagagcagaccgacagttgggatcacttcctaacttacaaaattgttcagagaagttggtcaacaaattgcacagaacaaacatttgcatgataagtccatacagttcaaaaaagctatttcaag

SEQ ID NO: 62172 - DNA, 2676 bp, Oryza sativa
ggtagcctaaagccacgaaccaaactcatactaagagtcctaaacaccttagaaaaccctctagtacaagaaagaaactttacataaccaattgtaccaaatttggactccttccaaattcgactccgcatcccatacgcacacaatacctccatcgtatgccatatggaatcttcaccaaccacgtgcatcaactctagccttagtatcctgcgtgatatctgaccaccacggacatcgtctttccaccaagccgactcccggtccatcaccgcaaatactctcccgaggcatcgagtcacctacacatgaaacaaacaaagaaactatattccgagaccaagctatctccgacttgactcattgttagcaaacaacagtattacatacgtaaagtatccatctagaagccataaccatgaaacaatcacgaatatccaaagaaacaaaccgaaaccgaaaccgacacagcgtcggccggtcagactgcgggcctgccggtctaactgctcgattaccaccggtctgaccggcatacaccgcccggtcggaccggtcacatgaaataacagtgaatccgatcatcacctgaaaattgattatctccaaaaccacttcgacgataatctccaaatatcaaaaccaataatcacagatgccaattgttcatcacagaataagaatcaaaacacactttgatcttacataattaacatgatagactgcgcgtaggttgttaggcatatatatgttgatatgtaggtctcatcagccttccgagggatgcccaaataacagtacgtatattgcttgcaacaacgagatgacattcacacaggcggcgtatatatatggttcgtcaaaagggacctacaaaatactcactccgtttcatattataaaacattgtaatttttatcataatcaatctctttttaaatttaattaagtttatataaaaacatagttccgcattttcaacactacaaaaatattatcaaaacatatttaatgaaactaatttggtattttagatgatgttaaatttttctacaaacttggttaaacataaaaaagtgcgactagtaaaatagtataaatgactttttttttgagaattcatgcattttatttaaaagagaaaatatcgtttagaaacaaattgcatgagttatagttacatctccagtgggactactggtaagtgctagtttgacaggacaaacacccctttgacaaatgtgagaaatatttgagcagtcaaatagtataaatgacttatagtatgcaacgggaggtaatagatactaactctattttggttttcatcactcttgtactagcatgtactttcatcttataagttgttttgttttcttttctagtacatcaaactttctttaagtttgactaagtatatagaaaaacatagtatctatatcacaaaaaaactcttttttcaattttttttgtgaatttagtcaaaatgtattcaatttcagttaaaatttcaaataatttcatgtaaaacagttccaaaaatatttcagtgaccaccgaaatttcgaccaaaaccaaaagtgtaaccctgcttataaatgtacgacgatcaagaagacagggaatggtagccatagaggtggagcgagctagcagttgagatagaggggagagggagattagttgagagacgtgggaaaaaaatgcatgtgatatcatgcggcttcccaacccttgtatagctccccacctgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccggggagacgtttcggttcggcagcctcgacttcgtcaccaacaacttcggcaagatctctctccttgactcggtgtccgcccagtcgggagagaaccggctttcagtcccgtttggactcccaaacgcggctgaaagttacttcaagaccatctcaatcgagttggcttcaaaccactcgggcgagatcgcatcttccccgccggatcaagatgatggggcttacccaccgatcctaatgaagctccccgacgattcggcggccgcctccatcacgacagcgtcttcatcccgtaggcctaggcggaagtcggcttcaacaccgatttcgcctagcttcagggaagtcggcgtcatcctccaaccactcggcacggtttcgacggatcagttg

SEQ ID NO: 62173 - DNA, 13297 bp, Oryza sativa
tccttatcataacacctaaaagaatcattttgcttttcatgaaggaaatctgggaacatgttctccatttctattgtttgaacttaatgtctatgtaatctgaagagttgtaccactaggtcctctcatccttatgaattgcttagtgcattcagcttgtagaaaaactctctcagactccaatgtacaaaggattaacaattcgcagctgccaagcttttgagtgtatatctaattaggtatatctgagagagcctcaagccctaggatcattacaatgattttctgccaataacttactaactgacctagaagactagacttttattggaatttgctttagtcatcagatttaaatgtgaggccagagttttacttgggtcttgaggacctgagagatatagttgctttgcttgcagattaccatggtaggagttgagatcatgcaaactgtttgctgttttgttgctttagcaccacatgacagatttgtcatgcccaatcagtacatgctagagacttgtcatgcctaatgtttttttttattaaagaatgtgtccataatatatactagtactaagaattatctgtaaagttgtgatatcaatatggcacaactttattttgagttagcagtaccatttcgacaactttattttgagttagcagtaccattttcgtgaaaaacaagcaatataatttcatatgggaagttcataggaagatcatttacatgtctaatatgcaggactttccttgttgaacttggaattgatttacaatcaaccatctgtgtatttaatgctgtaagatttttatagttcaaacttggagttgatttaaaatcttgttatttttcaggtgatgggatatctttcaagtccagctccacacatagtgagtggggcaatagctgcactatcgctgcttatatacaatgatgctaacttttgcttggaagttccaaatctgataccatcagttttagttttgctgaagcataaagctattgaagtaatcaaggtgagtaatgtttcattgtgtgcctctcttaattgttttcatattattgagagttaaatcggttcaatcctacatgttttaggcatctttgggctttgtaaaggtgttggtaacatcattgcattcagaaaaactgttggaattgcaagcagatatcatgagcggcatattaccatggtcgtctgttacaaaacaccatttcaaaggaaaggttagtcagtaaaattatcctgtgtcttttttcccattcaatcttatttttcttaagggtaattaatatgacattgtgttgctctgatatttaatttgcaggttgtgttaataatggaaatactgattaggaaatgtggctttgatgctatcgacttagttacacctgaaaagtacaaggcttttgttagaagcgttgaagaggtcagattccctttacttgcttggtctagcttgggaaactagtagctatagtgaatttagccaatacgcaattagccgctggtgctccaggtcaattactgatgcacatttatcgaatataaatataaatgctttatagggtcaatttcttcaaaattttactttatttgggcttcttggcctacttttatagtatacaacactagaatgtggggaggtcaactgacccattttggagagcttctcattccttaattaatatgaaaaagtttagtacagctgcacaggaaagtttagtacagactgcataagctataaagtcaatgcttgatctaagggatgatgattacatgactattggctactgtctgaaggaaagacagcaaaccaacgaagtaataaattagcacaatctttaatcataatttactatgcaaagctatttctggtatgtgatctcacaaacgtttgcattaattgtagcataacatacacacatcaaggagcaagttttttttttgttttaaggacctatttaacccacctcttgtaatgttgaggctttacttcactcttgatcctgatgtatggactggttagcatgttatcaaatgtgtggttcaactggattatccttaaatgcagtattaagctaaatttgtgtagcaatgagccatgtttctttactttgaccgcccttaaagagaggaatagagaagaactgtgtgcgtttaagaagtttggtaatatttttcccctccccccaacataatttcttgtttgggttacaatgttacaaaaactgcatccttcgacaatatgaacttgtacctttgcatgatttatttttgaaactgatgtacatcctagttacaaaggcatatctcggtacttctgaaattcagcctaagacaactctgatattgaactcaatattttcttgaggcaactgatttggattctggacagttccttgaacggctctcattctttcaacttgcagggccgcaagggaaatcataatccagcagatggcgcagagtctgaggcacaacaacctacgcaacatgctgctaagaggttagcctgcagcacttagctaatttcccttccccccttaccattacatgttaatagtagttaattgtatgttttatgaattcgtatgtatgcagaagaaaacggtctgattctgatgttggaactggacaagagggaacacacactcgggcgccatcgaggagtttgccagctggaaagaaggaattcttcgttaaaggggccaggaatgctcgctctcctggtgtgaaaagccaacgaagcaaaccatcaggccgcaatggtgatagaactaatttcaaatccaaatctgaaccacggccaggaaatggccaaaataccaagggcgacaaacctcaaggtttcaacaaaagaaacagaactggtaagttcgacaagacacaaaatcgtgggggtaaagcatctgatcgctcttctagattcaagaagcctagaactgcagcaacaacatgaaagccaaggctgtcatttgcaccatccagctatcaagctgcataaacgcttcttgttagcctcatatctttcaccggcaaggtcaggtcctttagttgagtccatgccgggaccttgaaatttgcatgcaccttgattcctttaggacttttgagaactgcgatagagaaggtagctggctaaaaggagcaattcttcagggaatctgcgtcagttaaaaggagcaaatcttcacttcagggaatgcgcactgtctgcgttagtaaaagagagcagtggtgtcgattgagaatccacctagttgtacattaaaattttgacttgtgggtggattgaatcatacgaaactattgatctagggggcatcccttcagtgttgtattacaatttatacgcaggtgaaattttgacttgtttgtttcagtcatccacaagccggacaatatgctgtcatttggctggcgttgtcaatcaggtttactcattacttttgcacagtttacatccagagccatacagatccaaattgatttttttttctaaagaatacaactccgaattatgacatttcatcctgttgaagtgtagagcaagctcggtttaggtcctaccccaaaatttttcaccatgtcatgtcaaacgtttaaatacctgcatgaagtattaaatataagttaaaaaataactaattgtacagattacgactaatttacgagacgaatcctttaagcctaattgcttcatgatttgacaatgtggtgctacaataaatatttgctaataacggattaattaggcttaaaaaatttgtctcgcagtttacaggcgtattctgtaatttgttttgttattatactacgtttaatactttaaatgtgtatccgtataaccgatgtgatacatgtgtatccgtataaccgatgtgatacgataaaatttttcacccctgacgcgtatcatcgcactgtctgtctctataaactacacgtaaaattatggaatgtgttttttagcgtgtttttatacaatttgattcgaaaatatctttaaatttacccaacttagaccaaggcccttttatccatttcttacatggaaaagcctacacactttttcttactaaattattactaactctttcttaccagtaaattcttggggtaattgtaaatttactactactttgaatcgttattgcaaaaacgccactaaaaaattgcaaaaatgcaattagaactgtcattcgagtggcatacttgcaaaattgaaaaaaacggtggcaaatttgcaaattcttaggcttcgttcagtagcaagagactaagaggagatttctctcgttcttcacgcgcatgcttcctgaactactaaacgatgtgtttttttaaaaaaaaatttaaaaattgctttaaaaatcatattaatctatttttatatttgaaatagttaacactcaattaatcatgcgctaagagcaagtttaataatatagcccactactagctccaattcatatatagttaatctaatagccaattcatacaatagttgattactatactctttatatatggtctcaccatatatagccaatttatacacacactacgtcttggaatccgtgctgcagctggctacatatctgtagcccgattctcttctctatcatattttatctcattaaaatatgtttatagctggctaatagtctgttattgtacctgttctaatagctcaccttgttttacgtatcttcttaaacttctctttttttctcctctcaaacacaaccttagtaatgctgtgagtgcatctagaatttttataactcatctacctaagtaaaaaatttagtaaggaaaaaaatagtagtaatatagttgtgctctttctgcttttccgactcagtcagacaggtctagacgcggagggagtccgactcggcgacttcgggtccaaaccaaccttgcggcttagctagggttagctagcacaccacgcagcttcagctcaggcgtcgagaggaaggaggaggagggggtcagcctcgctcggttccggcggccatggcggtggcggcgcccggccagctcaacctcgacgagtccccctcgtggggctcccgcagcgtcgactgcttcgagaagctcgagcagatcggcgagggcacctacgggtaaaaacatttcgctcaaaccctagccatgaatcgagggggattgctcgtctgattggattctctctcgctcgcccgttgtttaggcaagtttacatggccaaggagacggagacgaacgagatcgtcgcgctcaagaagatccgcatggacaacgagcgcgaaggcgtatgaattcccccccccccccccctttttttttctccgccccttcttccaatttttcctctctgatgacgtgttgctgattgcctcggcgcagttccccatcacggccatacgcgagatcaagattttgaagaagctccaccaccagaacgttatccagctcaaggagatcgtcacctctccaggttagtttcatcgtcgcaagcacggttggttttgatgtatcagaaccgagtccatttttggtgctaattgaatttggaaactatatgccttttcaggcccagagcgagatgagcaagggaagccaagtatggcacattttattcctgcaattccttggtttgtgggagtggttctaggttgtaatgtctgatgcattgtcatcttgttgaaatagtcgagggtaacaagtacaaggggagcatctacatggtcttcgagtacatggatcatgatcttactgggcttgcagataggcctgggatgcggttcactgtgcctcagattaaggtagaaccacctgtttgtgtgacttgttcttgtttggatgtgatatattttgttatgacagactgatcttctgatgtgtgatcttctatcgtcccagtgttacatgaggcagctacttacaggcctgcactattgccatgttaatcaagtgctgcatagagatattaaaggttccttctttagagatatcttgtttgttcctacttcttgcatgtatatcagttttttccctgaactaatatgttgtatccgttctttcttgcaggatctaacctcttgatagacaatgagggtaacttgaagcttgctgattttggccttgcaagatcattctcaagtgaccacaatggaaacttaacaaaccgtgtgatcactttgtggtataggtatggaaacttcccatgaggaggttcttccattcatatttctcttactttcttttcattgttctctctctcttatttgtgtatgcagacctcctgagttgttactcgggagcacgaggtatggtccagccgttgacatgtggtcagtgggttgtatttttgctgagcttctcaatggaaagccaatattgacaggaaagaatgaggtattgcatcttgaagctttgagctatcaattggataactgaagtgccgttgcattttagtttttcatttccctccttagtgcattatttgtgctgatacatgtttattgtttcttccctcattttggggattggaaaattgaactgtcagttatcatgcagatgcagtcttgatttaattttgtaaaaccgtttcccctacgcattgattacatgcactgcacattgtttgtccatgcaatagttataactcctaacctcatctgattttatgctattactgcagccagagcaactgtctaaaatttttgagctttgtggtacgcccgacgagttaatctggcctggtgtcacaaaaatgccatggtacaacaatttcaagcctcaacgaccaatgaagagacgggttaaagagtcctttaagcagtgagtgctatgcttggcaatgtttttcttatgcagctttcgtcttgccattgatgttcactgttttacatatttgcagctttgatcagcacgcgctggatcttttagagaagatgttaactttggatccatcacaggtatgctgcattaaccagttgtgacttttcagacgtgtcacttatcatttctgtttgctttttgttctatatattgacaatcattttggttatacagaggatatcggcaaaagatgcacttgacgcggagtatttctggactgatcccttaccgtgtgatccaaagaggtacatatgatggttaaatttgtcacgctgctaactagcttaattctaataactttgcatctgatacagcttgccgaagtatgaggcgtctcatgagttccaaactaagaaaaaacgccagcagcagaggcaagcagaggaagccgcaaagcgccagaaattgcagcatcctccaccacattcccgtttgcctccaatccagaacccaggccaaccacaccaaatcaggcctggccagcctatgcataatgcaccacctgtggcagctggcccaagtcatcactatgcaaagccgcgaggacctggaggccctaataggtacccacaaggcgggaaccaaggaggctacaatccgaaccgcggtggacagggaggaggctatgggagtggcccatatccacagcaaggacgaggtcctcccccttatcctggtggtggcatgggcggagccggtggtccaaggggtggtggtggcagtggctatggtgttggcggaccaaattatcaacagggtggaccttatggtgcatctggtccaggtcgaggcccgaactataatcaaggtggttctcgcaatcaacaacagtatggaaactggcaatagcacggcggtatcatgagcagcaaatgcccttccggtaggactctgtatgttgaaagaacctctgatgttgtatttgagatatactttttgcatggtgtattcagatccaggcatctctcggaagtatgatgtttatgactagctgtatagtatggcactgatgtgattcccaatgtttgatgtactagtattattattactgcaagaatgtggaaagacatgaaaagtttgttatcaggatcaaaacttcgtgttggtagtcctgccattagataatggcaatttgcccataatcttcttttatgagaaaactagccgggtgtattgtgcggttagaacccatataaaattatttattttttaaaacatgattttttttatttttttaaaaataatcatcttcttgtcttagcattaaaaaaatatatctagtttctaattttatagtttttaaaagttacttcaccccttactcctttgtctttacttcaccccttactcctttgtcggctttttatttacttgtccatgacacggctactattcattactacctccgtcccaaaataattgcaattctatgttatttagcatatattaaggtttgagaagaaagactacggtgcccctcattaaatggtgtttatgtgagagtgggaagatggttgagggtaaaatagggagaaatttgaatgagatatgattgatggggcaattagtactctagaattacaattattttgggacgaattttaaataatagaaatgcaattattttgggacggaggtagtattatttagacctttcaaaatcggatcttatagcttcgcgtttcctttttatatttttagaaatctagtcaaacgttgttattgtactattttacgattagtctgttgtccccatttttattctcatttcaaatctggtcatcgttgaggttcccttttttactttctaaaaatcctatcaaccaccatgacccttagcatttgccaccattatgttttagatctcctttcaatatttcttaatttttaatccaatttttttatctataccactttaaatattggtagtggtgatgacagtaaatctgccgctaccactcctatcattgacgtgtggacccctatttatcattgaaaaatttgaatttccttgcctttgagagctgaaagagaatagacttgggctagctgccaaagagctgcttttcaattgtgatggactgagtttttttttcaactgtaccaaagatgaacttgggtctttggagtggatgagaatgattaaaataaacaatggtcacaagccacaataaagtcgcattgattactttttgcaacatgcacatctaattaatactcatatactctatatttacaatgataagcaatataattattccacaacatttgattttctcctttaatcccataaagaagtacatgcattctactggttatttctatattgtattttctacttagattgtattcctacatagatcctcatttttttttctaattttctatttccttgcacctttcgcaccttagatgcgagcacggagcaccgtcatcgtaagaatttgtgacactctcatcttttggccggaacgggatagcatatttgggcttaaatgggattcgccgaaatcatgggtcatatgttttctaaggtgatattcttttctcctaaagatgaagattaagttttttacacaaaataaggtggtattaacgtatgattgattgagttttaattattacaaacttgaaaaatagattaatatgatatttgagagcaactttcatatagaaagttttcgcacgaaacataccgtttagcagtttgaaaagcgtgacacgaaaatatttatctttatccaactcttattggagaaaattacaggacctaagggatggtcagcctatctcgaccgcgcgctgaaaggatgagcggttaaatggactgcaaactgactcgaagaattctactgatttttaccatagaacacgtaaaactttggttaatttgtttttcagaatttatatgctgttttgatttgaagcccaacaaatcttgtgacagtatggtccatattttaagcccaaaactgttagatacttgttcatgcatgtgcataggcttcagtcagaggatcaatgggagaaaccagaagtgacacaacactgaacaaaactgtgatggtccaaaattttgcttctaatttcctagcatgttagcaaatatatattacatgaaaggatggacacatagtgaaattgtcacaggagtgaaaaaccagaatgatgtacaagtaagcaaacatgctctctccgaaacttcaaattctccatctcaaaaaacaaagcgtcctagctcaaggaaaaatggcttcaacaaatgcctcagcatcaaaaggctgaagatcctccatcccttcaccaacaccaataaactttactggaattccaagttcatctacaacgctaacctgcaatagatcaaacaacaaaattcaggtgaaccactaaaatgttgttgtttataaactgcatatggcaaggaatatgtgtataccacacaaccaccacgagcagttccatcaagctttgttaggacgaatcctgtgactccaacaacctggcattaagccaacagagttcgttatatcttgatgaaaaaaaaaagaaaaatcaggagtaccaaaataaccaggaaatggtgattacatcattgaactccctcgcttgttgtagcatattcaagccagtcgtgccatccagaaccagcaagatctcctgttaagcaaggaatatatgctagtagttaataacaatgagagcgctatgaagtattagaatcataaccgtgcttctctaagcttgccctcaaaagtactgcacatgccaaaatgatccaatcaacacaaaatcaagtcctttgcatgtaaacacagcatacattaggagcacccgaaagggctttagctatgactttcttgcaggaaaccaattcttccatcagaccataatttgtatgaagtcctgaaaaataagtgctgaaacaaagtcatttcaaccaatcagcaaatcaccaaacatatgcatattctgctctcagtcactaaaataatcatacgtcctgacgtgtcgcaaagaacaagatcaaatccttcacgcttcccgcgcttcactgcctgcgagagaactaccaagcaagtcaaattagatgaaacatagaagctaacctccttatgagaacagagtgtgatcacaatgcttggcagatcaaaaaatcatacctgatgcaggttttgctttcttatcattatcgataacaatctctgaacctgttctctctgcccaaacttctagctggtcacgagctgctgctctgaaggtatcacctgctgccatcaatacctatattattgttgaaagcatgaacatgaactcattattttgatctattgtacaatattacatgttcagagaatgtggtgaggcaatatgtacatagctgaatttaattcccatgcatctagcctataaaccagggtatgtctagaaaatagcctcaccttcactccttcattcttgaatctgtaagcaagttttcctacaaatacataaaaaaggagtaagatcaatcttccacttcaaagcatcatgctgtataaaacgttccaaactaaatagtgatgccagatgcagatggtagaaaatgcccgaaccagaactgcatattgaggagctccttactatctaggtaccatattagctttaaagcgacaagataacctgcagaagcttaatccaatgctatgccacaatccaagcttaatatgcaagtagttttgcattgagctgaaaataccttacataggcgtgataaattcacttcgagtaactagtacattggtgtataagagataatcttgtgatggcctaattacagtattgtgcttttataaccaaatatcttttccttcacaaatgcacttgcgtgcctatataaccatgtgttgtgcctttagaacatcatcataatgtcaattgtccatatagtagggtactagggtaggaccataggagagtgtgttaccgtttattgaccatctatcagaatggaacaaaaacatctaagcttaacaaagccaagcatgcaagaggagtacctaatgaggtagtctttccacctccattcactcccacaatcatgataactgccggctttctgccataacgatgaacaacattgctcaaattacaaacagcaagcaacaaatggcactgagcaggaattcaggagaaagcagaacctgaaaccgagctgcagctccggattgccgcctttgctcgtcagcagttcaagaatacaccttttcagcgcttcctgcacaatcaaccaccacagatgacaaaatgaatcatcagaccaatcacaatgccgatgtcaatgtacactaagaggaaactgaaatgacctttatctcagccccagacttgagcttgccatcgcggatttcctcgcgtagagtgtccacgatccggaacgaaatcttggggccaaaatccgacaccagcagagcctgcgtgcacgagaccaagcaggaaacattcaaaaaaaacgaagacagaagcagcgccgaacagtgaagaaggagagaacagcatgcagagcagtggagcaggggacgcgcctcctcgagctcgtcgaggacgcggtcggtgtcggcgaggttccagtaggtgaggagctcgtcgacgacggagaggctctcgcgggtcttggagaagccggagaagagcttctcgacgtcgctcttggccttctcctggatgaggcgtcccaggcgggtgaagaaccccgcctgccccgccgccgccgcgcaccgcaggagccccgcgcggccgcggcggcggtggccgtagggggagcagcgcgcggacgtctccgccggggagaggaaggggatgacgtgggagtgtgccgccattgtagggatgccaaggctccgctctgggtggatagcgcttcgctgccaaaacggcagccacgccgcgtttactgtccggtggctacttcataggccgaaacattgagcccatgggctcaaggcccatgtaaagcccacttgtctctgaaggactatccttcacgctgcggcccatgaggcccacgatttctccttgcgtagcccatttgtctaagaacgactatccttcacgctgcggcccatgaggcccacgatctctccttgccggggcgagacgctgactgctacttccgggctgggcatttgctgccgcggtggctgctgctttcccgtgtgcgcagcggcgcggtaatggatttttcgtttcgttcttggcgtgcggatgcgacgcgccgtggcgtgctcgatcaccattgttagccgacacccaatcgccagtggttgccagagctaagctcctcgaaaaattgttaacaatgacaaacgaatctagggcctgagagcaagtttaaggacagtcacaacccagaa

SEQ ID NO: 62174 - DNA, 2515 bp, Oryza sativa
cggcgccaccaccaccgccgtgacgtccccctcgtgcccctccagctccgacacctgcaaacacactcccccatcggtaaccaaaaaaaaaaaaccacagcgagccacaaaatctctctctctctccatggcgcgtaccagcatgccggtggaggcgctgaagacggagacggtgcggccggtgcaggcgaggaggagacgcccgtcggccgagaaggccggcggcgcggagacgtagctctggccgccggtgatcatggcggcggcggcgaggggtttgggagctagggttttgcggcggaggggagaatggtggcggcgaggcggcggcagaggcagcgtagggttttgggatttttggcaatggcagaggcgggttaacgggtagcgacccggtccgctttgtttgggctcttgatgggctccatgggccaggttgatgggctgtccttgtttaggttaaacgtgggccgggtcgaatttgtagtgatttaggcctggtttgataggtccaggttttagttcgagcttccgcagcccatctagatttctttggaattgaggcccgtctatgtgtttgcttaagattttaggaaaaagtacaccgaaagtccctcaacttgtcatcgggataaaaaacgtcctcgaaccgcaaaaccagatatgcggggtcccttaactatacaaaaccgttcacccgaggtccttcgatggttttgaccccggttttggcctacgtggcacgtgggacccacgtggtccccacatgtcagcgtgccacgtcatcaccatctctctctttcccttcgtcctctctctctcacttttcctctctctaggctggcgacaggcgacgtggtggtggcggcgacgcgggaacaggcctcccatcccgacagccaacgcctcgctcttcttcacctacgacgaggccacgcaccggctcacgccgccggcctcctctgtttgtgtttggtgagtggtgtttgatcggcgtcggtgtttggtggatgccgtgcaagccgagcggatgcgcgtggggctggaggaagcgcagcgacagcacgtccgggcgttggtggcggccgtggcgcgcgccacgacggggagggtgcgtgcggcggaggccaagctggatcgcgcacgctgccgcaacgcggagctagaggagaagctccgccagatgagcgcagaggggcaggcttggataggcgttgctaagagccacgaggccgtcgccgccggcctccgcgccacgctcgactagctcctctagtccccctgtgccgtcgccaccgcagcgggggaaggcgacgccgaggacgcgcagtcgtgctgcttcgagaccccaggcggcgccgccgccgccactgccgccgacgcggtgtccagggcgacgtcgtgcaaggcctaccgtgtcacggaggcgtctgtgccgctgctctcgttccgccgcctgtgcctgtgcggcgcctacgaggccgccgttgacgcttgccccgtctgcgccgccaccaagatcgcctccgtccatgtcctcctctcctgaagtcactcacatgtgccacaccagccactgcatggagtaggagatttcgatagcgcaacagctatggccagaccgaaaccgggcatccatcagccaactccgatgacaagcaagctaacaacaatcatcctgtcccaagttacatggaaattcatgctagggaagccatggttctgtcatcagtgatctccaggccatgcgagttttgtcggtggaaacaacagtgttcagtgcgatgaattaatggttgattgccgatctcatctgtcgcaggtaccattgcttcaaatatttggcagcccaggtcggcacgcacgccgccccgtctccccgtcggccgctgctcgtcagttgtcctccccatcggccgccgcctgtcccggcaccccttctccccgccgatccccgcctgtcgacgaagtcccggcgctgcttcccatccaccagccaccgcagctccgtgcctccgcttcgccggccgccgcgcgctcacacgccgcctccgccgttcgccgctcaacccccctcgctgcccggtcgtctgctccctacccgtcggccggcctgagaagagtgcgagagagagagagaggggaggaagggagagaagaagaggggaatggacgtggcacgctgacatgtggagcccacgtgggtcccacgcgccacgtaggctaaaactggggtcaaaaccactcaaggaccttgggtgactggttttgtatagttaagggaccttgcatatctggttttgcggtttgaggacattttttatcccggtgacaagttgagggaccttcggtgtactttttccaagattttagcccaaatccccgggttgaggaaaccatgatcaggctctcaccagccatagctaaatttaaattttagaaataattagaggtcttttttttataaaaaacacacagtacaaatgtagacacccacaacatacgcacactcact

SEQ ID NO: 62175 - DNA, 5843 bp, Oryza sativa
  unsure (1)..(5843): unsure at all n locations
ctccgcgtcgatctttactcccgggtggtttaccaaccgggactataaatagatctttaggcgtatggcgatcttttttcccggttgatgttatcaaccgggactacaaatagatctttagtcctggttggtaacaccaaccggtactaaagattgaaaagtatcatgtagcttttaaaccgggactaaagatatttttagtcccggtttttaatacaaccgggactattgtaaaatctggtcgaccgaccaaagatggtttcttcaccagtgtagcaacaccatcttttatgtaaaattaactgtaccgtacagatcaaccaaccaagaagcataatatatacaaacttgatcctacaagatcaaattcctatcaattcaaggacctacaggatcaaagcatatcggtataatctaatcttgctacacaggcctcaaattaatttgttcagtttcagaggtgcttggtttgaagcctaatcttggtctagtgtttaaaacttatgaagataaagattaaattggcgtacgacgtacgtaaaacgcgaaagatattaacacatgattagttaagttttaagtattacaaacttgacgaatggatatattagatattttaaaacaacttctatataacaagttttcgcacgaaaatgtaagtttgaaaaacgtgctaacgaaaaccgaggtaaaatctatatcttcatccgaaaagaacatgattcagccgcacttatggccttatcggttctgacaaattagtgtacaagagtacttatacttcactatataaaaaaaaactacatagaaatatgtcttttttactgtacagatggtgtacataagaaaatccacttatgcctgcagtgcgggctgtgcggcccacagttagtattgcacgcctcatttctattctagagacggttatgcgaacatctagaaattgatttttagatatagttgtcttaagcgattgtctttaaaagtagattttcatatgtggtcgtctaagttgtccgtatgatttagaaatgtcactactcgtatgtgcccccaccccccctccctttttttccatattacgaaggtggtattttttaacctggagttcttttgtgccagtacttattaattaattaatacttcgtaaaaaaacaattgaatagtccttacatgtctaaagggtttttttttgcataaaacctatggcttttccacgttttcaaaccgtgtgtacatgccacatgtgcaacgattactctagattgctgtcttttctaacatattaatctctatggtctaaatatcaataaataattgtgaatctaacacgtgatattacatgtaagcaaaagattaaaatgtgaagtaccatatcaatgctgaatatggtccagagagaggacggacgaatcaacggtgtatgttgtaccaccaattattatatcaagatttgtgcaggactggatgatggttgtttagacattgcaatcttataaaagctaggtcatgtcctcatgtgcagttgtcggcctatacataactactccctccgtttcaaaaagaatctaacatattctaggacaacaaatttggacaaaaacttattcagatttgttgtcttggatgctgactccaaccaatcaaccaccgccacttgtggcactgacaagcaggcctgcctgttggctagataagacaaactttgtgtctctgtttggtacagctttagatcacaaatccatggtagatttgtattttgtatgttaaataataatggtttaaaattttaaattatatataaaatatgaaaaaaatgattaatcaaaatgttatcaatgtaatctagatccgctgattttgtacccagcttcaaaaaatttttgatccagagttgtgccaaaaaggatttgtatatatatgtttatgatctttttttttgttctgattaattcctcctcctttttcatacatggtccatagcttgcatcctgtactaattaagtactaacagcctaacaggtaggcacaggcaggtccgaatataatgctgaagtgagaccctgaaaaccatgaaagctctccttgctaatcttgtccctgttgtttgttaatttagttgaaagtctatgatggttgcattagaggagattaattagttggaacttggaacagctctttcaagaaaattctttgccctcaattaatccacttgctatcatgagccaatgctctttgcatacaattgatcgagattggttcgagtttgcaatatcacgctgttacctcacagttatcatagttaccccctcagtaactaccttagtttttaaccttatagcttttatggtaaccacatggatactagggtaaccacgataccgtcaggtagaggtaaccatcactaaaatggtaagggaaaccatggggtgggctacgcttgcaatgctcaatttctgacgaaagactttttttttctctacgaaacacagtacaagaaattcacgtatatatacgctacacactcacacctatgaatacgtataggtacgcaacaaaccacatttataaaagccaaacttttgctatgtgtatctctattgtaggtgaagatcattagatcaagaccagagttatatatgttccatcatcctaaaacgtacttccaaaagctctaatcatgagcactactcaagaccaaagtggatcatgcatgtaacaaatgaaataagataagagtcactggcaaacaaaaatgtggcatatatgcctctgggccccaatcaagcaaataggccaacctggtgccctaattaagctagcttgcaaaaattcaatggacaggtagatcgatcagtgtgtgactacctatagctatatagctttagctagctagcgtcctcacttgtctacaacgacgtgccacccacttctcctcctcactaacacacatccacttatatatacacacatttgtaatttgtatctatatatatttgcaatgcttaagcttgaaacctagcttgaagctagcttaatttgctagccattatagcctctcatcgatatatataccccaatgcatatgtaattaagcttgaatcctatttttcttccttgtttgggttttgtgtttgtgacttgggtcgaattagtttgagagaatttggagggtttttggttttgattttgattttgattttgatttagtttttgagttacatgaacaggttcagaaatgtgttgctacgaaagtgcaagagcctgtcacgctctctctcgaggtcgagctcctacaggaacctccgatccatgtccacccgggagcacgtcgtcgccggcggcgatggcggcattgtcggcggcggcgacagcaaggcggtgtcgccggcggcgacggggcggtggtgttcgtcgggagctcgcggcggcgctacgtgatcagcaacaagcacctcagccacccgctgatcgccgcgctcatcgacgacgacgtcccggcggcggccgccggagacggaaaagaaagcggcggcngcngtggggtggtttaaaagaggaggtcnacttcngcagcgacgacgacgtcgtcgttgaccaagccgatcgccgtcaactgcgaggtcgtgctgttcgaccacctactgtggatgctggacnacgccgtcgacctccgcgcgggcggcgacgtcgtcgacgacgacgccgccatgagagagctcgcccagctctacgcctactagctgctgctgctgctgctgctgatcatggagagagatcagcttaatcaacaccatcaatgttagttaagtactcgatcggtacatgcgtgcatgcatgttgttagtaattgttttgattagttcttaaaattaactgccttgattgatttcatttttaattttgatgttcatttggttcttgcgcgagatctaaaagattattcggcgcgatgaagaagatgatttgatgcatgtacatgcaaaatgtatggaacatggtgtagttattatggtttatgatgtttttcacaaaagaagaacagatgaatgaatttatggatagagttgtttgttatggttttaatctggtctggttaattatgctcttgatgatatgaataagtatagttggccatgcatcatcatcatcatcatgcatgcatgcagcttaattaaggtggttgttgatatgatgatgctggagttaatgtaggtacattagtaggtgctaatttgatgaatgatgcattcttgtgtaccacaagctagctcaataaatttggttgccttcactttgtgcaattagttgacttgtgatcaaagtgaagatgcaatttgtgcatgcaatttgatgagtgcttgttagcttgctgcaagttgctgtctatacagctcatacttatatactacactagcaaattgcccattgtttactatgggtaaaagaaaatatataatgctttatcgtagataaaatatatttttatgaaatatgctattattattattatttacttattttagcttgtgttattcatttgatttaaataaatattaaactattgcatatactattataaaatattaaggagtaatttgtaagactgcaaaattagtggtttcgacggcgtattgtattttatagtagtatagatatgagcagaaatttgtcgaccggaaatgatatttggtactcactttaaaatcagtatacatttattaccttttctaacattatctaaaaatgcctttccaaacatgtatttcgggaagaaaataattattgggggaaaaaggagccctggagtcttgagacagattagacgttaacatctgaaattcaagtaaaaaaataatatctgaaattaaaaatggaggcagtgctagcaaggtttagaagcgaatttgaagttaaaaaaaggcaaaaagaaaaaattaaagagagcgcaatcaagtagttagcaaaggcaatcagatacagctagcagaagtaattaacacagctaacatttgtatcagacagcaagcaggcacagaacagctgaactgaacagatataacggcagttcagagcagacaggccaccaaatacagcacacccgttagttccaacccaattttagctcaacagtccacatctcataatatatgcacaaaatctagcttttgattatcttggattttatgctcttctaaaaaaaatacttcttcaatttcaaattataagtagttttgatttttatcaaagacaaactatttcaagtttagctaaattaatagataaatataataatatttataatattaaattagttttgttaaatctataattaaatatattttcataacatatttgtcttgcattgaaaatgttactgttttttctacaaacttagttaaacttgaagcaaatttgactttgactgaagttaaaatgacttataatttgaaacgaataaactacaaagatagaatgcttcattgtcagtttgatatcatgatgagttcaggtttgaacgtgtgtttgaatcttaacaatcaataatataatctcgaaagcagcaacattatcatcttaaatggagtacataatactacaaacattggagccattagctgtatgtttcccttttgtctagaacaaaacacatttgagttttataagagacatcatgcgcatctgcaaaattttaaagctgtactagctgtcagtcacctgaaattcccatgtatatatatctgttccattcttaaagaagaaatattcaagtaagtattatatgtagctttgaagttactacatgtaattcagtttggtccagattgtttttggcagctgga

SEQ ID NO: 62176 - DNA, 1235 bp, Oryza sativa
gtcagtcacctgaaattcccatgtatatatatctgttccattcttaaagaagaaatattcaagtaagtattatatgtagctttgaagttactacatgtaattcagtttggtccagattgtttttggcagctggaaatcaatgtgccaatttggacagcctgcaaaggattgggcagagtgaagaataggtccatatggaatggacgcataattttgcgcccaaaggcctgtccccttgtaaattttgctgaatttttgcaggaagcatggatgcttgtttgcgaattgagattcatgtaggagttgggctattcacctgttcaaactcggagattagaaacttggagcaaattttactttgccatggagttcatgaaaaagccggtgtttgctttgacaatataccttcactttccaagctgattcggcgcctaggattcaaaattgaggatttatcctctagtgccaatgacatataaggtcagaaggctataaatgcttaatttctatctaaaaggagtgcatctgatcaaattttaccatgaagctcggcacaaaatctcaattgaactagaggactttgtatgcatatgacagatttaggctgatttcaaacctcgtgttttcaacatttctatatggcacagaaaataaaatagagtggctcattaacaggtgattaattaaatatcagttgtaaaaaaacttaaaaataaattaatatgatattttaaagtaatttttctatagatattttttacaaatataccgtgtagcagtttggaaaacatgtgcgcggaaaacgggaggcaaaagttaggaaaatggagtagagaactttggaactttgggggtggttagatatagggatataaagttttggcgtgtcacatcgatattatatagggtgttgcacgaggtgtttgggcactaataaaaaaattaattatataatccgccaataaacctcaagaagaatttattaagtctaattaatctatcattagcaaatgtttaatgtagcactacattgtcaattaggcttaaaagattcctcttataaattagtcataatttgtacaattagttattttttagtctatatttaatacttcattcggtgttcaaacgtttgatgtgacatggtaaaaaattttaggtgataactaaacagcgcctttgcaaagaagaaggggaaaagtacgtaaacgaaaagagagagaaaaaacgagaga

SEQ ID NO: 62177 - DNA, 33853 bp, Oryza sativa
aatcgacaacaccaacattgccaacaaaaaaatcagttagaaaaatagaagccacaccgaatttaccaaaataattttgttagtctttttcaggaatttatgcaccgaaattctcggggtgtttcaatctggtagtctttcttttttaggacaaattactgtatagaaccacatgcaccacacaaggcacacatcaattcatatcaacagacccctactacgagaaccataagccttgggaatttaaatgggatccttgaggcattttggccagggatgcagcaaactcaagttgcttctcctcaggccttgaacctcacctcttcataacctcaatgtcctgaggcacggggatgcgaaacatgagggattggggctggtctggtggagtggaatactggacgcctagtctaataaccttggtttggtgggatggaggaacagactggagactactgaggacccagtgagtgccgataagattttcagttgattcccgtcagtatttggattttgctaagaaatgtccaatctcgcattaatagctcatggcaactgaaaaatgaaggaaatagtataactcacttggtccggaatattaggattagcaccagcatctaataggcatttcatgatgccagaaaaaccataatttgctgccatcataacataagtagcaccattggagtctctaaagttcacatcagccccagcctgtataaatgaattattatttgatcagttcagtttgtgtttcagatgctatccagagaaaatgtccatggaatgaaaatggagcttccaaatacaactataagaatatccgtatcaagaaaggggcactgacttggatgagcagtttgacgcattccaatgatttagaagatatagccatattcaatggggtatcatcaagattgaaaaccttatcaggctgttggaagtaaaatgatggaaataaggatcaatagagaactatcaatcatatgcatgcttgcaaagaaattagacagcatttacataaattctgagcaaataggcatctttatttcattcaaaccagttataatcaagtgttgatatagatggaccacatgtaccaaaggcaaaaacatataagttttctgttatacacctaagaaaggaacaaataaaatgaagaaaatattacatctgcatgatggtccaataatatcttcatggtgctacattgaccatgagcagcagccgtatgcaacggggtcccatagagagaatcaaaaacaataccaattcctcttgacagcagcaattctactatttcacagtgtcctggaagagaacatttgttaaataaaaaaaaaactaaattgcaacaaaatgtttatagtatctgcagaagcatatgatgcagacctaagaaatgtcacatttgattcaaatcaattcccctgtattcaaggaaaatattcaaaatagactcaggatcagggttcagtttaccaaccataaaccacttggtaaccagtaaatagggattacatttttaaaatggctggttggttatttgagttctttgtaattgttataggcatgagagacatccgtcatgttaggagcacatatgtctatacaacactaggaaaaaatatatccccactgcctgaaaaaaggggttggtgtttggtgctcgacagtcccctaccctttaccataaaagatgttttctggattgtataatgtgtgagttgatttttaaatcattggcaaaggattgagttattggcacatcagtatgtgccattggagatctgcataacttcattaagttatgacaccagattgtaacataactttattgtacttatttcacttccccatctcttttaagttgtaatctcgtccggtcttgggcttttgtctccgtagtgctacctctttagaagtacatataaactaagttgggtcatctcgaccttccattgagttctcaggacaaaaaaagaaagatagcattctccagtttcatttggctgctgctcaactaattatgtctttaacgctagaattgacagcctgcagcatttattatgttcaaatacttgctcaaattttgactgaaacggtgcaaattctggagccttgctgaggattttcagtttcgaaatgttttttgccgagcacgcgcaagcgcaccgggggggggggggggtgtcggtctgaaattcacgaaattattagaaaatttcctagtgttgacaaatttttgtgatttactagaataagtaccgaatttttttggccggaattattagaaaatttgacaaaatttgaatgaatttgaataaattgaccaaattcacaaaaaaattgcaaaatgccgaaaatttcaggcaagatatgtgcttgcggctggggggggacgaaatttcagaaataaattgcaatccctggccctgctcaggaaaactaatagagtagataatagaacaaattaaccgatggttaatctaaagtgacaaagtatttacacatatatatcaaacatatttttcaaaacatgcgtagtgtgagagagatacctttcccggcagccgcatgaagaggtgatcctgatttaccaacaatcattggatcagcaccatgatcaagcagatatcttgtagatgcagttctcccaaaaaacgcagaaaggaatagtggagtttcacctgataagaaaaggtagtgaatattaagagcttagggaactcatatggtcatataccattcttgccttcaacaatgcaaactacaaaggctcctgctccacaaggtaaaatatatctgcagttattgctgttaaaacaacaaaaatgtggatttatcttcagtgatcctaatgtaataccactgatttgaaaagaactaaagtgtccaactagtaatgcagaaattttgtgcaataaaatacgggaaaaaaaacatttatatgccaatgacattggccataattaatgatattgcaccccgtttggcacccatgaatttgctctagaatcatggaattggaattcaattcctatgacatgggagtttcgaggacagcaagaatcagattggaaattccagttcaattcttagtcagaatataataatagaaaccatcgccgctgcccaagagtcagttcctttggtaattgtttggtgggacctttctttcttgataaaatcattctgctaaattaaatatcgtctcgtctttaatagtataaaagcacagtggattggtgtgtgatctcatattaaaatatggatttgatgcacatagaaaatgaacatgacccctttttgaaaaagcacaacccgatagaatgcattggtattattgtttggaatcaaattcaaattccattaggatatatataaatttgggtccagctctagatataaacacaatgggggaggcactggtatagttgatatagtaataatcatttgatattccgcagcaattcaagctagaacctgaagtataaatttaaaatgcatacattgcattgcacagcatcaaaagttgcacaagcgtgcaaataacaccacaagctcatatagtacgtaaccagcatgaaaccaactgtcgcaggtgaggaatattaaactatatggacacgcatatcgatctcttccgtttccccgggtaggagcatccaggataagtgaacgattcgtacattagagcgaatggaaggggatcagagatcagaacctctgtcgttggtttggttgacgtcgaggcggaggtcctcgacgaggtacgtgaggacgtccatcctcccctcggtggccgccaggtgcagcgcgcggctcccgctgccgccgtccgccacggccgccaggacgtccgcctcgccgcggccgcgccccgtcgtgaccagcccgcgcgccatctctacgcccagcgataagaagggggaagaaaataggaattaatgggggaaaccctaggagggagagagagggttgggtgggtactgactcctgaggaggcgaaggttgccgtcgaaggcggcctggaggagcatcttctcccaccgctgcttccccatccccttctcctccatggcgatcgatcgagcgggcggcgcggagaaggcgaaacgtccagactccagactccataccgaagtgaagtagtagtagcagcctgcagcctgcaagtagagaagacgagcggcctgagcgggggcgatcgcgttgattctgttgcgacggagatgacgccgctgaccccgggcccatccttccacgtcatacggtgctttcttttccttccttcgcccaaaatactagagcaagtttaagtttaatagtatagccaactactagctccagttcatctatagccaatctagtagctcattcatacaatagttacatactacactattaatatctggtcccacctatcatacacacagtgtcttaaagtccgtgctacagcttgctacaaatctatagcccgttgctcttctctcacctcatttatctccttaaaatatatttgcagctggcttatagcctgctattgtacctgctcttagctgtaagcacatgtgaaatagagaagagaagagagagaaggaaaactgcagcacggactccaatatattgtgtgtatgagagatgagaccaaatattaatggtgtaatatatgtttataggtaactcgttatggttacggagaaggtatatcttctatcctatgacttatagaatatacgaatatgatatacctttgcgtacacaggttgcttccatatacgctaaggtaattcaacaaatattatggaaagtatccttacgagtcgggagactaacaaagtcccactcggaggaggtaaggtgtcttctatatcgtacggggtccgatattttcaagttctacatggaaatgattcacggtgtaaaagggacacctcgggaggggtttcgggtatcgaatttcaccaccaacacatcgaccatagcctacaaagccggagcacgtgaagccaagtcaccagaaaatctcgtcgaatccatcgactacgatctcgtcggtacagccgaatttgcctactcctattgtattatgtggttttccatattaatcccatataaactggactagctattagctgataaggggcttgaaccaatataatccttgtattttttcttgcttgatgtcgtatcgtgtagatcctcgtaccaacgtaccctagtactctactcatctggtctacgggtatcacccattgacataactattgtatgaataagctattagattggctatagataaattggagccaatagttggctatactattaaactcgctcttagctgtccaaaattattactccatgctataaagtgtttaatcacatattaaatagcaatattttgggatgaatgcagtaggaagaaatagaatatatagccacggtaagttttgttctatacttgaacttttaaattattcaaacaagaccttaaacatgatatcatgtttgtacatatgtagtccttccatgtatcatagggaaaaaaacaagaggaaaaaagaaattaaaaaaaaccaagtgattttgcatattaaatatttttcaactatgtacatggcatttatttagcatattagttacatatttagtgttggtagctaatttaacttcgtatcggcatattttgctttttcgaatcatcgttgcacctatatttctatatctatacttctatactaatataaaaaggaggagttgtcccccctccaatcctacaggtgaaatcatccggattaatctgcaccgtccatccgcgccgaatacttcgctcctcctcctccagccacgaagacatcgctccacacgcgaagacttcgcttctcctcctcgctcgctcctcctcctccccgcatgttctgccgccgtgccgccgcatcctcgctagagatcctccccgcgtggactgccgccgctagagctgctgattcttccctgccgccggagccggtgcttcttccccgcgtggactgccgtcgcatccccgccgccggagccgctgcttcttccccgccgcagccagttccgacctcggccccatccgccacggccggagctgactttccgccgccaccggcgccgacgtcctcctcatctgctgctgtgccaatcccttcgccgatcccctccatccccatcatctcttgccgctcacctccttctactctaccacacaacccggtgctctctctattgtcgcttgttcctctctccccttggttaacactgaggagtactaactaattttgttttggatgttatagattttataccagaagtccaaaacaacatccatcggtatggagacgagttgtttcagggtgttgaattgcttgccaatcccccttcaattttctgtatgaaatatactcagatcttgtgtcggttcctcatgtcgattcctgtgtgattttctgttgcggagtatagcttcatcaagccaaatttaatgttttctaatttctcctgttttattattcttacgtgatattacttgtagcagctaaaatcaagatgatgtgacttgggtaggttttcagttgtgtttgtatgcaactaaaagttgccaggctacactactaggtaagctggcgtgatttatgtttttttttgcagtgtcatccttttgagaagtgcttctatgctccttgaaaaaaaacctgcacggaaattaaagcacatcaatggttcggattaaaaggtgattactagggtaaaccgtcattagcaaggggcaatttcgaccaggaagtgaaagcccacatgcagcccaggccgatcgatccatcgatctgggaggtcgacacggcaacagggctagatggtgaagatcaccagatcggccgggcatgtgcgaggaatgggagggcgacgagctgtgagggctattgtcgacttgttgtcgttgcgctcggcgttgagacagattatacagtatgacgagatataggaccagttctcgaagggcagtgtggtgtggaagcggcagaccagatggagaatggccgcatcctctacggcggcggccatccatgatgactcaaactcctgcatggtagaatacccgcttcttgtacctagtgaaacctagatagaaatcccaacgattctcctgttttttgattcagtgattttcgtcctttacaaaagctaatccttttggccgcttgacatagatgatgcagatattatctgaatatcattccaggtgcgtcgcgagggaattgccgttgcgaatcgatcgatgagagatggctgggtatggggtgggtatggatatgaacttttgcgtccgggacgaaattgcccctcgctgatgaggtttaccctgttaatcgctttttaatccagaccattgatgtgctttaatttttgtgcaggttttttttattgaggagcatagaaacacttctcttgtatgaatcatatcttaatttggtaacattaaaattctttctgagttatctcctaatttcataccattaaaaacaatgacttttcaagaatcaagttcactgccatgatacaccgaatatagccatgtgagggagctcttgccatcatattttcatgtgccatttgatgaccgtaaatttggttttccaagatgtgcagcaggtaacactgtcgatgcggctgcctttggtggtgttctctgttcaacctgaactacaggagtaatcggtctgctaacacagacctggtctcaaggtgccatgcaactcgctgattccacaagcttatgactgagtagcaggtaaacattttgtccatccattatctgcaaatccacctgtgcaactctttgcttcccaaatttgattgcatgtgttgcatatttttactgatgcagaatcgaatggttttaatgttgtatgtgcagacactgtggcaacaaatctatcccaagtttcctgcggttttatttcatttgcactctgatttaaatgaattacatatgcagatgtcaatctgatttacctttgtacatgattcaagattcaactacagcaattgaaaatgttcttccctatagatcagaaagaatgaatttttaatggtgaggtataacaaagattctagattatgcataattttcttaccacaaaactgaaatgatgtttgatataattcataaattattctaaaaatttgttttgtagatcggtaaaattcactcggaatcctgagtggtagaatgacatcattggtcttatctgaagcaaagtattcaattccctcttaatttgctataggaagccgtttgatactttgtttatgttggtctattggctcatttggaagggaacgtactgcaagaatctttgatcagaagagaagcacagcagcccaactatttgctgacatcaaggatggaatctccatttggaaggaagctggtatgttttaaaacatcagtgagttgtaccgtgttttagtttggagcaagtttgttccatggccctgttaggcttcgacaacacgttctgttgatataatttatacggaattgctaagcatctatcgacagaaaatgcatacccaaatcttgcaaattttaaatcaccggatgtgcttcgcgattcgtgctccatgtgcttcttctccaactccggtaacctcctcttcttctccggcgccggcgaattagggtcccggggtggggtggggtggaggtgggaggggaagaagggggaggtggccgggctcagagggatggccatgagaggtggcagcccggtagtgagcggcggattttaaatttaaaaataaaccatctcgatacttatttctaaacctgaaccttcttgcccactccgcctcgcctcgcttggctaaacaatagtcacaccatccgcacttgctcatggaaaaaatattcatattcaaaaataagttttgggaaggtttatttttaaaactaaaaatgaaaaggttcaaaaaaattaaaaaatatatatctgtgattggtcatatattacatttttatctgttggacttcatatttctaacgagcacggagcctttcagtatgattagatcaattccctgttatactaccttggagttgtatgcttgtgtcatgctcaaacagctcgactattcagcccatccaattttcaaatgatcttaacgactgattgtcgcagggtagagacatacaaagaacaaacaataattttgtttttaaaatagctcaaaagaatatttagtgaaattttaccagggtgaatatgttgggatcatgagttcccaatcacaaattccctcgccgcaccaagtgtgccccttttcaatcaccggttcttaaaaatatgtttgtgtgttttgggtgacattacaggaaaatgcaataatattttagtgtttttatatgtcgaaaacgtgcattgcacgtgcacgattactagtcttagtataatctaaacatagcaagctaagggacctaaacaagtgctattagctttaaataggtgagtttatgccactatgctgctaattatgctcgttcttgctataaacaaggctgcaaaatgtttttttcatgaaaaaatccatttgctattttatatgtcaaggattgacgtgttccttttgttcatgtttagaaatggaattctgaacattgcgtgctcataggaagggctgcatgtgctcagaaaaaaaaattgggagggaacctcttttttttatagagctaatgttcattaaacacctaaaactcaacatgcaaacataatatttagagagaatcccttatatgccactagaatttgaccagttcccttatatgccactcaaaattggcttcttccttatatgccactagtttaagtttttccacccttttatgccactcccactactatagtgttagttgactgttagttaaaggttagtttttttttcataaatgaccaatatgccctctcaactaaaaaacgtgtaaacttcaaaaaatcataactaatttattttaaatcctttttgagtgaacaaaattttatcagaaccagcgaaaaatgctctttatattaaaaatattgttggaaaactgcatgtttcatgcttatattgaaaatttatttgtgatggtaatggctaaaattgcatgtgatgtagaaaaaatcaattttcatatgttgtatccagtagctatattaatctttttacaatgaagttaacggtcaactgacggcaatggcataaaaaggaggagaaacttgaaccggtggtataaaagggagaagccaatttgaagtggcatataagggagccggttaatttagagtggcatataagagattctctctaatatttattagcactcctaaaatctacaagcatgtcacatcaacccattaatcacataaagttcaacatgcaaatatatagtaattgtctacaatttatttcattctaaaactgaacacatacatgctaaatcatcattctcaaatcattttcataatatttcaatccaaatcatttctttgtttttccaatatctaatatatatcccgcaacagagtgtggggcgatgagagtgcactgtaacaaccagtactctagaaccgcttcaatctattatcagaaaaacaaattatcaacatctagctaggacaccaaactagttccattaaatttaacattaaatatattttgatataatgttgtttgtattgaaaatgttattatattttggtcaaacctaaagaagtctgattaagaaaaaaatcaaacgacttataatatgatggagggagtaggtccctaaactatcaaaatgcagattgaagttctagaatttgtcgaagtatgttatttcgatcccaaattgccacagtccctctgagatcctacgggggactaacgtaacatgccacacgaagataaacatggcatcatggctcactgacaaatagagatccacttaaaaattttcctttttctttatttgttatttttattctctttttttccatttcttctccttctcactacagttgtaggccaccgcggaatgcggcactcatctcgacaacctcaagtcatcgccaacaagggaagggggtgacggtggcctagatgtggctagccgcatggctgaggagatgtgggaagggggagggcctcagcgatggcggcccaggcgtatctagcctgtgagggaggagatgcgggaaatgggagggcctcaaagaaggtggctcaggtgaagcatgctggcatggtagagaagatggggaaatagcgcagcaaggggaaggtgaggggtcatcaacctcaagcttctgactcctctttattgttgctgccttctgtagggcggggttcatctggcatagcctcaccaagcttgagttggtgggcatggaccgggcacaagcccctcgatttgaatggtcttggtccattgttccaagcccgatgtcgacaccttctactcagatccaacaacatgcggcagtgagctccctttcagcctctccatgtgagcaggcaagttctagctttgctttcatctctccgtgccgctgacatcgcccctagttgcctctggtcaagctcaccttggcagctgccctcgagctctcacagtctcatcgtagtttgtacatctgaatgaagaagaagaaaacggaaaggaaaagaagtaaaatatttttttatgaataggccccacttatcagtcagtgtagaattgctgaatatgccatgtcatgatgtcaatgtctatatggaatgccacgtaggatcccagagggaccgtggcaatttaataccggaatgacacaatttgataagttttctggacctaggtgtacattttgagagattagggatctatacgacacacccatataagttgaaggactgtccatgtacttctactcttttggtttgagtagaagatgattgtgtgctgccaatgacgtgaggagaagaggtcggttagataactctccttagagcatgtctagtagtgcccctaccccgttcttattgggattactagcaaaaaaccaactccaatctatactttctatatagttggtacccactaacaattattagaagctaaagctcaacatgcaagcatgccacatcatcacccactagcaattactattctagcccatttaaaatcccatgcaagcatgccacatcttcactcactagcaattactattctagcctttttttaaaaaaattatattctagcctattttaaatcccatgtaaacatgatacatcatcaacaagaatgtgtcaaatcatctttctcacattattttctcaacatttcaactttcatcatttcaacaatatttaacatatactcatccataaatcccgcagcaaagcgcggggtatcacctagcattttctcattttactgccaaaagtttggagttcccatccctttagttttcgctttgtgaggaacgtacaagcgggccttcctgatccgcttccaattgcgtgctcttgccgctcaagtcttgtacccgacaatcatgcaggaggaagaggaataaattgatttttatggttagtttcacatgaggccaacgttttctattttagggagtcaatttttggcaacctcttggagggatatttttttttttcacgcatcaaattatgtttagaatttgaaaaaaaccaaaattttagggatgagatttagccaatctcttggtgttgctcttaggtccattttgaaatagaggactggcaaaggaaggattcaattgcgaaagggcctatagtttactagttacaagagcctcagtaccatcataggtcctgggttcgactggtgacgtcgtgtcacgcctagaaattcacgaaccagaatttctaagctgaatgtgcattaaatccctgtccaggaccagccagggtacacaaacggcaattgttgacatacagatccacgtcttacaaaaatataaaagattacaaatgcagcggaaaagacaaaagcgagctaagcctgaagacttgactcctgcaatgaggtgactctattccacaggcatccttgacggcagtgacaaaaccaacttcttcgagacatctccaactgagaagaacttcaactctggggtgggggaaaagagagcaagactgagtactacccactgtactcagcaagtcataccggaagagaatgtatgatgcagggtataaccaaaggaggctagaggttcatttgcataaagctagcatttaaaagcagtagttgaaagcagtaaaacagttgtagcaattaatcaatattaaccaatcactgtccaatgctacaccaggttgcaacaggcccaaccaaccacctgaactataccagttcattaagctaaactaggggtgagactaatcacgatgaatctggtcgatcgcccataaccgcgggcacgactattcgaatagttttactctgatcagaggtgtacaactgtacccacaagacacagccccacgacacgttaccgtgcgccgacatgccaccacgacataccggaaagaggccgtgacaggatccttcgcataaccccctctaaccgatcgcaccacaccttagggttcgcccccgtcatcagcaggcaacgggcagcccccctttcatgccgcggtgaatccagaagccgatcaaccggacacctcggccgacccaactccatcacgcccaccctcgcctgggtacgtcggctagaggaaagctacactacactacaagcccagccgttgcccacgctggcttgtggtaagtacgataagttcttctagggcatcccgcgaaccgatccttaattgccatgggcacgactagcagaaccatgcacccacagcccaccatgtagtgtattttaattaactaacaccattgcagtggcactaatccaaagctatgccaataatcaaagtctatgcattaatgtgattccccttttgtgtactagttgaactaagcatggctaagcatttcctaagccaacatctaatcatttggatacccaagttatcaataacataaggtaaacaatatatggctgagtagttgggcccatcccacatgatattgtaaaacgatgcaacatttaatagaaatacaggacatttgtaaattgggtataatatgatcaatcgtaatgcatgacttgccttgctctcacactgatgagaccacagcaacgtcttcgagaaaccgcggatcgacgaagcggccgaaatctacgcgacaaacaaagcacacaaggaaaacatgctataagactactgaaacaggaaacaaaaccatttttaatggattctatgcatttttataaatttactgagacttgaatggacttaaacggagcttggatggattagatatgaattttagaagattatctgtgtttttactaataaagaaaagaccttaatagatttattgcgcaataaataaccccggatgacatcagcaaggggggcggcgccgacaagcgggccccgcatgtcagcggcacaagaggaggaggaggtggcctagcgggtgggtcccagcagacggtggctcaaaggggaggaggaaggcggcctggctcggctcggcttcaaggcggccggccggttatggtgagggcggctgcgcgagcgcgtcgtctgcgacgacaatcggcggcgagaggcggcggcgggcggtgcgaaaggcagcggcgaccggcgcgaagggcggcgacgcacggcgcagcccggcgctaggagggagaggaagggagaaaaagagggggagggaggcctcaccggggattcggccggcgtgggtgaagacgacggcggacggcggcggcaagcggcggatggcggggtgcgcggggtggacgaggcggctctcgacgtcgcgaggccgacgacgatgacggagtggctcgacgatggccctagcggcggctagcgacggatggaggcaacaatgggcggcggcgcgtggcttggcgtggggagagcggtgcgacggcggtaggggcaaccgagcggcggccgggatagctcccatgacggcgaagctagcagcggcgacggcgtggcgcagcggcggcggcgcatggccggaggcgtaggcaagcggcggtgctagtggcgagcggcgcgatggaggtaggaggcacgagagagcacggcgagtggggaaaaagagagagggggctcgggggaatgttttataggcgaagggggaggcggacgaggccgagaaggtggccgatttggccggcaacgtgggaggtggagagagagaggggggaggattcgaaatgaatcccatctccaagcgggtgtgtgcgcgtgcgggagtggtgggagagtgggcgggcgatagggacgcggagcacaggcggagtggggcacgggaggagcaggggaagcggcggcgtgggcggcggtttgcatagggcacggcggctggaggttaggggtgaacccgacaggtgggccccacctgtcggcgcccagggggagagggggaggaaggtagcacttcgggggaggggagaagtattgggccggcccggtaaggagggaggcacgggaggcgagttgggctggcggcccaaaagagaaaaagaaggaaaagaaaaaggaggaaaaagaaaaaggattttcctgggattatttattgtggtttaaagtttttaattggttaaaattatttattgagctctgaaaattccactaaaaatcctgttagcatattttgacatgtagaatccaagaaaaattccacatgccgattccaattattatttacatttattaatttagggattcatctctaggttaaattaaatcatttctttggacgatttattttatgaatttaaagcaaggtaggggaacttcagggcgtgacacgtcgtcaatctccagattgatttgctggcccaatcttcgaagctgctcataagggtagggtttgcgtgcgtgcgttcataggggtgagtgtgtgtgcgcgttgtgagtgtatgcgttgtaccgtgtaatttaaaaaaagaagaaggaaggattcaatttcctataggtccttttcaattcacagggggaagatctgttttttttataggattgtattcctatggtcaaacctcttggacagatatatagaaaaataagcacggcgttacgccttagttatattgtttatatagtgtaattaaatggcttctctttccatatctattttcacacatctagtactacgttaatttctatgttttttttctagagtgagtacgcaagtgcttcttaaactttgtgcagttgtatcatctgtgtcattaaactcttaaaatatatttttagatcccaaacttttttttggttgtcctacagctccaaacagactctaacccgattcatacattgacaaggcatgccaccgtggtgcatatgtgtagtgggacccacgtatcagtcatagggaaaaaataaaattaaaaacatattatctccttttttttaattttatcttttttatatgactgatatgtcattcccacttgcaggtcggccccaattgtgacattgtcacgtcagcatttagagtggattggtttccgtttggacctatataataatcaacataaatttggggatccgtaaatacatttcaagggtatagagaggtagatgacataaccacgtaagtttagtaaccgccagtggactttactttttttttctattcatatgtttttcttatatgcattttaaagcgccttaggctgagttcgttaggaacaaatctactggtgcacgggaaacggagtggtctattagcgcgtgattaattaagtattagctattttttaaaaaaaatggatcaatatgatttttaaagcaactttcgtatagaaactttttgcaacaaaatattccttttaatagtttaaaaagcatgcgcgcggaataaaagagagatgagttggaaaaacagagtgctgaacacagccttaaaatcgtgagaaactgcgcgtgtaaactgccaatattaaaaaatataatatatatcttatttaaaaaaactgtttgagtttagattattgtgcaaattggtgtgttttgcaagagcaagttcccaacactcccctctcgtttttcacgtgcacgcttttcaaactgctaaactgtgtatttttttttaaaaaaatagctaatacttaattgatcatacgttaataaaccgctccgttttccatgtatgggatggttcccaacaccaacctccaacttaaccatcgttaaaaagggagaaattgagtgttaaccttggttaaccatcatctatccagtatccacgacctaactatcgctgccttccccaccaactccgcagtctctacaaaactcactccgcatcgttcgtcttcttctcttccgcccctacgtcacctccagtcaagggctaatgcctagggcctaggcttctactagtagcgagtagcacactgcctgccgctaccgctctctcgccttctccacccccgagcgagcccgatcgatcctctctctctccatggaggaggagaaggggatgatggggaagcaagagaaggagaaggtgctcctccaggccgcctacgatggcaacctccgcctcctcaggagtgcgtatcctagccctttctcttaggcctcgttcggttcgagtgtaaaaggccgagatccccggccccttcggggaagcccaccacgcggggaaaaaatccctgtgctgacaaaaatcgcattcggttcggtccgggaaggtgggaatcccggcccattaccccccaaaccctagggatattgatccaccacccagaccggtggaaatccaccacgctccacccgagaggcgcaggcgccgtctctccccgtcgcgcgtcggtgcctcccgcgccgctctccttgtcccgtcgcgagccggcgcctcccaccgcatccaccggcgacggcgcctcccaccgcatcctcctgcgccgctgccttccaccgcatccgcccgcgtcgccgcctcctctcggctctcgctgtagacaccgccgccgcctcacatcggatctgccggagcagccacttgtagacgcatccgcggccgccactgacttccccggcgccgccttccttcctcccagtgcagacatcaggtgagccccttactcctctccctgtcgctgctcgtgtggatgaagaagcttatgttttgctgccatccctccatgcaagatccattggcaattacttctctgttcagtcacctctgtccggacaccgggtctttcccaacaagaacctcctcgaggagcatcttctgctacatcagctaggtatgtcaaacaccatccttcttctgaactccatcgacgattcaagatggcacatgcatgcttgtcaattatcagcattacagacaactagtagggtgcccgtgcgttgctacggggaattttgttgatcacgggggataaagccgtgaactccaggattccaacataatttaattagtgtttcagaactactcgctgactcaaatttaaggagcagcaacagtaatgctcaaactcgttacataaaatgacttgtacgttggcaacattaagagccataaactgcactgatcagaatgtaaccaattttatgaaagaaataacttcagtcttacagagaaactgcatagaggaataccacattacaaaatatcggtagggtttgccctccgtgccgcccgctcgtattctggccttcaaagtattcgtcatgatttggaggagacaatcattgaagtgaaaaaaaactaacttatttcaccagttctggaaatgttttattcagtttcctggtactatcaatgctaagagttgtttaccctggttatcactgatccagaaaaacatagtaccattaatcaactcaaaaggattgtgtgatattttactgaacaaatagaatgcgcttattacataattgatatttcaacctgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggccgaggcgccccgacccctcgtgggttttcgctccgcgtgtatgggttaggtgggcacagtggggctcacctaaccatatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagaagggaggtttttttttttggactggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggacccccacgctccgtcatctggcgcgccaggtaggggactctgcgagtgatcttctgagctctcgcactccttcgtgtgcgccaagcattttcctgttcagcccaatggccgagccagcaaaggcgcgcgacctctccccgagtatgagcggtgacgacggggagccaaacccacgccgttgagctcgtactccaccgccccctccacgccaaagtcctaggcgggaaaaggcgctcgagagggctgaaggatccgcgacttcgacatccacaggaggtggagaagggcggcgagatggggagcgtcgtctcctcgtctacggcgacggcagcacgccccagggcgcgctccaagctgcaggcgcgctcctacgtcacccgcccgtcgcccatgaaccggagtctccagcccaacgttggctggacgatgtggccaaattggtcatgactgcacggcagcgcctagatgctggtgggcggtcctccgccaccaaggcctctggagctgctaccaccggctccgcgtcgtcaagacggagggcacgacgagcggcagccgctgttcgccattcggccgccactcctttgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcggggaccagccctccgtgcccccggttggtggtgtcggctgtagagcctttgtggcgagccttcggaatgtccgttgccccccaaggttccggcccaccatcgccgaaaaatatgacgggagcgtcaaccccgccgagtttctctaggtctacacgaccgggatcgaggccgccgggggtgacgacagggtcatggcgaatttctttcccatggccctgaaaggacatgcacggggttggctaatgaacttgccacccgcgtctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaacaccataccatgcatccctgcacacgcggtgatttacgcgttcagggggggtgtgcggcacaaccgtatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgatgagggtcatgtcctcgccgtcgagggcgctccgcgggccacccgaaaggggaggcctggggagacaaaaagaaggaggccggcgctcccagcagggagcgcccgaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacagcgatgatgacctaggtttccaagagcctggggccatcgttgccactgtcgatgggggagcgtgtgctcacgtttctcgccggaacctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgccaacttccgcacggagcgggtgaactttgatgtgacggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcgttatacctgcgggcaagcttctcgggtacttggtctctgcccgaggcatcgaggccaaccccgagaatatacgagctatagagcggatgcgccccccagcaagcttagggatgtgcaatgcgtcaccggttgcatggccgccctaagtcggttcatatcgaggctgggagggaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccggacggtggcccaaggcccccgacgaccggagcaggccctctccccgcttgtcagacggtgccaggtgcccccgacccccaggacggccccgaggccactgcgggaaggccgcacctatcgccctctgaccccgaggctaaccctgtaccgattcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttgggtgaagagcgccccagggatgcagcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttacggtggttacgtcttaccccctcggccaaatcttgcataatcgagagggtactggacgggtggtgaaatgggcaatcgaactttctgagtttgatttgcactttgaaccacgcaacgctatcaagagccaagccctcgccgactttgtggcagaatggaccccggctcccgagctcgtctcggtccccgaagcaaactcgggcccctcgcagctgcctcacaccgcccactgggtgatgcagttcgacggctccctgtctcttcagggcgtcggtgcgggggtcacgttgacctctccgagtggagacgtcctcagatacttggtccgcctcgactttcgagtgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcaccattttgacgggattgagcttcggcacgtgcccagacgggataacatgatggccgacgaactctcacggctcgcgtcctcacgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaaggcattgtgcttcttgccaatatccatgaaggcgaatgcggagcccactccgcctcgcgcaccttggttggtaaagcttttcgccaaggtttctattggtcgacagctctcaatgatgcggtcgacctggtccggcgatgtagagcgtgtcaattccacgccaagcaaatccatcagccggcctaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatctggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgctaatgcggaaatcctcaaaggccttaaaaccaagaccttcaacatactcaagaagcatggcgattcatggatcgaggagttgccagcagtgctctgggcaaaccgaactacaccaagccaagcaaccggggaaacgcctttcttcctcgtctacggcgcggaagcagttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcaccaatgtaggagggtccgtatcgagtggtcggcgtcccccggccgggctccatacggctggccacgggcgacggcactgagctgcctaacccgtggaacattgaacaccttcgtcgcttctacccctgaggggggggtcgggtgtcaggtttcgggctcgggccaaccccgcaccccctcgggcgtgcaaggttggccgggggctgccacacatgcacattcttatttctttttttttcagtatttcaataaaagcagtttcaatttcctaaaggctgtgtctgtgctgttttttccttttgaagaatcttgacttgaaataggtcactcgtgctcaatcctgccctcgggggctcgggtcggctaaattcgccaaacggggcccagaaccgagccgtgccctggggcgtggtgaactccgggggggaatcggtaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgttgtctgcaccaccggcattgccctcctcgtcggagttgggggcgaacgcgagccgaggggccgagccctcgaagctgtcgacgatatggtcggcggcatcccggacttgcgcgcgcgcgcggtcctcggtcccgggagggaactcttccagcgccatccatggagagaaattggggtccctggtctggtaactcgccaggacgagctccaccgctccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccctgcagatcggcgatggtgtgttcggcagctgcgaggcgggcggctaagtcgctttcgcccgcggccgccccgccgctgcgcgccctcgcgtccagctccttcgcccgcgcctcgagctcagcggcccgttggttcagtgcggccctctcggcgcgggcaccttccagattacggcgcgcttgctcctcctgcgctgcctcgcggagggacaggctgtccgccagctgttgcgccgcggcctcggccccctcgagagctcgctcccgctcggtgagcgcgtcctcgcggaggcggagcgcgagctcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgctagcaccttcttacgggtttcaagctccgagatgtgccggcggtgagccttacagcccacctccaccatggcctccaccgagcgtcgcccctcttcgacacgcgcccaagcggcatcgagctccgcccgctctgcctgcagggcctccacctgggcacttaacccgtccaacaccgtggtgtttgcggcggccaaggcttgcagaaggggctctgcgctcagtagggcagcagaagggcgtggggaaaagccgcctcggagaagatgccacgcggctcggcccgccgatggacgtgccaaacgcggggatgtcctccggacctggttgggcctgagcgtcgcccgagggagtgggcccaagtgacgcgcccgcagcctcgtcgccagctaccccggaagttgtcgcctgagcgtcgcccgagggagtgggcccgagcgacgcgcccgcggcctcgtcgcgagctgcctcggaagtcgccatcgcctcgtcctagcgaaatccggcttcctcccgagcggcttcctcggccttgtgggctcggacagcctcctcccgagcggcttcctcggcctggtgggctcgggcggcctcctcccgagcagcttcctcggcctggcgggcccgggcggctccctcccgagcggtttcctcggcctggcgagcccgggcggcctcctagacggcctcctcggcttcccgtaggcgatccgcggcctctcgccggtcagattcccgcctccgggcctctgcggccgccggatcctcggcctcaggctggccggacttggaatggcgggagggacgcgacgggatctcgctgaaacaaaagaaaagaccagaagacgaacgagatgggtgagtgaaaactcgcgttgagagaatgaatacaaccacgatgggtgagagacgaacctgcgagggggtcggttaaacgaccactttagggggggggaaatgaggtttccccgagatggttctgtctcccccatcttgcggggccgcttcttcttgcgctccccctcgggctgcgatgttggcgcggccccctccgggcgcctgctgctggcacgcgccgccccgccccctcggggagatgggggaggtgttcctccctgcttcctcttcccccgggcgtcggcagggcggctgctccccgggcccctgtcgcgggacccagaagcacgaccccctctcggggtagattgttccccccggcggctcccgcctgcgccgtcgtggccctttggagctcgctcctctgaggccccgaccgccatcataatggtcaggatggaggcgcggtctggatcgctgcagagggggaggattccttggggaatgagggccgcctccacggagttgagattcagcacccgttggaccaatatcttgaagtcctcaggagcccagtcccatctcactccctggtgagtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagctatcccccagatctaccggcgcccgccagctggaggcctgagccgggggctggctcggaagtcggaggcgcacttcgtcggcaaggggggtgtagaaccagtcgctcttccagtcgtcccacttcttgcggagggcgcaggggatgtagcggttcggcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaagggagaaagaagacggaccgccccgggtagtctggcgccgggcgtccctcgcccagcgtgactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctcctcgcttctcgcgcccactatttcgccccctcgtttctcgcgcccacgcttccactaatcccattcgcccgcttgcggtgcatgaggtggatatgcggttgtggcggtcgagatagatcatatcgtgcgcgcgttaattacgctcgccgaccgaagcgacgttaccatatctccagatgaaacgaatcgccatgtccagattcgtgtgctactcgagtaatgtggcagtcttgaagagaccgctcattattgacaaccgagttaccattgccgatgtgcgtgatttttgaccgttgggtttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggtcgaggcgccccgacccctcgtgggttttcgctccgcgtgtatgggttaggtgggcacagtggggctcacctaaccacatttattgcggtttggctgagcgtgtcacgccgcatgtaacgcggtgcagtgtactcatttatccggtctgtgaccaatcacagaccggtcagatcgcgagttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatattgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtatgtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagaagggaggtttttttttttggactggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggagccccacgctccgtcacaaccaaatggaccgacaaattttactgaacaaatagaacgctcttgctcagtgcagcatgcattgtgctttggtttttgtatcaacatgctctgcaatgtcaccccattttgcttgcaaaattactaaagcttccaaaagaagcaaggtctcctggtcagtccagctagtaccaccaaagcctggaatttctgcagattccataatgatgaaatcagtttgtgacatgcctgcatccaaatttcctttgtcatagtctgcgtggaaaggtttaagagaaaacaatcagcattcagctaaataaatcatcagacctaagaactatgcttcagtacttttgttaggtaaaaaaattaaagaagaagaaaaaagaaccatatagaagtatcatcagctccatattgaccttaccatgaagctacctaagcaagaaaccaggtgggatcaggtgaagggatgtgaatcaaatggttttgcagttgatggttgttttccagagtcaggtaatagactaataatagagtgttgtaaatagatttgttgtcaatgtcagccaccaggttagataaagcagagttcaggcactggataacttgtccgctagcatcctgcatccaaactcgtagagttgtaggacacaacgacaatgcaaaaatcttcgatttttcatttcctagtataagtagcacataaaaaacctgcagttgatcacaatacctgtaatggtgtatataggccttgccaaaatcccaccgaaagtaatgtttactactgtccaagaaaaaaaacacacgaaatgtttgacttggaatataaaaattacagaaagaatggaatttaagcaagcatattgtggatggttaattagtcgcataatataccttttctaatctgtgaggacctctctatacacaatattttttgtgtatgttgcagcctgtttagacaattcctttcctttcttctcattgtccttcacgccagtacacttagactttttcttttgtttcttgtcttctaccggcatcgatagtatttttatgtttgttctagaggttgctctagacaacgcgacgtataattgaccatgagagaagacaggctccggtaagtagacgcctgcatttggaattgtttgactctgcgccttattgatggtcaatgcaaagctcaatctaaccggaaattgcttcctcttgaagcgaaacgggaacatatcatcatcagacggacatagaggtatacgaggaaggaaaactctgttcgcaactgctattgtgcatcgcagccatgggcaaaccgaagagactggcacctaaatacatctgttcgcaactgagcatgcaagctccaacctgtttggttctataatgactataagtggtactttcagattcagcatatgcagagacttataacagcaggctagtatcggtctgaaattcatttcctattgatccccaacgagcagaaaagagcaggctggtactttcagattcagcatatgcagagacttaaacgctacgacggtggctgcgagcggagaagggtagtcggcgatgaggggctcgaccccgtcgcaactcctcccgagcggcacgaagggcggagacggagcagcggcggcaggcgtagttcatatatgatatggctcagcgaggattaaaacctaagtgatttccctgaacatcacaactgtaacgtctaagcaagcattttgtcgaacaccttttgggcatggggagcattagcgtattacctgcagcttgcatttatttgca

SEQ ID NO: 62178 - DNA, 783 bp, Oryza sativa
  unsure (1)..(783): unsure at all n locations
cgatgtgcaatgcgcctacnagatggtacagtagttcatcaatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaaattggcatacgatttttgtaatgcatactctgtaaattatgagcctggcatccttgagcctattgggacgttatgatttagagaagcatcagccaacaagaaaaaaggtgtatcttt

SEQ ID NO: 62179 - DNA, 726 bp, Oryza sativa
  unsure (1)..(726): unsure at all n locations
ccgcaataaaataaatgataattacataattttattgaataaacaaaaaggtcaaacgtttattaaaaagtcaccaatattatacattaaagtacggagggagtaataattttgaccaaaatctattgaaatttgaagaaaaccatcgtaccaccgaggatcaggatctgacgctcaattgataaggtgaacttaaccctgcgctgcatacgtgcaagaggacacgggatgagctagccttgtgaaagaccgtgcgatgtcgagccttgtaccaggaggctactcgtagccacctactcctacctgggtttccgcggcgccgtcgtggcttagacgcaatccaccctgatccggtgacgagaccactccccatgcaccgcgccggccggccggcgccaccgtcgcggacgtacgtacgttacgccttgggggctgggcgtgtggtttgaacgcacccgcgacccccctggccggccaggcttacgcctacccgcgccaaaaaatcccccggatccgctcgccttccatcattcgaacgaaaaggcgtggccgcacgtacatgatcgcgcttgtaggcagcaccctcccctcacgagctgatactcaggcgcattaatgccctcaagctcataacatttagaacaggtaaccggatcaaaagcggcgctagaatggaccaaaaagtagtgtgatgnnctnctgcagcaagagtatcaaacacagtcg

SEQ ID NO: 62180 - DNA, 136236 bp, Oryza sativa
  unsure (1)..(136236): unsure at all n locations
tatctgttctggagcggccgcaattgtcattttactcccaactgttttctgtccatggtgctgcgtcacctcttttggcccaatgggctgtgtatccaagttgggcccattaggggcgcgtcctagggttggagcacgaccctatggtcgttcttcccctcttcttatacctctagtcgccgccaagaacattcgggttttgatgatagagatagctacttgctactggctcgtagcgcgcgtgttggctaaaccgcccgtctgcctgtaatcggaaccccaccatattgtgtttgatagtgaaactttcatttttatctagcaatttcagtgcttgttctacttgttcttgcttgttcttcgattgcttgcaggacgagtgccctcgtggccgggttgacgcgcaccacaagttcgcggcgaccattggagacggtgtatcggttgctaaggcgcagcgtctttggacggttgtagtcgggccctgaacgtcgtcttcatccaatcgagttatcccttacctctcatcgaaagatcgggccacaaaccctagcgggttcgcatcagaaagtatatctctcggcatggaaatcgagaggaaatctcggatggcggttttccacccgttgccaaaatctcggacgccgttttccatccgggattaacgcgattcaatttccataactacatgattacgcgcattgatcggtagcgctaaatccttccataatttggattgccctcgatctcccttagcgctatactaataggagaggccggtgtcgtggttaggtgacgatctctccacgaccttcttctccccgaaaatcccaaaaccctatccgatcaactaagcgctggagggagaacgtgtggtggttccgggacagtgtaggtggcgaccggaaggccgtcgctaccccgcaagtgatcgccggcaacccctttgggatcaagccggcgtacctactgctaccactacttcgtctacaccgacaaggacaaggaccgcatcaatggcttcaaacaacggtcagtaatctaagaattccgcattagggtgatcatgttaggcttatcactcatgtcagtagatcgcataatctacatttggtatcagagccactgctatagcctaatgatcccatcattccgtttagaagccataaaatgcatctaagccctcgttctcatgtcggttttgatgcaatcacattctggttcatgttgattaatcatgttttattcggattaagtttcgattaagcgctgctcaaggctcgccgccatggccccggctgcgcgcggaggagaaccggggacggtgggcaccggcacggcatcagaccgtgcggcatcagcctgccacacggggcgccgccggccgcagccctctccgctgcgcgttgtcaccgcgccgctccgccacctatcgcctgcgccgcccccttgtgcgcaccgccgcatcacgcgccgttgcggcgccgcctcgcgcgcgcgccgccgccgcaaaatcgccgccgccgccgccgcatattgacgagaaagaaggggatcggggaaatgaagtaaagtagggttagggttagaaccggcatgttttatgttttttttttctcaccgattcgagttaaatctaagctgtccattagatcggacagatcggatcgttcctgcatcgggctggcaccgttagcaggccgccaagccccttgggccgccgcaatggaccgcgccacactacacgtgcattatgggccgcacatgttctttaagcaggccgacttattaatgggctgcgctattagattttagcctttttcacttatttatttttagaaattgcattagtaccatttatatcgcttaaaattgctgaaaaattatgaaaaattttatggaggcttattaatttaattctagctaaatggaaccaacgagaaatttggctagatatttgtttttcatgatgtgaatttattttctgaccaacgttgattataaattcacataaatttattcataattatgtttcccaaaattatttctgcccaacggtgatgtaattaggggaatttatttctgtttaattatgtaactaattgagccaacacaaattaattgcatatatgtacttatgtatatttttttcttcatgatttttcagcttttggtcagatccgactcattaagcctcttgatgggtcaaattatgctaagtggaaggctgacgtgttactcaacttaggcatactcgattatgattatgccatcagagaggaccgtcctgaggagccttttagtgttgagcacgattatgaggagaaactgaacttatatcatgagaaaactaatgaatgggagaagtccaataggatttctctcatgtacatcaagagtgccatatcaaatgtcattattggtggtattgtggactctgatgatgttaagacttacttagaaaatattgataggaacttcaggagttcttctaagtcttacgctagctctataattaagcgtctaatgtccatgtgctataattataaagatggtgtgagaaagcacattatgcagatgggtgctatgaatggagagcttaagagtatggacatgggaattaatgatgatcttctagtccattttatcttgagttcacttccttctgattttgagtctttcatcattaactagaataatcagagggataagtggtccattgaagaaatcatttctcattctgttgaggaggaggatcgtcagaaggctgacaaacagaagcataaggatcagctgaacctccttcatggtgctaagggcggtaagaaaaagttctatcgaggggagtccagcaactcccaaaacaagaagaagaagcccaacactccttccactcaggcttctaatggtgcccataagggcaaagctcaggttctagcaggtcagaactctgctggtaagttcctttgcaagttttgcaaggcagaaggtcatgcacagacagactgtgaaggctttcgggcttggcttgctaagaaaggtactaatgttgatattgtctctaatgttgatgaattactttacgttgaattttctcataaatcatggtggattgactcaggtgccactgtgcacgttgcgaactcattacagggattccgttccgtgaggacgctaagaaagggggagtggatcctaagagtggctgatggagctgaaattaaagtgatggccattggggagcttcatcatcgacttccaagtggtaataatcttttacttcatgatgttctttatgctccctctgttaagaggaagcttatttctgtaatggttttaacaaacagtggttatgattgtaatttttctaaggacaaatgctttattaagtataataatattgatattggtcttgttagcgtgcaagacaagctctatttgctctctttggatgatcatattatgaatatattgaatgcctgtaatgataatgagacgtcttcgaaattgtggcactgtcgtttaggccacatttctaagtggagaatggagcgtctcattaaggaagagatacttcaacccttagatttttcgaatgcggatcattgcttagattgtattaagggaaaattcactaagaaaattaagaaaggaactactaggagcacgtgtccattagaaataatccacacggatatatgtggactgttcctagtaacatatgttgatggatatgattcattaattaccttcacagatgatttctcccgttatggatatgttttccccattaaagatagatctaaatcactcgataagtttaaaatattcaaagctgaggttgaaaatcagcatgatgcaaaaattaaggtagtgagatcagattgaggaggagaatattatgggagacatactccttatgggcaaagtcctggtccatttgcccaataacttcagatacatggaataattgcccaatattccatgcctggagaaccacaacaaaatggagtggctgagcgtcgcaaccgtacacttatggacatggtatggagtatgcttagtcattctactttgtgtgtgaatttatggatagaggcacttaaaacagctgcacacatactcagtcgagttccaagtaagtcggtacccaaaacaccttatgaattatggactggaagaaaaccgacattcaattatttgcatgtgtggggctatcatgctgaggcaagaatatttaatccacaactaaagaaattagatcccaagactgtatgctgccattttatcggataccctgagacatctaaagggtaccgattttattgcccagaccgtgtctctaaatttgtggaaactagacatgtcgtattcttagaaaataatgaagtctggggagctcacaggaaagggaaattaatcttgaggaaattcgggctaacgttacaccggaaatccaagagaataatattccaataaatttggtacctcgtgttgtacctgtgactcagaccgtagtagcaccagatgaaaattctggtgataccgactatgttgaaaataataatgaattaaataatgacactcaacagacttctggggcacaaaatgaagaaattctcgaagaaccttctcaaccgctagtgatcgaaagtgaaccacttacaatattacaacgggagaggagatctgccattctaaattattatgaggtttatttaggtgaagatattgggaatgtagatgatcccacctcatttaaagaagcaataatgagtgaacatttatccaaatggcttgaagccatgaaagatgaattaaaatctatgagtcataatggagtctgggacttagtagaaattcctaaaggagccaaaacagcaggctgtaagtgggtctacaaaactaagcttgactccaaagggaaaatcaaaaggttcaaggcaaggcttgtagcaaagggtttttcacaaagagaggaaatagattacaatgaaattttttctcccgtctctaagaaagactcatttagaattgtcatggcgcttgttgctcattatgatttagagctccatcagatggatgtaaagactgcatttcttaatggtgacttgcatgaggatgtatacatggcacaacccgagggttttgttatggaaggcaaggaccatttggcttgcaaacttaagaaatctatctatggacttaaacaagcgtcaaggcaatggtaccttaaattcgatgaaataattaagagatttggatttaaggagaatgaggtggataattgaatttacattaagactaagggtgtaaaatttataatactagtactctatgtggatgacatactgttagcaagcagtgacattactatgttgcatcagactaaagaatttttgtcatctaattttgatatgaaggatctcggtgaggcatcttatgttttaggcattgaaatacaccgagataggtctaaaggagtactgggattatctcagaaatcatacattaacagagtactagaaagatataatatgagtaagtgctctgcaacacctgctccaatagttaagggcgataaattcggatatttcaaagctcgaaaaataaattagaatcagatcaaatgaaaatggtaccatacgcttcagctgtcggaagcctaatgtatgctcaagtctatacgcgtccagacttagcatttgttatcgggatgcttggcagattttagtccaatcctggtttagaccactggaagtttgttaaaaaggtcttgcgttatttgcaaggcactaaggattacatgctcacatataataaatctgaagaacttgaagtcctaggttattcagacgcagactttgcgggatgtgtagacactaagaaatctacatcaggatatctcttcactcttgcaaagggagcaatttcatggaaaaggtctaaacaaactttgactgcatcgtcgataatgcatgctgaatttgtggcatgttatgaagcaacggggcaggccatatggcttaagaattttatcccgggtttaagagtggtcgacagcatttctagaccaattacattatactgcgataataaagctgcagtattctattcaagtaacaacaagtcgagtggtgctgccaaacacatcgacattaagtatcatgttgtgaaagatagaatccaggatcaaaccattaagattgagcatattagcactaagtcaatgctcgcggatccactcaccaaaggcttacctcccaatttatttaaaaatcatgtagccggcatgggaataactgattgcctttgattaagactaagatcctggaaataggggcattagtcctaactaattcccattaagatatagtgaactatatagtgaactataggtaccggagtcttggtaggatatgataactaccctgacgcgttgccttagtaaatctatttttctaagaataaactcatttgcctcaagatcggggggagaatgttaggaaagaatatctcttggcatggaaatcgagaagaaatctcggacggcggttttccacccgttgccaaaatctcagacgccattttccaaccgggattaacgcaattcaatttccataactacgtgattacacgcattgatcggtagcgccaaatccttccataatttggattgcccccgatctccctcagcgctatactaataggggaggctggtttcgtggttaggtgacgatctctccacgaccttcttctcctcgaaaatcccaaaaccctatccgatcaactgagcgttggagggagaacgtgtggtggttctgggatagtgtaggtggcgaccggaaggccgtcgctacccctcaagtgatcgccggtgaccaattcaggatcaagccggcgttcctactgctaccactacttcgtctacaccgacaaggacaaggaccgcatcaatggcttcaaacaccggtcagtaatctaagaattccgtattagggtgatcatgttaggcttagcactcatgtcagtagatcgcataatctacataccaatccccaaatgggccattaaaaggattgataaattaaggagggccttcttatggaaaggggataagccagaaaacattaagcctggggcaagcttggaattctttatcatcgaaaatttatcaatccttggaggccttggaattcattatcttcaaaaattttcttcagcttggaggctcacatggctttggctgagatggactgatccttctaagccttgggaaaaattggatttgccctacaacaaggctgatgtacagctctttcatgcctgcacaaagatcaccctaggtaatggggagaagactctttcctagaaagacaactggatcgaaggcctgtgtccaaaagacatctcaccaaaccttttcaaggtggcaatcaggttgcgtctaaaaaggtggcaatcaggaaaaacaggcatgtcaaaactgaatttacaaacaatgtctggcttgcttcattcagacaaataacagacgttgaagtccttcatgagctggtacaactaggaagcttactacaccatgttgagctattagtgaatactgaagacaagattgaatggacacaaactacagatggcctctactctgcaagaagtgcctaccatgcccaattctttggaactgagagaaacaaatcatttaaaatgatatggacagctgaggcgcagtcaaaacagagattcctgggttggctaatcctacaccagaagactttaacggctgagaacttactaatcagacattggccatgcaattggatttgccagctctgcacagaggcttttgaggacactgatcacctcttcagacaatgcaaagtaacaaagcaaatatggcaagaagtctctcgacaaaagcaaatccctgccttctctactctggaaaacatctaggattacgtgctgaacatcaaatcttcatcatcgaaagtacaggcaaggcaaagacttggagcgcttgtaccaacctggtggcatatttggctcatgagaaacgcgaggattttcagggaccaatcaccaaacatagcccataccatctctgccatcctggaggacatcagagacagagattttgcttttaaaccaccttaattcctattttattatacacgcgatgtcaagcagtgtacccatttgtttttgtttctatgtacccccgatgtaaaactttatttttcctcctaatataaccggcaattctcttgccgtcttctattaaaaaatatatataggaaatgatgcttatttacttgttaccatagctttggtcatggaaaagttgacttgttcgcgctcgtttgtttgtattattaatcaaaagagttgattttactttgtactatgtatatagactaaagttgcaaatacacaatggatgtagccactttcacttaatgccacatatttacaatttattgtataggtatccactgccgctatgctttgctcattcatgtcgttgctggtgatcttttctatcagtgtagaagaactatcggtagatctaatgtgcccactcttaaaaaagaatagtacacgtctaatgacaagttatttatataatatatagaacataatatatagacacatggatgaccgagaaagcttaccaaccatcaacggcaatggttttttaaacttaggaaatcattacatcctgatgactatattctctttatgaagtataaaaatgaaatcctcattacctagaatatgtgcgcacgtcgtcgtcatgagtcatggtattgagatggttataattacaatcgaggacttatggaaggcaagaaaactaagctcgttctagctagatcactagaaaacaagcgtgccgacgcttgtttttatagcccttgcattcgttttcgtgttattaagaagcattatgtttgttgcaaaaagacgacatcctcaaatttccatatcataagctattaaattgtaaatatcatatcgatagatttttgatgaaaacttagttgtattttaatttgtatagatatgtagtttgggaaaacaatgataaaatatgtataatggagtctgtgttgattattaaaatgacattatgttaaatacaaagttaatataaattttgcaaagttttataagaatctagttcaattttttgaaacaaaaagaaggtacattcgaataaaaatttcaatcaatttttaagttaaaatttagtgtagcaaatcacattatttaaaggtgttctaaatgttgtttaaaggagccacaatactcgtcattttttcgtggtaccatatgaaaagttgcaaatctatagaatttgtgccatgaactgtacacacttatttaccatgatgtgcacgggagtgttacctcttcatcttctccaacgaccaggtaatctctccgtcggagagtcttcgagttttctagagatttctgataggtgtatcatgtatgtgtacaggagacaacttccaacgaagcagactcttagctcctcttcatggacacgtggtagttttctggagatgtcttactaaatttttattgtgccacgtggctcaataggaggccagatttttgaccctaaaatcggttgtagagattacgggaggggatgtgaagcttacataaataggataagaatatcttgaaacatacgagaacacatgaaattggattgacccctaaaattttaggccccaaatttttggggcgcctgtgtggtcgggcatcccacactacttatgtatgagccttatgtaaaagggttaatttgtcatcatcatttcgttcttgcttagtgtaaaagagttaactcggagaattatggttggaatgcaggggtttataagatggcccaaacctatctaaattgtcatattggcactaatcccaccacacatgaatatttggcccaaatgggcctgaattggaatatattgatggcccaatacattagagataattggctagattacgctaaatataggcaatggcggaaaaacagtgtttgagggtgaagtgtccgacgctatgtcgtgacctgaccactagaggatttggttagaggtcagcttgtgttttgggttttgagcagctcgttttttagcatggttggaccaaccacatcatggcattctaacttagattggccacaacgaggaattttgtgataaatttctactttatttgtgacaactaacaagtgtatattaaaggaaactaattttagataatctattttgaaccggtcctaaaattaggaaacatagtttgcatgcgcagacagccccttctttctccaatgtgctaaccagagaagcaaaagttgcgccaagttccaaacacaaggatttaaaaccagctgaacttaatggcagttagagacataccaaaaaaagcaaacatggatggccactgctaggtggcacccaaaaagtgtgtggcttcccttcgctagcatcccatcctacgtccgctctccttcgttgtagtatgcttccttgtgctttgctttcccatttgctcctttccttctttccttccatttccattctgatcaaattttaggacaccaattaccagcttgatttcttgtataactatatttcgtgcattctcgatgggattgccaggatagggtaaggtttccatttgcatgggaaagagggaggagcgaatcgtgctgcccaatctctctttcccatccatatcaattgatttttcttcttgttccaattgcaaatttaatcggaaagaagagcgggagattccgcggtttcttgattttcagcaagaggaggagaggtggtgctccaaaagaaattatcggatcatcatctgagtcaattcttttgtgtgggagattgaaaggcttgtagcatggagagtactactacaccaagagggaatgaaacaagtgaattaggagcaaatgatggtgaaagcagctcgaggaacagccaacccaacaacattgaagagactaatcccctcccagaggtcagtaatgatgatgcagtcctgatcataggacaagctattgaattgaaggatgaggggacgaggctattccagagaagggactatgaggaggcagccatcaaatttggcgaggcgataaagctccttccaaaggaacacaatgatatcgcctttctccactgcaacgctgctgcttgctacatgcacatgaatcctgaggaccttgatcatgcaattgaggagtgtaatctggcattggaggcatcaccaaagtatacgaaagcattactgaaaagagcacggtgtttcgaagcactggataagctggatctcgcttgcaaggatgtacagaaggtgctgagcttagaaccaagcaatgtaactgcattggagctatcagagagtatcaaggagctgatggaggagaaagacgttttgctggagaaacagattgtttcgcctgtggctgaggagcctaaggctattttagcaaaagataagatcaagaggaaggtatcccgcaaattcagaaactccatagttgaggaagaggtgtgggaaatgattcatgaagaggatatgcaagaggatgatgaggctgccgaggaagagaaatgcaatgggaacaaccatgtgcagaatgatgcaagacccgaagaaaacgacactgagcagatgcacataaaacaaaaccggagcagcgaagagaagtacagagaggagaccaggccgaagcaagggcagtgcagtcgaggagccagcaacgatgggaagacagtactgcagcattcttcactgaatatggaagagatgtgtgtcaacctgaagcatggtaaagagaagcatcagaagcatcttaaagagatacatgttagaggcagtcatgggcaggaaacccatccattctgtagtggtgtggacaaacgccaaaagcatattgatcagatacaaaccaatagtctcggcatgcaagaaaagcacacggacaagtttgaaaggtatgccaacggcagccgagaaaagcattttctagacaggcatattggtcgtggtgaggataagcaggaaaagcgatccacgctcaagccaacaatccatggtagagacaagcataagaatcacaaagatgttaacaagagggcaatgaagagcgtgaagtttgtttgtggagatgacatacggatcgttgtaattccagaacatataactctgatgcagctgatggacatagctcgctataagtacactcctcacttgaagtcaatccttcttaaatttatggacaaagagggtgacttggtgacaattacctcaactgaagaactgcgatgggttgaggaactagatccactaaagcctgtccgattgtatataaaggaggtaagtcctgatcgtgagatcactagggatcttgtcatgcccactacctcctacagtaagttagaaagaaatcacaattccatgtctgaatgtggaagttctaggcatggcggtgaaaagaattcttatacagatgactggatggtacaatttgcccgtctattcaagtatcatgttggttttgattctgatgcatatgtggatctacgtgacctcggtatgaggctgtactatgaagccatggaagaaaccatcacaagtgaagaagcccaggagatatttcaatccgcggaggcaaaatttcaggaaatggcagctttagcattgttcaattggggcaacgtccacatgtctcgtgcaaagaagcgattacttttatctgatgatgcttcacaggaatcaatacttctgcaggtcaaaaatgcatatgaatgggcatgcgctgagtatgtcaaagctgggaaaaagtttgaggaggcagtggacgtaaaaccagacttttatgaaggtctcattgcactcggacagcaacagtttgagcaagcaaagctttcatggcgttacgcagatgcatgcaagataggaatgggaaccgaagtccttgaactattcaaccatgctgaggacaatatggaaaaggggatcgaaatgtgggaaggaatagaatatctgcgtgtaaaaggactatctaaatccaaaaaggagaaagttttactggataaattgggtttgaatggacatttaaaggagttctcagcagatgaagcgtttgagcaagcttcaaatatgagatcacagctgaacatttcatggggtaccattctctatgagcgttcggtagtggaattcaagttaggattatccagctgggaggaaagtcttactgaagcaatcgaaaaatttaagactgggggagcatctctgcctgacatcagtgtgatgataaagaaccactgtgcaaatgagaaaacgcaggaaggtacgcgttactcaatatttatttattgaaatcctgctaaatcatctactcccaaacatcttgtctatgtaagcaaattttcctgtacattgcaataattagttcgtgaaatgttcagttaacattgctacttttgttttgcaagttttctgacctaacttttggtaaaatgttactttgggtcgatactaaacggttttgttttggaatagctagtgagtaagaaaaattggtgcatgcataattgtcatggtagatgaaaaacaactgacctgtttgtattgttcgacttgtttcttattaaaattacaagttgttacaaacactgggcttctacgactgcagcagtttatgagtaagtaaaaatgtgaatgagtgaagaagcaaagttctctgtaacctttgtatactttgtttccccctcttcttaataaacttcggctggctttcgccagccctgcgaaaaaaagaagaagcaaagttgtttccacctgatttccctgcaattggattcttcacaggtggaagacttaccgagcagggttacaaggctaatgtaatctatcaagaatccattactgagacacaaatgcataagatttatctatccaggttgtagtttacctctagccaagaacaattgtagtttacctctagccaagaacaatcaatttcaataacataaggtgaactatgtgtgcaaaccacgcggtacaacattgcattgttagatatcagggttcactagcataacctgataaactatttatggttgagaaactgggacttcttggacaatttgtagtcaggttatatcatacaattagtaaaacaaacatgtgagtttcagattaacattctgtaactagctataaggttggtacatggatagctgatacattttctttgttctgcaggattgagcttcaagattgacgagatagttcaagcatggaatgaaatgtatgacgctaagaagttaaaaaatggtggttcttctttccgtttagaacctttatttcgaagaaggccttcaaagctgcataatatattagagcacatacattacacttgaggttgtatatctgacataggacttggatgctgtaaacatggataggaaagttgagacttatttctttctgaaaaaggtaatctgatcctttacgaaaaagtatttatttcatgtgattctgcaaagtgagttaacttttaccctgtgtggtatgcatgcatccaaagcaacaggaaattgggttttgagtttttcttttaatctttatccacttatattacattgcaatcagtacagtacatagacttactctgatccttataccgtatcaaccaaaagcagggcagggccaatttatatcttagtaaagaacagtggccctgcagaggtgctaaaacctaaaacatgtagtataaactagtacttacaattctaaaaaacaaaaaactaagaaaagaaaaaaatataaatccctctgtgcatgaaaacgagccattttgtacaatggtactgcctgaagtatagttttcaccacaaactcttatttgtaaaacaaataaactataatattatgatttagtttcaaaagacaaatcaaccaatataattttcatacatctgatctcaatacttttaaaagttcctgatgcttaaattttgaaatttaaactagacgtatctccaaaatagcacctttcagtaattggaggtgatacaataatatgattaccacccatgttgctactagaagtgcaattgtggcaaaattgatgtcagtatgatatattaatatttttcaaaacacaccgctgaaagctctcatatttttcacacacatatacttattaggtttctttaagtcttgttttgtttttattaatgtaacttgagctgccaagtaacatagaacttttagatcctgaatagctagcgtccctctacgtaaaaaagatgatctgcatgaaattatcatgcatgttttccagcttatttgttcagtggatatcattagagcaataagtcatcccctaatttaaaatatcaatgattttgacatgttcctgcagactggttattttacggaactggagtacattcatgcttcccccaccaagtgatcttcccattcaagcgaacagaactgctaggaaggcaaattataaagtgaagatgatatttcactagcttcccacctatttcagatgtgcaaatgtccaagtgtgtactcatagaaaaataggaaggctcagctaaattgtaacttttttgtagatgaaacacgatagtgaattgttcatagttctcaattgcgtgaaagttatgtaatttgttggaaatattttgttatatgcagcagcgataatcgataaataatacatatccaactgattactgataacatttcccagctagtctgagaacatatctgaattgtaccaaatcacttaatataataagtctgaatgattcattaataatactgagtctggaaacatacactatagagaaaatgcctactggtcagtgaaaactgtgttgcgcgcattgtattcatcggtccggccatcttagactaagtttctataagtgtaattgcttaaaattgtaggatcgaatagcaagaacttagccaaccagaggggggtgaatggttggtgtacccaaaaaccaaaacttttaccggaaataaaagttaccctcaatttcgacggatcgcggtctgaccgaagtagttgcaccggtctgaccgcctgaaagccatcggtctgaccgatattgtatctttggtctgaccgccgagatcagctgtcgtcgcctgaagccgccgccagtctgaccgctgctactccgccggtctgaccaccgcgatgccatcggtctgaccgccagtgtctcgtcggttagaccgccaaacccaagcaaacacaaatcgaagaactcttgatgtagatgacaactttattacttatctctgtgtttacaaagtgcaacaacagcactcctcacgaaaatctcgactaaactcgaaacccaaactcaaccctcaactcaatgctctcaaaagcgataccgggaggccacaccctccctctctatttataaatgaggtaggcagcctaaaaccatgaaccaaactcatacaagaagtcctaatcctcctaggaaacctttctgtacaagaaaccaactttacaaactccaatcataccaaatttggactccttccaaattcgacttcgcatcccatacgcacacaatatctccatcgtatgccatatggaatcttcaccaaccacgtgcattgatctttagcctaagtatctcgtatgatatatgaccgtccggatatcgccttatctccaagtcgactctcgatccatcaccggcagtactctcccgaggcatcaagacacctacacatgaatcaaacaaagaaaccatattccgagatcaagctatctccaacttgactcattgttagcaaacaacagtattacatacgcatagtatccatctagaagccataaacatgaatcatctatggatatctgttgtcaaatagacaaccgcttcacgtcgaaaggcgtggttctctcaacaatagtactgcttagtgaaaaatagtatacgcatagtatccatctagaagccataaacatgaaacatccattgatagttggaaaagaaagacaatagtattgcttagtgaaaaatttttggatcaccctattatctggccctagggggctatttatagccctattacaggttccccctattaggatttagactttacaagtgaatttacatggttacctttatgatagggacattattgagggcacactgtgtcctttacatgtatgggcccctattgggcttaaatggcttggcccatctatttgccgaaatcccccgaaggcgtaagtagcccgctgggcctcctgacggtgaggttcggtactttggcgaaacccgtgcctttgtgccgaggctttcgcctcatcatcttcgctcgcgcggccctctgacaaggtcttcgcttggtgaagttggcacattccaagccacggctttcgccttgtggctttcgcccatatggttttctcctcgaccttcgccgcttgcctccggtctgggcctgttgcccaagttcttggtatacctccaacaatatccaaacaagcaacccaaaatcgaaatggacacagagtcggccggtcagaacgcgggctgaccggtctgaccgcacaatacacaccggtctgaccggcaaccattggcctgtctgaccggacccgacaatcagcaacacctgcagatcaccagcaaatccaatcatctccaaaactacttcgccaataatctccaaatatcaaaaccaataatcacatatgtcgattgttcatcacagaataagaatgaaaaacactttgattttacaatctttcccttgatgaacacattggcaaacccatcaaatatgttttgttgtttggaaaaataaaaacaaaagtggtaaaaagcaaaaaacacactgtgtactccatgctcaaaattcaaaagaaaacttctctcacttttgaaaacaaagaaattatcccttgacttgaaaaacatgcacaatctcttctcttctcccccttttgacaatgatttcatgaagcataagaattatgttcatttatgttcaagagcttagcatacatatagcatatcaagtcatgtgttgcaataaaaagaagatgaacccatccataatatagcaagcatgcattaaagtataatcatgaaccaaagattttacaactaagttcaaatcaacaatcaaaattcatgatttcatacgatttataatgcaacatctttagaagcacataggttgaaaaataaacactacacatatatacctattgcaattatcactctttcttaaattagctctagcacaaaacaaccaagagaatttataacttttattttagcatttttgctcatatttttctctcaattattccgggtacgtccttgtcatcaagactgtttccaaggattcggcacccattatttttgctcacatcgaatacgtccttgtcgtcaagactgtttctaaggattcgtattcattttttctctcatagataattttattcgcttgcacaatgagacattacaaagctatttgaggaataacaattcaataaagcacatatataagcatttataaatcaaaccatatgctagcatcaatattgcatattttcttaattcaagttatagaatttaagtgtcatgcatcatctcccttaaaaacaatatctaggccttataaaaagactaaaatacatacaagctatgctagacacaaataaaccttcatagtattgctagcatgcacaagaaaataccatatgtataaagcaaagctctttgttctcaatatttcttattgtcaaattttgattgataaaaccatgatgtacaaaactccccctcaaaccatgccaaaagaatgaattattcccaattctccacgaagaaaagcaaagcgagaagaatccaatggtttagtgaaaatatcagcaagttgcaactttgtgtccaaaaacgtcaattcaacatctcctttctcaacatgatccctcaaaaagtgaaagtgaatatcaatgtgctttgtgcatgagtgttgtacatgattcttagcaatgttagtagcactagtattatcacaaaaaagaggtactttctcaaaagtaagaccataatctttcaaagttgatataagtcaaagaatctgatcgagaacaacaactagcagcagcaacatattcagactcagcattgattgagcaacagtagattgttttctagaagaccatgcaatcaatgatgtaacaagaaaataacatgttccactactacttttcctatcaattctacaaccagcaaaatcagcgtcggaatatccactcaagcatatagaagatgaagtagaatatcaaattccaaactcaagtatatgattcaaatacctcattatccgcttgactgcttgacgatgtgaagcatgaggagaagcttgaaagcgtgcacataaacacttaacaaattgtatgtctagcctagaagcaattagatgcaacaaagatccaatcatacctctatactccttctgatcaacagcttcaccatcttcattaggatccaacacagctgtagaaccaattggtgttgaaattggcttgcaattctccatcttgaaaaatctcaaaagatcctttgtgtatttcgtttgatgcacaaatgtaccttgaggtgtttccttaatttacaatcccaaaaagtacgataactcacccatcatgttcatctcaaattccctgcgcatagtctcagcaaactccacaaccaaagcgtgagttgaacaacctaagatgatatcatctacataaatctgagcgaaaagttgattatcaccatgcttaagaacaaaaagcattttgtcaacctttcccatttgaaaactttttgcaagcaaaaagttcttaagcctatcataccatgctctaggtgcttgtttcaagccttacaaagctttagacaatttaaaaacatggttgggaaaatcaggattttcaaaacctggtggttgtttgacataaacctcttcttgtataaaaccatttcgaaaagcacttttcacatccatttgatacaatttaaaaccttttgaagcagtaaaagctaacaaaaatctaattgcctcaattctagcaacatgagcaaaagtttcatcaaaatcaaaaccctccaccagagtaaaaccttgagcaacaagtctagctttatttctcataattaaaccattctcattttgtttatttttgaaaacccatttggttccaataatattatatccacagggtggttcaactaaaattcaaactttatttctcttaaaatttttaagttcttcatgcatgacgttaatccatgattcatcagttaatgcatgagtaacatctttgggttcaaaagtagcaacaaacgcaaaatttgcaaaaacatcatgagtccttagaccttgtagtccgctcaccaaaatttctaataatttgttccagcggatgtcgtcgttgaatatgcaaaggagcaacgacttctgaagttgtttcatgttctgtaccagtactagtcgaagttgtagcctctggaggaccatcacgatcaatatcaacaaaaccagaacccgacgaacctggccggtctgaccgcacatcctacgccggtctgactggacgtgtgctagcggtctgaccgcctggcgcccaatctgaccggccgagccaacctcattgtcaaagtcgtcgctctcgtctttaaaaatacgaccatcctcccctgaacctgtgacaatgtacctacaatttctggtatagtacctggactagcctcatcaaaagcaagtctcaactattttgttagtttccaaaacaagtacacgatagccacgtgaatgtgcagcgtaaccaagaaacattccatcggtagagcgtgcctcaaacttatccaaatttctagatttcaagacaaagcacttgcaaccaaaaatacgcaaatgtgaaactttaggttgacgtccaaatcgaagttcataagtttttccaagttttgacctcaagaagtgttaaccgcctcagcccaaaattttctaggagtatgatactcatccaagatcgttctagccatctcaaccaaagatcgattctttctttcaacaacaccgttttgttgcggaacacgaggagaagaaaaatcatgttcaagacctttttcgttgcaaaattgttcaaatgaagcattcttaaacccaccaccattatcacttcgaattcttttcaaagaaccaggaaattcaagatccaatcgaagatacaaatcatgaaaatattgaaaagtctcatccttagttgccatgaagaaaacccaagaatatcgagaaaaatcgtcaacaataaccaacacatacaactttcctccaacggattgcactctagctggaccaacagtgtccatatgtaatagctgtcccggtgcatccgtcatcatagaatcaataggagcatgtgaagaaacaactatcttagcatgacgacatggtgtacaaatcaaatcaagatctttcttaagtttagcccaaccacaaacaagatccaaaccacttaacctcgtaagatgatcaaaatcagcatgtccaagtccacgatgccaaagcatcacatcctttttaaacttagcaaccaaacatgttttcacaggtgaaacaagattttcaaaatcagctttaaacactcttccatagcgagaaatattcagcacaaaatcaccacaagaatcaaatactttacttccagttttcttaaagtgaacctcaaaattttcatcaacaatttgtgaaactaaaagcaaattatactttaagtcctcaaccaaagctacatttttcaattcgaacttgtcatttaccttaacaaaaacctgtaacaagaatggcactagtagaagcatcaccaaagataatcgattcagtcttggatgcctgtttgagggaggagaaccaatttttatcaccggtcatgtgccacgaacaaccggaatccacgatccacacgttctccttccttgccaccaaagcctacacacaagaagacgtcaaagcctcagtactagggttagataaaagaaatttaggaatccaatactgagacacacaaccagtagatcaaataggcatacatccacatgcaaaaatagtttgagaatttttagaaaaatctctccgaagctggtctgaccgatggggtactgctggtctgaccgcctctgtaccgccggtctgaccaccgctcagtagccagtttgaccggtcaccggtctaaccgcgggacccactgcggtctgaccggtttccatgagggaaaaccagatttttgccactttaattttgcaactgcaatttctctctcctttttctgtttatgagctaatctgaaacaaaaccaacaagatgttcatctttaccacaaaaagaacaagtatacttttctttagaagaagatggttttgaaagatttgtttttgtttcttttagtgttgtagaaagagagggcataattccagtagacttaaaaattattttcttagaacttagttttgtcaaaatttcaccatgttcagtcacactcaaaacattaggttgatttttggtgaaatagtcatgaacatcaaaaccaacacccatattgtaactagtcactttagattgatccaaaatcatgttaagttgtttcttaccatcagaaaatctttccaaataacttttcaaataagaaatctctttttgcaaattaactcaattttcacaatctaccatgacacctttgcttttacgacatttgggggaagaaagcacttcattgattttcacaatttcctccatgtactcaacatgacctaatgcatcttttagcttcatcttgtttggtgtacatgttgagcaatccaaaacaccatgttgttgttttaactttttggcacaaatcatgttaaataccaaactagcatgaaaaacaatttgatatttttataacaactttttagtcaaaaacaactcatccaaagtgtgtgtgtgcaagagaaatccaagagaaagagaaggtcttttttcaaatgatgtgcaacattgacacctctaattttttttttcaatttcatgtattaaaacttcacaatttttgcagtcttcatcattacgaataagagattttaatctaataatttgagaattaagagatttaataatatattcctgttttctatacatcttctcacatttcttattttttgtacttaaaataagaatagcttcctcaaaagaactcacatcattgtcttcacactctgaattcgattcaccacgtgccatgaagcaaacaccggagatgttctttcccttatcttcatcttcactctcaccatctacattggttagtggctcaaaagcagcatagacttgttgacaaccaaatatggtaagtcataatccgggttcgacattgggatcaaggtggattcgataaagagattgattcgaaaaacagagtatgcatcggttgcgaaggcatcagctggagtctgcatcggctgagatggatcggacagaggatgattgatacagccgatgaaggtgatgcagccgattctgataatggcggtttcaaagatgtttctagaatcaatcaagatgcttcacgaagattgccgcgatggagatagggctctcggataggcaattgtatatattaattaggatattttatgtaatttccttagagatatgtttgggcaagagtctgccgcaaagacttatggtatcttagagtttgttagagataagcgtcgtgtccggtaaggacatatcttgtatctcaggtataaatatgacccgagcccatgtaatcaattaacattcgttcaatacaatctcggcgcatcgccacccttttactttcgtttttttcgacgagttcttgctttcgagttgagctgcatcgattcgatcttcaactagaggtaaaacttgttatggcggcttgcgttatcggggttaatacttccatctttatgatacttgaaccctgtctaagtaatccgtcgagttatcatatacatgtttcaatctatgctagttgcattatataacttgttatcggctggttctggttgttaggaaacaatcagtagagttatattttgttattaatctagattgtatcatgtatctatcatctcctgtagattctcatcatcttgtctagatttcatacttgcctttatgcttaatgctgtatcggttgagttcgatctattatgtgttatttataattgtgatatctagcttgttttatgattatcaagagagatagtatcggggtttcagctgatcttacctgatttagctttatgttttatatgtttaattgatatgctaagtctgccctttgcgttaagatcttatcacaataaattatattaggcttttgtttgatatagtatatctgttttaatatcttaatgtagagtggtatcggagtattagccgatacatgctagatctatctgatcggctatgatataagcgtttataatcttcatgttaatgtatatttcgacctaagtggtttgtactgtctcggcatggcgactgatctatcccaatcacttgatttaaatatacatcgacagaaagattgtatagcgttaatatatgtactcgatcgagtagatttagtcttaccttgcttatttgtaactgccgatcgattcacatatgacatcggctcaagaataaatgatatgtcatcggctgctggccgatcggctatcgtttatggatttaaccgtggtttcttttgttttgtttcttgttgattgcaggatcaaatcaactggcatgctcacgaacctaaaggcaagattttggacctgcactgaagttaagcagatcttccaggccagtgtgtgtttttcgcatcaacaaaacttgatcaaacatcttcttgagattctccttagtcttcttccccttgaacgtgctcttggggttgttgtccttggtcttctctccaccattgtcttccttcttgcctctcccaagcttcggacaatgcagaacgaatgtgatcaagagcaccacattcaaagcgatgagttggaccaccttttttcctgtacctaacattattcatagctcgagaaatcttgttagcggccaaagccaagtcctcctcgaactgtttgagttgctcatcggacatggaatgaatcaaagcaagaacagtagaatttgatgaagaagcaccaacatccaaagaagtcgcggaagaaaccaaagcactagacttagaatcaactttacgagaaagaatattcatctgatgtgttttgatctttgtgtaaagtgaatccaaagtcaaagtagacatgtcaacagattcctgaagtgatgtaactttcatctcccaaatagacatatcaagaccattcaaaaagtgacgagaaacctcagattatgtgtaattaacatcataagcagaatcaacagatcgaagatcactcaaaatcttattaaatctaccaagataatcatccaaagcttctccaggtttcatctcaaattttatgtattcctttttcaaaagatctcgacaaagttctttaatgttagtagttctttgatgaatgtttttcaaagcattccaaatttcattggcagttttatgttgcgaaactcgatcaaaatccgaacgagaaattccactcaaaagaatattgcgagctctgcaattattattaaactcagttttcaaagcaatagtgtcaatctgttcaggaataacatgtggctgtgaaactttttgccaaacatcataatcctcagccataatgtaagattgcatcttatcacaccaataagcaaaatccgaaccatcaaaaacatgaggcttagtagtaaacttgtttgccatggctaaaactctagatcggttaaaatccaaagaacaaaacaaggctctgataccacttgtaggatcgaatagcaagagctaagccaaccggggggggggggttaatggttggtgtgctcaaatacacacaacatgccaactaccaaactaatcctttggttccactatgaagttctttatttttttagtgaaggaagggcaaaagctttgccacttttatattgatagagaaggagaaaaaaccaactaagtattaacagggtccgagactgaaaatcggacccaaaaaaataaaacagaaaggcactactctcctgcagagattaactcaatgatttttgctgctcccgttgtgatctaggtccgtgcctcctctttaatcttggcgatgatggtggcgggagttgaggccgcatgcctgaagatcctggcattttgttcgcatcacagctcccaggaaatcaagatgatcatcaacttaagggcctttgttgggcagttcaccgtgcgtgagatttaataccaccattcttctaccgttgcgcacccatcccaatcttgcaaccgaaggtctaaccctgtccacctttgtagttcagcccaaatccttctggataatctgcaatttgctagaaggtgtagagccgattctggcacggtgcgacagagggggcaaaaatgttgattagcccaccctctcttttgcaacctatctgccatccatactatgttttggatgactagccagaagaagaatttgcatttaggcaaggcccaacatttccaaatggtctggatatagatcgttcctgctgctccatggaattgcagtctatacgctgagttagaagagtaggttcaatttgctgtcagcttccagacgattgaatccttctgatcaattaggggggcggcacgttgtatcaatgtccataggcagatgtactggcacagatgatccgcctcagttatacgcagcagatcaatatcccggatccatgtgttgaggtcaagggcatcatgcactgtccttgttttgcgtttggaggctgcgaagatagctggagtgatatccttgggcttcttattctcaagccaatgcgaatcccaaaagctggccgtctacccatcccgtaaaaggattgtcgtcgccgttgcgaagaggtctttgtctatctagtcgcaggagagtgcagtgccattccaaggcttgttcggttccgtccactcatactacaaccaccttaaccttagcgctcgggtgaaccagtccaggtctagcacaccgactaactttgtcccaactaactttgcatttcccaactgagatatcctctcctcccactcataggaatttcctcctcatcttatcaattgaatggagcatactgttcgggattttaagctattagatagtagattgtttgcgatcttaggacggacttggttaaagttgttctccttgccgctgtcatcatccaaccttgccatggcgccaatctggccttgcacttatccaacagaggctggatgtggactttcttgagcttggagaccacaagcgggagacacaggtatttcattgcgaagccagtgatgtttgcagggaagactcgtaagatctcttgtatgtcgatgccaacacaacggatgggcgtgatctggctctttttcatatttgtctgaaggccggttacgtccctgaaggagtgtaggatttgagctaagtggctcatgtctctgactgtcggccggacgaacattgcagcgtcctctgcataaagtgacatccgtaggcgtggtgttctcccatttagttgggtgagatagccgaggtcggtggccttttccaacacggcaactaatgggtcaatggccaggataaagaggagaggggatagcgggtccccttgatgaagacccctgtcgtgcttgatgggtgtgcgcggtgagccgttgagcaggacccttgtggagggtcaatcagactgatggttagaccgagagggtcaatcagatactggaggatatgttgagagcttgcactcttgattttggcggagtttggaataaaagcctaccttatagcgagttctcctacaacaatagttatcaggccagcttacaaatggccgtctattttgggaccaaacaggagaacgccaattgtttgggaccgaattattgagtgatgtagaggaaaaaagtcagaaccttcatggaaaggataagaatttcacggtctcggcagaagagctacgcgaacaacagccgaagatagcttatctttgaagcccgggactatgtgtaccttcgagttacgccactccggggagtgcaccacttccaacccaaaggcaagttggcaccacgctttgtgggaccatacaggattttggaacgcagaggtgaagtcgcttactagcttgagctcccatctagcaaggctagtatccacgatgtgcttcatgtatctcaactgaagaaatgtttgagcgtacctaaggaataggctagttctaagcacatcgagattcaagaggatttgacatatgtggagaaacaagtccgcatccttgaaaccagcgtgagaagaaccagaaacaaggacaccaggtttgcagggtccagtggagccaccattatgaggaagaggtcacctaggaaagagaagacgagttaaacgccgcccatccgcacctctttgccagcttttccgaatctcggggtcgagattccgtttaagggggctaggtttgtcacatcctgaagtcctccttcctttagctttgaatttcatcaagcctagagctaatcattaattaataaatgcgattaataatgggaatcgacatggtgggatttttgttggattctccatgtcaaaatacattaataggatttttagcggaatttttcagagccctggagataatttaaaccaattaaaatcagtctatgttattaaagaaatccctagaaatcctttttccttttcctttttcctttcccctccctttttcctctttcttgggccgcaggccccaatcctccttgctgcctgcgccccctcccgaagtccgcccttcatcactctctctctcttggggcaccgacaggctcacccctgcctccgcgccacatcccccacctccccgcgcatgtcgcccacctcccgcaccccatgcgcaactcccccacgcacccatgcccgcgagatggccaggattcaattttcgaatcccacctctctctctctctctccacctcccccactacgccggcaaaatcggggccgttcctggccacgcccgacctcctcgcccctataaatgtcacccccgctcccatgcacccaccactctaatgccgtcgcccccatctccgccgccgtcgccaccgctccggctgccactagccgccgcgccgagccgagccatgtcatcgctgccgcgggttcgaaagcgcgagggccacctcgtctgcaaattgtccgtcgtcaaccgccaccgggaacaacctttcacagcacaccagtgagcccctccatttccgctgccttcggacggcatttccgctcgcctcgcacctcttctcttcctctaagtcctctcattagctcccttagaccgctccggacgtcgtccacccactcatcttgccgtcgccgtctactgtcgtctccctccgcgtcggccgaacccctcggtgagaaccctcggttcttccccctctccctcctagcgccaccactaccgcatcgtgcgccgctgcccgccacggctggccggcccaggatcgagctgtgcccgtgccgctgcagccgtccgatctaccgctcggtagattggggccgttcggctgccgcccacgtggctgccacgtcaatgccacatgtgtgtgccatgtggtgcgccgcaccccagtccttggactcggtccactgcggaccggcgcccttgtgcaccgacaggtggggcccgccggccggctccgcttccctcctgatgacatcagcagggttctttattgcgcaataaatcattaaggagtatctgttaatagtaataaaatagagagaatattctaaaattcatagaaaattcatccgagctccgtttaagcccattgaagtctcagtaaatctaggaaaatgcaaagaaaccattaaaaatagctttgtttcatgtttcagtagtctcatcgggtgttatgggtggccaatcaaattcaccgtgattagtctcatctataataatttgacctaatggaacttgtgtagttcaagtggttggttgggcctgttgcaacgtggtgtagtgttgcgcagtgatgattaatattgcttaattcattaaaacgattttactgctttcaacacctacttttaaatgctagaattatgcaaataaaccctcagctcccttggtatatatacactacatcatacctctcttccggtatgacttgctgagtatagtgggtagtactcagtcttggtctgtctcccaccccagagttggagtatgcttcagatggaggttatgttactcgaaggagtaggcttcatccgtgccgtcaaggatgcttgtggaatggtgtcgcccgctgttcatgtcaagctctagaataagctcgcttttattttgtgctgcatttatgtaagacttttatatgtttgtaagacgtgaatctgcatgtcaactttgtcatttgtgtaccctagccggtcctagacaggggtttaatgcacattctgcttggaattctattcgggaatttctgggcgtgacagtcgacaacttctctcccaaattgtagttatcttaactcgccgaaagatctagtcaatcagagctttgagcacatacattcgagctcagggtaatatcaagtggtatcagagttttagttgctcggtgtgtttttatcttcctataaccagaaaatagccattcaaaaaaaaggtttcatccattacctaaccatctttgcgttgttgcgttgttctttttaatttttgctttgttgatttttgcgttgtaccgttgtgtcatgttgctggtcttagcattagtatgtttagagttttaagttctggtgaggttagtaccattgtcaccgtcgttgccgtgtctttgttgttgtagggactaaaaaatggaatttcggctgtcaaggttctattttttagttttcagaaggtgatctaagcaatcaatcttaattggcttgctagctgaattagatcctatcaccgccaaaatcagaagttactttatttgtgattcatgatcaaggtgctgcttcgactattagaaccagatctagattaccagaggctcggtgcacacgttgcaacaaaatggtggcaagataataaatatatttttctccacatatatcatgtagaatcaaaaatatttttgatatagcatcattatgtgcaaggaatcactactagaaaaaccatctttggtcggttgcccaaaaacaacattagtcccgattgcttaaaaaaccaggactaaaaagcatttttagtcccggtttaaaagtgcaatgatctttaatcccggttggtaacgggacgaaagatcatcttttgtaccggtttattcattgtcacgacgtggcaggtcccccactatttttaatcccagttggtataaacaaccgggactaataatcagatttttagtcccggttgttataaacaaccgggactacaaatcagtttcccacgtctcgcgctctctctctctctctctctctcttccatcgttctctccgcgcgcatctgagagtcctcacccttatctcttcctcccctccactctttatctctcccttatctcttcctcatcttcctctttcactctcatctcttcctctccccttccacttccacacttcttaagttttcctctcttctcttcctcagatctgcgggagaagcagacggcggcggccgggcccgtgctgggtgggggcggtggcggccgggcctgtgccggggaggggcggcagcggtcgggcccatgctgggctggggaggcggcggtcaggcggtggcagagcgacggcggcccggcgcggaaggccgtgtggtggcaggcttcatggatttttttttcttttttccttctcgttatgtgaatgattgtttgttgatttgatctgtgatttgagaatgatgtgtgaatgatctgtgatttgttgttgtggatgatttgggatgttgagatattgagttgttgatgtggatgatttgggatgttgagatgtgtgaacaatctgtgatgtgcgaacccaatctatgatttgtgatttattattttctaatgatttggagatatttggcgccagaaaagaaaaaaaagaaaaaattaactttagtactggttggtagcaccaattgggactaaagatttagtctctttatttcaaccgggactaaaactggacatcttttagtcccggattcgtagtcccggttagaaaaccggtactatagggggttcctaaccgggactaaaaagcgtttctccagtagtgaatctgttcacaatatagtcacatacttatattgagtaatataaatacaatactacatttttttctcgctgtatataagtgcaccaagcaatattacaatattagatatactattttccaacaagaatcacgagggggcgcaaaggttctctatgccatgaatgcatttagtgttgcacctaaatgtcatccccttaagtatgggcttgactatatcaagaaccttgataatcactacaaacaatagtctataggtcataatcataccacaaagtactgcaagatctacccattttgaatgacctgtttccacttgaaataactcagcaataactttctcgccactaactgttatgggtccttcaaggttgagtactaaacctaagaactcattcttgtaaaacccctgcagtgcatacttgtgaaaggagatgtagtacattgggtacttccatactatgtttggaaggctattaggaagttggaagaatccacttgtgagcatcataataccttgtataccagcacctgttatgatccccattaggaaatctggtacgatggttgctacgatcatcatcaggccttccactagcattgtgcatgaacaaagtactaacgtaaaatagacaaaatgttcaatttgcctttgtaagccactaagataatacgcaattgcaccaggtattatggcaataagaagaagatatggtgtggatgacaatgtattggagatgacaaatgtggttacaccataatgtccatttagcctttccctgctaaagatctgagcaacaggaagagaaaggtagatatataagaccacatattaagaaaaatgtgatgcacaaatgcaaattcatttgataaatcaaccttgcatatttcgattttttttatctacatgaaatgtaacctattgtacagatgcgaagtatttaaattattttaataaaattattaaattttcactctggaatttttagtaaataagttgggggtttttttatatatataataagtagaggcttcacaagaagccctgcattaatcctacaagctagaaaaggtaaaaattcccacattaatcatgtgtgcatctatcaaacctatggccagagaatgtccaacaaatagtgtttcgatttgttaagttcggagtttataatataggtaggtgtactcagttggagttatgcgttgtagtagtttttatttaacaatctaaaatttacgaattgacaaatattaataacaaattaataaatactgagttgtagttggtatgtagtctcagttagtttatttttcacaatctgattgtcttgaaattcgaaattaatgaatattaagctgtgctccattggatctcaataatattattttcatgatttactaattctagaatctgatttactatattgtaagctgatattgattgtttacaatatgttgtaagtgcggacggagtgttacatggctatttaaatattagtaatggtaattgagtataactcaattcactaaatgaaagctgtgggtttgaaatatttttatccagagtcaaaagacattgcaagtatttgtgaattttattaggatgcataagagagattatttaaggcttttctatgcgatgcttcacatgatttcttaatatcctaaattgaaaatgaatttatttccattactctctcttaattaaatagcactatcccatgtccttgatggaaaatttttattcgtgttgataactttgttgaatcttttggtacagtagtatgaatttgaataatcaattccagacatcgtatccaagttcactgacttaattttactatttatgcccgttggtctatatgtgtgttcagtcgattttaacaaattatatagagtaaacatgtttgctctttctgctaatgacatatcaattcataaataccttcatatcctccacgaaggatgggaaccctccaattgccattaaggttagcatggtgctaataaacattaacattgatgacctagcctgaaatgaagaatcaattaaaattaattaataaatatgtttggtacatgcatactctatcagccatttgtgtgaaaacagccaacattttatcttcacttactcgaattgaatcggatccatagcccatattgtaaaatatggtgccaaggcaagcacttatggaaatataaatggccatccgcaaccaatagtatccaatatctctatacatgttaacaaatgaacgtctggtaaggacaagtgtcttggtaataaaaccagctcggtttcttccaatcgtcacccgatcctaaaagaatatgaacataacttgtgacatatatcccaaacatgtataattgtgaataagtatgttgtacatataaatataatatgtacacaagtttagagcagaaaccatctcgtttatgtgacgcatgtcctgttttgcgacttccgaagtgttggaggatttgtatgaattcaccaaaatgtctattgcttcatctgcaacagctggcatgcaccggagtctgtcttcactctcctgtgtgttagcaaattgaaaggtaacaggtcaaaagcaagcaaattggtgtcacccagttttgttgccggacatttgatggtgtacgcatcaacgagcaaatgtgaaaaaattatagaaaaattagacatgtatcccaacaatattatacatatatgcaaatttgaagataagattttacacataagtgtaatattattggaagtatgtgtccatgcttttatggaattttctgtgatatttgctagatgatgtacacggagtatgcatgaaaattttgtgcgcataggatatattcccgtactttcatagcatcttttttattttatttttgttcttttctcttttgttgctgggctgctgtgacattgtgcagatactgtttgcagaggacagatttgtaaataattactcattatccaaaagaacatgatatttcattaatagtgcttgaattggagtcttggaccaactatatatctaaccttgtcaaaatctttgttcacagtcctcaaaaaatgatctgatggattcctcattggagggcaagggtagccatttgaagcaaagaactgcaaattaaaccaactattgcaagctgaaaacagcgataacatttaactaattaaacgactatatacacagaatgattctacactagatcgactaacctcggcagccattgaagctgggccaaagaagatggtgttcccagcggcgagcaggcaaaggacatggaagagctcgaacacctcgctgcatggctggtgcacgacagcgacgactgtcatgccctccctggcagcgaggcctatgatgcgactcatgacatggaaggaggcggcgctgtcgaggccgctggtgggttcgtcgaggaacagcagccggggacgtgtaaggatgtcaaggcagatgctcaaccgcttttgttgcccaccgctgatgcccttgcttgaccgcccgccgatccgagtgtccagcgtgccggtgagtcccatctccctcaccgtttcatcggcgcgccgcaacttctctgccatagtcatggtgtctggcagctggatctgtgccgagtagtagatggcctcgcgcactgttagtgtcgccattagcacgttctcttgtgtcacgtacgcctgattgattcatgcattcacaatacattcatgtttttagatcagacaccagtttttctcgttctctctcgctggctctatccttaatatttgagctacgttaatgtttgcagttaatgtttgcagtgtcatgattgtaaatccccctaagtctaaagaagttcggtagcatattggattgattatactattacactagctaaatatatatccctgttattaatagtgtaattttttaccatgtgaaatttcacaacatttttattgtagacaaaattgcaatcatcatctatacacggctaaaagatttggctagaatcatatgttaatttatttttatcgtagtgaacatgttcgcttcttctcgactatggggggattagaaggggaaaaagtacgaattatctctcccccccgaactatcgcggtcgtccgaattacccccctgaaccacaaaaccggacattcttcacccctaactatgcaaaccggacgaattaccccccacgacccaatccgcagtggttttggtctacgtggcgtacacgtggcaatccagtcagcgttttattgtggggcccacctatcatatatatactctatctatctcatgtctctctctccccctctctctcgggtcgtcgggctcagggcggtcggcgcgcatggcgccgtgcgggggccggtggtgggcggcggcggcgggtcgacgagctcggccggctccggtggcagcggcagcggcggcgacggcgtccgcggcgagatgtggagctccgacacatcggcagtgcggtggacgcccccttccccacgcgccgctgtccacagcagttgctgccccgccgtcgacgcgtagttgatgaccccggccaccgtggcgttgtaccgcagctcgtacgcctgcaggaccttgagcgccgcttccaccgcagttgtcgccgccgccgcagcctcgccccaccccaatgagtgcgacagggccaccgtccatcgcctgcccccgtgcatcgccatcaggcgcccaccgcctgctcccacgcgccgtcgtccactgtgcgcccccgggcgtcaccgtccgccgcccgcccctccgcgcggcgggcaaccggtaggttgcgacgggcgcgacgctgaggcgggaggccgccgggatagaaggtgggcgcggaggaaatggtgagcggcggtcgcgggaacggcctcctcctccgccaccactgcctctctcttcagcctctcttgttcctcctccccgtcctcctcctgacgccgctccagctcccgacgtgcgcctccgtccgccgtcccccgtcctcctcccgacgcttccggccatggctcgcctctctgccatggccgccggcgcccgcctctcccccatcccgtccacctcccgcgcgccgtccgccagcccgcccccgcgccgcgccatgtgtgccagccaccggcgtgcgcaccgctgctgaccaacaaagagagagaaagaaagagaggaagaaagaaagtggtgtctgacatgtgggtcccaccattaaaaaaataaaatgctgactggactgccacgtgtacgccacgtagaccaaaaccaccgcggattgggtcgagggcggtaattcgtccggtttgtatagttgggagtgaagaatgtccggttttgttgttcggggggataattcggacgaccgcgatagttcggggggtaattcgtacgttttccatcaggaggtgacagactcttcaataatactaatcaaaatgggctgtattaattagatgctccaatagttttctcacttgaactcaccgaggttccaaatgcaagttgctgacatcgaccgttaaccagaatttgccctttcatcttcaagtttgaatccaatcttcctgtgtatatcaatagagtacagatcgataagatgttatgaactgaaatacggcgtattacaacagaaactcagctcgaaagacacaatttaatataaccgtgagaaaaaaagaaggaactctataactgagacgaagaagcactaagactcccataaggacgaccgtcccagtgctgtaagacactgttaatatatagtgtctatatgccccacatcatctagaaactatatatagcactattctattgcacacatatcaccaatttactgtgctaatttaacatcaaatatttgatcaatacccttaatattatatagaaactgggtctcaattcaagatctagtttcatcgtttcattcatttaatctgatgccacattatcttttacaataggtggcatgctatttaacactatagacatcagtgttgttgggaacttattgcatgccattggtggcatgctaacattatggacatcaccattgttggagcttaatgcatgcctcgtaatataaagttgatgatacgagatagataaacaatataattgggggatcaaaatagctatatatagaggatagaggaatttctaatttgcttccatacataaatggagagccaaatcacaaataaaataaagtaagaggagagaggaatttcttttttttttcagttttcacacataaaaaagatacattaggaagtcatgataagcacggaaactctaatgggcgatcaatcgccctagctattggctagcgatcgccccattcccccctccctcgctctacctggttttcttttttggcaccgcattactttcctattttagtaaatttatgcacctaaagtttatacacctagggtttatacatctaaagtttagagagcaaaagtttataagtcaaaagtttatatatccgattcaaatttgaatttgaattcaaaaactttttatatatagtatttctatacatctaaaatttatagacctaaagtttatagacccgtttcaaatttgaatttgaattatatctgattcaaatttgaatttgaattcaaatattttctatatatagtatttctatggatctaaagtttatacacctaaagtttatagatccaaagtttataagtcaaaagtttacatacccgattcaaatttgaatttgaatttgaattcaaatttgaatttgaatttaaattcaatttttttatatatagcatttctatccataattttttctaacttttgtttttttaaaaaaattttgtggtgtactgtagtaggaagataagatggggaggagaaaggggagaagagggaggaatcggcataggcggaggggagtgtgggtgatcgctcactcccagcgatcatccgcgcattagcaggaccctgataaacatggtataagtacaatatcaagatctataaagcaaaattaaaagcaaccacaagccaatcttagttgcttgtactaacggataaggtgtccctattttagagggaataccttatatgccatttaaaagatattgagtttctatgtataaaagaaaatatattttccttttatgccaccaaatgaatttttgttactcgtagacgccactattggttgatttttcggatgagcacacaatccgaaccaaataagaagataagagataaggttgttttgtgatcggttaaaagaatttttgattcctaaattcaagataagctcccggcctcaccaatgctataaaagagaacaaattgtaggaggagaggacactcaattcttgccctatctaatctaaaaccctaattcgcccccgatcggcttaagcactagaaggggttcgttcggctatctcagggcagtgccggtggagacctaaaggccgacgtgatctagtgaggtaaagagaagagaaacagagagaagaagaagagaaagaaaagcaaagacaggaattatcaatgtcttcaaatccgacaggtcagaaattaatttgtaatttgagagtgattgatttataggctaaagttaagatctttctaatttagaactccaacaaccactaccatcttttttgggaaaatacttattctctgatgcccaattaagagaagaaaaattgggcaccctgacattaccacagaccgtatatggctagtttcttctcattctcttctcttcactttaattatattttattttaaactatttatctaatatatgatccgatcatactattctatttatttattgtaattaaatcttcagaagaagatatcagatgattatactctgataaaagaaaatcatgtgtttcaaatcgttaaaactgccattcttatcactttctttctttttctccctccctttatagttcatattttctgtattaataattttcacgcagaagaagtttgagatgggtattctccaaacatgtaccaccatcgatcgataaataaatacatataaataaatgcatatttatcgataaatatatacatagataaatgcatacatatatttatttatttatttaaaattcaaaattttaaaattttgagtgaatttttttatttcataccttggtgcccggagaccatggtgcccatatgggtgttatacatataatctctccgtttcaggttacaatacgttttgattttggtcaaagttaaactgttagataaatatagtaatataatactaaattagtttcatcaaatcaataattgactatattttcataataaatttttcttagattgaaaatgttactattttttaaaaaacttggtcaaacataagacagtttgactttaaccaaagtcacaacatcttataaccccgaaatggaacgagtatatacataaagaagattaagtctgcaaccacctcagtagcacctgaggtcctgggttcgactccccatgggagcgaattatccaggatttatcggcgctgtgctttcagtggtaggcgacgtacccgtcgacagcgaggcgcctgtggtgacttcgtcaatctctcaagaatttgctagcccagtcttcgaagatgctcatagagatagggtttacgtgcgtgtgttcataggggtgagtgcgcgtgagttatgagtgtctgcgttgtactgtgtaattctaaaaaaaaaagaaaattaatggcgggctggataagtttgctaataacagcgggttggctgacttaacttcagtcagcatcagaaaattaattcaccctccaactgcctcaatgtgaaatagttaacgggtacgattcagtatggccgagcagcgatcagcatcgatcgtgcaatcattttccacttccaccacatcaacttggtaatcaatacgttcaacacgtaagttacgtgctgtgtatctgtgtacacgatatcgacgtgttcttcgaagaaaagccattctctttaatttcctaccggcccaaagattcgcaacaggaatgtgcaaatatctttctatctcgctccaacagtaccaattccagaaaaaaaaaattaaattttacacaatttcttccctcacgccgtcccctcgtgggtgggtcgggggcgaaaacctagccaccataggcatgccgtgcagcaggctgagaaggcggttgcggtgcatttggttgctgctgatccgacaccgtcttggctggatccagtttcccaatgactggatttggcatatccttggtgggagcagtgggcacaagtgggttgaacggtagagttggctgcgcgaccgagaccaccggttgagtcaggtgcgaccgaggcgatgcgggcgatagcaagcgctgcagctggtggcaggtctgtccttctagccaatcagacctttattttctctccatgaagctcctcgcctgctatggctagccccttccgatcgaagggagctcttttggcaagacgatgacggtggtgattggggaagagggtgctctatctgcgcggcctcgtgggagatcgcgtcatgctaggcggtgggaggtggtgctggctggtctgggctgaccatcactgtggtgccgatacgatagagttgtaggctagcggaggtcgttggttggtggagctctgggtggcgatgacaggtgcgggagaggatgtagcaggtgaaagcctagcttggagttatctgaggatgacgtgtttgggtttcgtgatccctctttgtggagttgtcgggctgccttcctctcccctcctgaccatatttattaagaccgggccggtaatgaaccattagggcactcagttaactggtttgttggttggaccggtcaaaccaccagtttaaaatggtttaaataaatgtgtgctacaatactaccacaataggcgacatgccgtggtggatgagtctttccatgggaacaaggaggtcttgggttcaatccctcattgcagcagccctcagcagtcgaaccacctctagttcggcaaaaaaccacccggtttgatgggttttcgccggtccgtttgcggagccgacgcagccttagttctggttttttctggtcgaactgccagtccggtcccggttcttataaccatgctcagtccttttggaggggcgacgttggtgccaaaggcgtcttggaggtctacatttccccacctttacggcctcccctcagcttggtcttgggtggtctattggttgttgtcacaagcttggcgtgggggatgagcggatcttcttgtctcaccctctccctgctcaaccccactacatcattaatcttttgtttggagttggttctcggtggtgcattgtgatcccctttcttgtcccgtaacgattggtcacgcttagcggtagtcggtttggtactgtgccatcttcgaggttgtgttaggagccgctagcaagcagtggtggtgtgtttgtttttggtttttcctagttacacccttcagtgttataattttgtgctccctccattctagattataagtattcgtaggtagaaatgaatggtggagggttgtgattggttgagtagtagagttaggtagaaaaagtgaatggtgaaggattatgattggttgggaagagaatattgatagagaagttgttatattttagtacaaatctttagggctaacagttttaatattttggaacggagggagtttttttttttcttctatatcaatgtgaaaattcgcattatatcgtgcaggtcgtttcgaaaataaaagtgtcaattcctgaacgccgttaattttcatcaggggaattatcgacagtaattatgcatggttaccgtgataaaaaagatttgcaggattctttaaattttttatattctttttagtttcctctggtagagttccattcttataaaaatccaattaatgtgttctttttttttatttgaggacgatggtgccaaattcggagaattctttaatatgcaacaaattaagtaatggacggcttctttttctttttattcttcgtcttcttcttcacaaatcgcgggtgaccgcaaccaaactacaaacaggagcaccgtgcatatatttcaaacgtggaaaattacaggagggaaatgcaaggtgaactggaaaaggacgtgcctcccaaccacactaggaggactaggggttctgaacatggagatgtttacgagggccttgcgactgagatggctctggcatgaatggaaacaccccaccaagccgtgggtgggactagagacaccgtgtgatgaaacggacaaacttctcttcgccgcagctaccaaaataacaataggggatggaaacacgatccgcttttgggagtccgcctagctggatgggcaaagaccaaaggacagcatgccgctcgtctatgcaatttccaagaaaagaagcaaatcgctacgtgaaggcattgaaaatgacacctggatcgatgacctggagctaaattggagctaaatgggaacactacttttacagtggaactgatcagccagcttgtgtccctatggagcgcaacccaggacatcatgctaaaccaaaatgagtcggatcacatcgtctggaagctctcgaatcatggagaatactcggcctcttcggcatacaaggctcagtgtctaggaacagtcggcaccaacttcaatcccctaatttggaaatcttgggcccctgcaaaatgcaaactttatgcgtagcttgtgattcaaaatagagtctggacttccgatcgactagctacaagaggatggccaaatagcggagtgtgcctcctatgccgtatgacgaacgagacggcatgccaccttttagcttcctgtagatacaccagaaggatctggagactgacggccaactgggtggcttatcagcaattggatccgagcaattgggagccatgccaaagcgtacacgaatagtgggaaatgttagccaataaaaggaaagtgcccaagaaagggctgcgatccttaatcctactcatagcctgggaaatctggaaagaaagaaaccaaaggatcttcgagcacaagaaaacggcggcccccaaccttatggcaaaaataaaggaagaggcaagaacctggataatggcaggcacaaggcgacttggagaattcttaccagcttaatcatagcgcttatgtaatttgtacagctcttttttttttttgcctctaggggttgtatttttttacgcctatatctaatgaaatagcacagtctcgtgctgattcctttcaaaaaaaaaatatttcaaacgtggaagactcgttacggttggacccaaatcgcgtcatgttctgactgaattttacagaaaggtcagtggacagggatatacacatttgtcaccttctcaaattgattttgctattttttctacaacatatttcttccttggttacgttgtgctcgtttttttttccctctctatacttggtcactgacatatgagcccaagggtagtgaggctcaaatgtcagtgacaatgtcccactatccacagaaatgttgaaaagtattgtatattccggtgtttaaaggtataaacgacctcacattagcaaaaatctattctcaaaaagataacgtcctatgcatatagttaaacctccaaacgttaaattaataatagaagaaaaatactacaattaaattgatctgtgaaaatgatatatatcaatacatttgtcattggaagcactttaatatagttatttctttaaaaacttttatgaatatataggatgaaattctgactagtgtattgtagattacgttgtgatctgtagaactttaacaaatgaaagagcaccccaggtacgtagtttttttttttttttgcggggaggtacgtagttttactgatgtatggtactaatagtgtggttggagaatatatattattcgacagtttattgctataaggattgtcaaatatgtagacacacacacaagacgagtgaaattgtgtaaacctcaggtcgatagagagatgcatatggatagagagaaactgagatcgacaagtgttaccggcaagggtgtcgagcagcgtagtcttgccgcagccggaggggcccatgatggccaacacctcgccggggcgcgcgctgccgctgacgccgttgaggatggtggcggccttccccccgctgtccaccgccgtcacccacacgtcctcccacgtcaggaacacgcccccgtcgagccgctcctccctcccatctccagcgacgacggcgataccgtcgaacgcgccggcgcagttgtgctccggcgccggtggagcttgtacaggaggcggcgtgtcgtcgggggcagcacgcccgcggacagcctcgagcacggtggtgaatggggaacgcaggagtttactgacgatggcgccaccgccgccggatgaacgccacagcgggcgcgacgggctcggcgtcgccgcccaacgtggcaacggcgatgtcgccatgctagctggtgagacagtacgtggcgagctcgtacaattagtcagtgcaagtgacacaagtgaaaccactagtgtgctcttccgttttagcctctccaatgaggttattttccacttgcagcatccatatccctatatatataggcatcaagtttaattagagtttgttgtgatgtctgcgtccgtcagtgttatggtggttcgtttgtaggttaggggtggtttggtgtgaaaatgaaaccatatctggcgtaaatgttctatttcttcgaataatggaatttatggaattcaatttaaaaatatactgttcattcaattttttttcacatattcaggacgcaactttttagcaaaactattccgtcgatctcgtacaatctatacacgaaaacgacgtatgggtgacgaaacggatggtgtggaagatgctagaccgaacggtctcgcacaaccaacatgcgagaccgaaagagcagtattagtgattaattatcaattagcaaattaattaatcactaattagattaactaatcactacttaattgctaatcaggatcattagtaatgattggcgtattgctgcggtatcgctggttggccgcgcggtctcgcgactttgccgcgccacaccctgcagcgccccgttacgcgagaacgacgttatattcctcctaaataaattatatcctgaatatttatgaaaaaagttaaatgaacactatatttgaaatttaattctttatttatgatctttgcttaaaaatcaatactggagaactgatctcttgtgggtaattgaaaaatcacatttgtcccgattccaatgggaaccggaacctaacaaaagatagctcttattcagtgagatctttttacttaacactcaaaatgaagcagtttgtcttcccttataaaaagatttgtaaggttaagatacctctgaagactagagtctttctctggttgtttcttaaaaacaaaattcttaccaaagataacctgtacaagagaggttggagaaaaggagataagttgtgccaattttgctctagggaagaatccattcaacactttttcttcgattgccctactgcaagaataatatggaacattgtgatatgtgctttaaacattaaaccaattctgaataaaactcagctatttggtacctggttaaccagttttgataaaaacatgaggaatatgatgatggtgggggctgctgctgtcatctgagctatttggaaaacaagaaataaagcctgctttgataacattctcccaaaagatcccattgaggtggtctatttagtcggtaatctaattaaatcttgggctattttgcagaaactggaagcaaactgaagaagattggagctgggggccaggctggtaaagcaggtggcaaatgacatcttcaactaaagatatgaatggaggccctgtgcaagaagattggaatgattctgtctctgaaatcttgtctttgtctaccgatgtaacccccctgagttctcactcacttagcttttgtctagtccctgctgttgggatcctggtaacgtttgctagtttcagtttgcttgctgacctgctgttttcaggtttcagcttagtttctactgaacctctctgcttttcttttttctcttttggtagcttgtttaagactctatgtgccgttccattaatggaaaggggggctttcaggccctagttcagaaaaaaaaaaggaaccggaactaaaaatctttttttccccggttaaaaaacccaacaccactttatgatctttagtcctggttggtgtaactgatttttagtcccggttcaaaaagcgtctggcaccctactatttttagttccgtatcaacgcgtcgtatataatcccttgcacttatcctctcctccttgatcgcaaactccacccttttcctcctcctcatctttaacttcctctcctacctttcatcctctctcctctctctctttcctctctcttatccgctccttttctttgcagcactagcaatgaggaaggagcgaaggcggtggcggccgggcgcagcggcggcggcagccccacgtagccgtgctaccagtggcccgcgcggccgcgttgtcggctctggcgctggtggcggagcgggagagggaaggtacctggcgcgggtgatgtctttgttgattatctgtaaatttattgatttgtgaagtctttgcatctgtaaatttatgatgtcaatttgagtatgtccatccaatctgggaatttgtggatgattttgtgatgtttctgtgaatgtggatgatcttattgttgagtttggttcgaaatcaatatgcaaacagcaaaaaacaatgaaaaaaaagaaaaaaaatgtagtcctggattcgttgtcctggtttgaaacctgagactaaagagcattgcaaaccgggactattgtgggttttctccagcagtgaatgctacagccaatttatacagagtttgtaggttgaatgactacgaaggtcaagaaggtcaaggcatctattctgaacatgcaaaaaactagattttcgccaggagaatcctctcctagacctgaaagtgatttggcgcatcatggcatcaccgacgttggtctgatgaaaccgtaatcgccgtatctggtcacaccgatcaatgctattgctagaatggcaaccgcaccgtgatcaagcggaggggaacagcggatgccgtggagctaacgagggccatcggcttcaccaaccccgtctggccgacaagacgtccttccgtccaacaaagggggatggacacgatgaggtccgccggcaccatgctaccgattgcccctagccttttatccgcatagagctcgtctacattgccaccaccttgcagatctggttccgcctcccacaggcgtctacccccacagacaggagaaagctgttggtgtgaaaatcgtcgtacacacgaaggcctaaaaattttgcttgctctagtgcaggtcctatcaaataaggttcacacaatgccaatacaactaacaaggataaaataaagaagattagatcaatgggccaatcgttcatggggtcgatatagtatggtttgcccatgccgatactgatggaatttcggatcgatcggctataactaatggaattcaaaagtcagaataataaaactctattggctgaaacttagatacaatatatttataaaatcttctaatattattataatcaatcttgatagatcagacttaaccgagacgggataagagtgaaaataataagatagaatcttgagtaaataaatatatctttgaatatgagctgatatgtttgaaataaaacttatcaacactctatatagaagaaagttaactgatatcaatcaaaacaagatagaatataaatcatcaaaaactatgattatttatcacaatctagatagatcggacctaatcgagacattatcacagtaactagctgattataataaatattgcaaatttaatcgatgcaaccaattataatatgttaagcagatacttcatcggctaaaactcttatgaaactatgataagaatctatcaacttgagtaaatgtaataaacacacgaaaacctagaagattagagctaagcagaatagttcggggttaacattgtgcttaacggatttaaacgagtctatgaacatttttcagggtgactgatatagaaaccataaacttagaaagcagaacgaatcagagcaagagccaatatatttgataagcaatgcaagcaaaagaagaactagtatatcgaacataaccaaggaagtactaattcccaatacaagcgaaggattttgacaaaacttactttcttgttggagattgataccgatgtagcctatctcataaacaagaacttgtcaagagcaaaactagggtggcgatgccctaaaagttgaatattgaactgttattgtttacaaagaccccaggtgcacatatttatacctataagcaatactaagtctgactctatcacgatcgaattgatctaaaactctatatctaattaaggaaattattacagactccgactcccacactactcatatcggctaaccattacttaaacatttccgattctaacacgactccataggctcataactctattaacaaaatagagttaatagagcccaaactgatccctcatcatgtcggctatcatatcagccaaaggcttctgttgaggtaccccctgaaattgctgttgcacttggtctaactagttatagtgaggcaaatattggggtagaggtgatccccctagccgatactgcacctaaggtgagtgaggctgatactagaagttaacattgccccccatgtgatgctaaggagactgatgcaccatatggatatgttgatcaggaacaaattgagagccaacaggttgatgtagttacggaataggtgattgcagtgccacggttatctgtggaatcggctcaataaccggctgccttggcctaaacatagaggcgacttgatctggagtaattcgggggatgttttgccctatatgttgcggttgttgtttgaccagaacgtgaggattaaaccctggttgccccggcgccgatgtcgacgcaccatgtttcccaggagctaagactgacactatcggctgttctggggccaaacctgagataggccgatgtttatcagaactgagagtcttgtattgtggaaaaacaccttctggaagaaaaactggtcccttagcctgatgctcaactatcgtgccatcaaccacatatttaatcatattagttaaagtattgacaagcactcctgactagttgatcaatgcgtgacgaacaacataaccaatctgatcttgcaagtttttgaactcttcaggacttccttcctgcttattatccttgggttcgacatctttagttgagcttgtccctagctctccattgtttggcagcactatcttgtacctctgaatcactgtacccagcgtgtctagacaaatgaatgtaaaagttggttctgcatgttcatcatttgttaatactctagggcaggtccaaagaattgctttcgggttctgagcgtgctagttggtatgatcctgcaagcaacaagaaacaaagaggaaacaaagttaaatccataaatgacagccgatcggctggattgccgatgacgtatcgtccaatattaagctgatgcaacacgtgttagattggcaatggaatatataagatgagaaaagctagatccacctgatcggctgtagatattaatatgtttaaaccaagtgattgggatagatcggatagtataccgagatagtataaaccacttatgtgtaaaagtacttcaaggtgaagattatatatattcatagcatagccgataaggcaaatctgacatgtatcggctagtactccgataccaccttatactaagatatcaatatagacgaaatataaagaacaaggaatcgatctaataccaggataacctaatcagaccggtaatatagcttaatatatttcaaatgagcgagatcttaatataaaaggcagatttagtataccaagtaacatataatgaacaagataactaaaccaggtaagatcggcagaaaatccgatgctatctctattagcgatcataagacaagctagatattatgattcagatcattacttaatagatcaaacctaactgatgcagcattaagcatgaagagaaatataaaatctaaacaggacgatgatagccttttcaggatgggagatacaccatataatctacctcaacatcaatatctagcccaatcgtctatcttcgatgatacgggccggccgatgaagttagatagtgatatcgatctagattatatagcatatatgataactcggagattcacataaacaagattagagtgtcatgaagatgtaagcactaatcccaagaacgtaaaccgccataacaaattttaccttttcgccgaagatcgaaaccgatgcagcccaactcgaaagcaagaactcgtcgaaacaatgaaagtagaaaaaggtggcgatgcgctgagaatattattgaactgatgttgtttgtttacaatgtatcgggtcatatttatacccaaaatacatgatatgtccttgccggacacgactctatctctattataactcaaaatatgaacaagtcccttaggcggactcttaccaaaaatatctgtaaggaaactactaaaatatcctaatgaatagatacaattgcccctaatgaatagatacaattgccctttctggattcaatccatgctttgcaatacttgcgtagagtttgaaccatcctcggtaacgatcccatgactgctttgccgggatcggctgtatcggctcctccccgtccgatcgggtaatagccgatgcagacggtagctgatacaactcttagccgatgcgggttctgtttctaaggctacagatcttcttcaaatccgtttcagttcttactttggatccaatctatgatttaccaattttggtcgttaatagcggcggcgcgcggccatcctgcgtggcgccgcggccaggcggcgtcggctcatagtggtggagcggcggtggcgcggtgataatttaaatttaactagtatatagaatgatgattcaaatgtaaaactaattaaggtgatatgactttatgaaagtagaaaagtattgagatagtttggacctagattaatcatctaaaggctaaaaataattgaggtaatataaattaatgggagaagaaaagtagagagataattgggaccatagattaatcatttaagtactaaaaataattgatgtgatatggcttaattagagaagagaaaaatatcattaactaagtgaggatgaactatagaggtacacagtatatcatgtaaaaataacgaagatatatattaaaatattatatggatcatgtgggatgatgatttaacatgcttgcattctaaaagctctaaaatttaataaattataaaattatagatattatagcatgtttacatgatgtttaaatttaatgattgttagtggatgatgatataacatctttttagtggatgataatgtgacatctttgcatgttatgcttttagagtcagtgggttatatctatatagtaagagaggattttagactttatgaaaggttgatggatgtaaaattggctattctctattatttaattaatgccatgattttcttttgcaaactattctgtactatttaattatcctcggttttcttttgcaaacctatgttttacatgattttgcattgaaacgttaaatatcactacctggaaaaccggccgttggcccatttttctaaaacatactatacacaaacgctcatatacacacgtacacactcactcctatgaatatatacgcacgtacatcctacatatcctgagattgataaagtcaccgcagacagctcactgttgatatcaatatcgcctaccactaaatatgggacttcaatccgggtagacaggttggtgttaacatctaagctccgcccatttttagctgtaattgtgttgctatatgtccttgtcttatataattgattaagttactgtgcgaacaatcaagagcttgaaattatcataacagtgggagaaaataaacattatttacaatgttgagatgggatgtactccgatcatattcataatataacagtctagattaaaacatagagccacgttttctttcaaaaagaaaacaaaagatctccgtcaaaatatattttacaaataattcaaattaggattagattattctaggaataggcggcaaaaaaaattacattttactctgtaccaaacaaaacagatatttttcccatttaaatgtaactagctagtttatttggaccacaagtgtgcaggaggccgcttcaatgtttttgcacaagaaatattcgatctccagtcgttagttttttcttcttctatatatatgcatgcctctcggaccacatcaattctttggtgtcctcattattctcctgtccacacttaatataaagattcgacagataagagtccacatctgttcttttgccgatcgacatgcttttcacatggcaatgtataccatatttgattgctgcggcgacagatgtgtgttggttctgaactttctcttgctctgcacttctatccgtcagaacgtgataaaacggcccagccacttgttgcatcccacatctcctgccgctcactgcttcgcccacagaaggatttgtattagaaaaatcaaaacttgaaggaaaaatacaacgaaatagggaaggaaaccacattaatatatatatggaatttcaaaccacacgcccttaagaaaatggtgatcacatatgcacctgcatacattccacataagtcacaattgatcacatacacttcagatatatacatccacgtacttaggccctatttggatcatctaatcactagactaaaattaatccctagactaaaaactttagtacctactgtttggatccagagactaaaagggactaaaagcacgtggaccgaggaagagagaagagagaggctgttactttagtccctataagtacctccacgagggactagtggattttagtcccaatatacatatttagtcatccatgtttggatccttagggactaaaatggagggactaatccattagtaccataaaccaagcagggccttaagcacattgcacaaatatcacaagtgagatggcataaaccaaacctcgggagtcttcaataaagcaagccaacacatgctaatttaattaaaaaacaactaactattagcgacaagtcagaaaataaagataagagaaatttcatgtacttgaaaaagtaactcgaggtacctaaattttatactatttttttatatctcaaggtagtacttagaggtactagatttgaccctagaaagtgtggtaccttccgatactttttgatggactgtaaaattacttaggctgtgttcttaccccaggttttccaacttatctcttttgttttccacgcgcaaaatttttaaactgcttaacggtgcgtttcttgcaaaaaaaaattatatacgaaagttgcttaaaaaattatattgatccatttttaaaaaaaaaatagctaatacttaattaatcacgtactaatggatcgttctgttttccgtgcgcactgtaccggttgggaacactctctagcgaacacagccttagtttgttatctactccctttgtcctaaaataagtgcagttttaccttggtcatgtccaatatttgaccgttcatattatttgaaattattttatgatcagtattttcattgttattagctgataaaacatgaataataccttatgtgtgactaatttttttaaaaaaatattataaaatttttaaataagacggacggtcaaacgttggacacggatatccacgactgcacttattttaggagaggtccggtctcaataactaactatggtatgtactcaaatactcgatgggtgacaattcaatcatcccgcctcctgctcacctcctgggtagtccagccatctgtcaattctgctacaggcagcagtgccgctctgggccagtttcttgtagcgaaagccgggacccgatccggttgagggcactcttgtttgcttgctccctgctccggcctcggtgccaccaaaactgttgttccccgtctctgcaaggagactgcgcaactggtcgtcaaggacacgacggctgaagtactgatcctgatcgagtaggagctgcaagctgggtatcctctacatatcccgccctcgaatactcgatgggtgacaattcaatcgtcccgcctccggctcccctcccgggtagtccagccatctggcaattctgctatagggagcagcgctgctctgggccagtttcttgtagggaaagccgggacccgatccggttgagggcactcttgtttgcttgctccttactccggcctcagtgccaccaaaaccgttgttccctgtctctacaaggagactgcgcaactggtcgtcgaggacacgacagctgaagtactgatcctgatcgagtaggagctgcaagcttggtatcctctacatatcctgccctgccccaagatgccatagttattgacaccggaccggactggcggtcggaccggaaaaaaccggaaccagcgcctctgccggtctggctcatctaaaagaccgcctgtgcaatcaaaccggtatagaccggctggaccgcccgattttgcagaaaaccgcctttcccaggcatacaagcaactatgccaaccaccaagccatgtgcttccttgtgtttggaacaaaggagttatttctttattagatactgaaccgctttggacctcgaccgatcagaccaataaaccagtaaaccgacggctttgccgattcaattgccggtccggtctcaataactatggtatataccaaagagcaagaaggagtcgtgtctgatgcgccactaatatctcacccctgtagcctctctcagtctctcgcgtgattcgtggacgattttgttatacgcttacaaaatttatcaaatgtaaatgcagtataactataatgtaattatattataatttgcatgtaactatgatataactttcacataattttagatcattagatttacttcaatattcatgtaagttgggaagaaaagaaatcatagtaagcacgggtgaggagattcggtcttgtgacctccgcttcatgaaaatagcatgttactggggatttctaaaagttattgcaattacattatgattgtactgtatttacatctttatcgacaaaattatagctagtccctttgtgtatgcgcagtcacagaagcagtactaggcttctggacagctgggcctaaagctaatgcttgttgggccatgattttatgaggtatattggcggtggtggtggtgggatgtgtgtgcgcgcggggggaggggtatcatagtggggttggtggtgcggaatataagtcctggcaatgccctggtccacagcatagggtatccgaggctcatgtttgcctctacggaagtgcacggatactgctgttgctttctctcaatagtatctgtcgatggagcgattcctcggacaatggagagtggagacccctccccaagtgtgaatattcaaccagggggtttgtggtgtacggcgtagaaagagatcaaagcaagagcggatctgtggagcccgagctccccgccaagcaaaagacacaggaattatacaggttcaggccatccggaggtgtaataccctactcctgtgttggtttcattgtctttcctatatcagctgagtacaacgaaggccttttcaggctacaaagcgaagtatactgatctaaagagtccaacccttcatccgtagcttgtccccttctttttatagtccatggaggggctcacattattacaaatctactccttgtcttgtgttatcagttgtcttgttgccggttggttccctaacacaatcttcgagaaacctgcattacctcgggtacctaggcttctgtccgagacagctgggtcacgccatgtagacccccgtttttataacaggaatctctcgtgttaatagtaccatttccctggatcaagtagtatggtactcacgattacattgctggaatattaattgcgattgtctagcgtgaattattacatcataagcccgcacgcagtcttagaacataggaccaaacggtccggaatacataccaaaagcagaaatagataagcagcagaatcaaggtagcggcgacgccattgccacaggcaacgaccgtaactaagacctactaagcgccgccatcttcttcaccctcgtggtcgtaagcatatgggtcatccgagacatcatcaccagcttctgatggaatttgtaaataacaagagtgagtaccaaccgtactcagcaagccaccacaacaatgatgcatatgattgaggatattcaatgaaaggctaatggtttatttgcataaagccaattttgcaattcttttcacaagcctaacacctagcataaactgatcaaattttatctctatagttcattaaacagccatggttctgtccaccatccattgtgttcccaaggatagcttcccgccactggtcgtcatggttttctggggtctaccccttctaacctctcgagaagttgatccaccagtctaaaaatcatcatgcatatcccacccaatcaaattaagaaattagagtctagccaagtgtaatacatgtcccgatgctcattaaccatgagcatggctatttgaatagatttggtttactcacactgtagtggatgtacactttacccatactcctcgactacccaacacatgagcctcgtcccaacacatgagacgcgtcacagcaaagcctttcaattacctcacttttgcagtatatgctccatgaacttatatcctcgtgcactttaggcgtcataagtttctagcagtgagaggagttctggcgttcccgggaagggaaaaacacacacattcctaacgttgcttcttgaagttgaacccagtccatatcgactgtcttctcttgggtatcttcttttagtcttgtcaagtcagtctctagccatccgtaacgggcatccgccagcggactggccatccattccgggcattcgctagcaaactgcttgtcacttcacacacctaaaagaaaccaatatgcagggatactacctccactcggctatttactccgctaggtctatacccactcgagaagtacgattgtactggggacgtttcatgtttaacttcatggctcggtccttaattgaccagggatggcactagcctttaccggacaccacccaagtcctccagccgtcccagtcgaaaatatttgtttagtttaattttctttcacaaatcatctcatcactgtcatggcaatgtggcgctcatgtctccacacgtcgtatgtcaattaccttccctaaggtaattgcccaagcataaagcattttgacaaatatgaatatgcatgggtctaaattagcatgggctaagcatttgtcaaatattgactaaagacacacgacatcatgcattacaaagattatatggataatcaatatcaaaggtatgggatgtaacaaagtaggacattcacatataaatagcatgcaaactttatttaaatcaaaataagttcgcaataggtccaacatgctcaaagattagtgataacttgccttgctcacagatttgctgacccggatctttgattaactcagcaactccttcggaatctaaatttacgtgcgaaagatttgattagaattcaaataaaatcaccaaaaattcaaacagtacaaagtaaattgagaaagtggtaccaacaattagatcttgattttagatgaatttaggttcaagtttcattcgaatcctagttaaaatgagtgagttatgtaagtttaaagattcaaatttgaattaataccaataattgtgaaatggtactgtttataattgatttatttttaatccgaaacattatccaaaacccactgtggttgacatgcgggccatccccctatttcttttctctattttattttcttttggaaaacaagctgtgtcattgacaggtgggaccggccctattgacaagggggtcaaccagtccttgtaacaaaatctataactaagttttcttagattttaataacagggaccccacatgccattatgtgggttaatcaccattaggtggaggattgctgtgcgctaactacatgtgggtcccacacggtttctatctctcgttctttctttttccccatcgtcttctacctctcgctcacgaccgaacagagtaacggcgcgcagcgatccaatggctcgagccgggacggctcggcccgtggtggggaaaggtggcggtgcatcacctgaaacccgccggtggcagcggcgaggcacggcagccatccgacgcgcggcgcgatggtgctcggtggcaccgagatcgcaagaacggcggcggcgcaatggtggttgattcgtgtgcaggcgacctcgatttaaccatctaggtttcacacggagtatagaaaaggaaaattctcgccgatgctacattggaacgaggtctccccatggcgagctcagccatggcgtggtggcggaccaagtcagcatggcaacggcggcgcacaccccaagtcgagggggccgctagcttcagggtgactaggcactgctataggcgcgagggcttaccacgggatggcgagacggcggagttcgacggcgcgcggcgtggtgcggccgaaacaggggcggctagcggttggcgacgctcgtaggtgttcgacgcctggtcttcctcattcagcagctcccggctccttccaacaacagcaacagcaacttctctccacaccccgccacccacatcggccgagaagccctgtggcggcggcgcagcccccgctcaccaggtgttcgacacccggcggcggcgcgatcttgtttctcttcgatggagcaagagttttagggagaggaagagcaaatgggaggttggaatttgtaacgcccagattttcgttcgggactaaaaatcattaaataatgtatttttagaaattaaataaaagttaaatcaaattaatcaagtgaaattatagaggaaattaaaatttcctttaaaaatcgttggccgagaatattttgtaacattctttctgccctaaaatactctccggatttttccgtaaatttttcggagctcaagaagtaattttaacatcacaaagtgcatttaatcaattagaataaaaagaaaacaaatcaaatcaccttccttccttgggccatttttggcccaagccttccttctctctctcgcggcccacatgcttctttctctcagaccggcctagctcgctccccccctccaagtttgttcccccccccaaccggcctccccctccctccggccgacaggtggacccgaggccccacctgtcagctcttcctcccacctccagcccgcctccaaccgccaccatgccgccattgccgccccacacgccaccccgccatccccctttgcgcccaagcggtggaactgcatccccaccacctcctccacctcttctctctctttcccccaaaaaaagggcgccggtttccccccgccacgtgcccacgtcgccactccaccatgccggccgttgccgcccatcccggccacgatttctccctccccgagcctataaaaactaaccccggagctctctctctctcatttttcctccttccccgagcttcccgtcgcctccctcgctctccctgcgccgctcccgcgcgctgccgatcgccggtgaccctcgagccggccgccacagccgctcccacctctgccgtgctgcaccactgccaccaaaagctgtgtcgcgtcatgccgcgccccggcatccacttcgtgctcccctttcaaccccgcagcaccatccccatcacgaggccaagctaccgccgcctgtaccgcctccagccgcacatcaccgccgtcctagcgccggcgtgccacgcggcaacctccaccggcttcgccgtctcaagggcaagcccggccaccgcctattttcccctctccaccaccgaataaccacctccacggcaaacccgaggccgccgccacattcgccgcctccggtcacactcttccgctattgccaaccactccgcgcgacactattgcctccgctggctccgccataccgcacagcccctccggcaccactctactggctccaatcgctgttggaaccccggcctctccgctcgaggtgagaatccgccgttttttctcatctccggccagcgactcacgccgccgtgagccacctctccccctcctaacagctctcctttcatcccatggtgcagccaagcccgtccgcccctttccgagcgacgcccgtcgccgaagctccgtcgcgtcgtcttcctgaggagccccgccgccgccggtcattgccgtcggccgcccctttcgccgtcgtgcccctcggtgagcactcccctccctctccctcttcctccccttcgtcggccgcctcccgggcctgctcgtgacgcgccaccgtcgccgggggctgtctgaccgggtcgccgttgccgtgctatgcacccgcgccgctgccggccgtgccgggcagctggctgccacctccccttgtcgcgccgcgtctccgctctctcgcgtgcgctgccgttgcccgcgtgcgccgtcgccgctggttgccgcgccgtcgctcggccgggccggcctgagccgtgcccgtgcactgccgccgtccacggtgccgctcgagccgcggtggaccgagtccaccgtgcgcccgtccccttatgccgctgacgtgtggggtccacctgttggcgcgcctctcccttgatgatgtcagcgccccctttttcctttgtaaaaataaatagtaattgtgcaataattcgttaataattataaaaaatgatttaaatggctcaaatcttgtaaaattcatatctaattgatatgaactccaaattgggccattcaacttgcataattcatctaaaattgagctctatatgtttgtttactttttatgcaatgtttgcttggtttttattagagtttttcctcgttttgcgtgccagcgcgtagaatccattatttcagaagtctgcggtcgcgaggaaaagagttcagaagattcttttgatgaagcaaggcaagtcacacattccccttgagcattttgatcctactttacaaatgttttaccgtttgcaaataaatatgcatgttttgctaattacaggggatccgagtattgtctatctgcttgcttgtgccttattatttgatatctatcctttgtcaaccttgggtaataaatcaactagctcatgttacttatgtgaccaagctagaactatatgcttagccatgcttaattaccactgataacaatccggcccagttggggttggccgaggcccaataacttaagaggttgcccggaccccaacagttcataggcacacctactcagggaaaggcccaatctccctaaaagactagtccaataggggaagagtggctctcccttttaaggtggcttcctcctcccaagctaagcaaggtgggattatttagaggctcacacggtcatcgccgacttttgcatctttgccagcgggtaatagtggaggatgtcctcatcattcccacccccttaaacaagggcctagctctgataccacctgatgtgctcgagggtgtcccgatctttcgatgagagtgataagtcgattggatggagtgacgttggcgatccgactacaactatccagggatgttgcgcctttgcaatcgttacaccaactccagagtgataagtcgtgaatctcgacggatgcacgatcagcccaaccacaagggtatttgttcctgcaagcaatcgagaaccagtaagaacaagatgaacatcaactaaatttgcgaatcaaagatgttggattgaatcaacagaagtaacaagtggggttcagtaacaagcaatccggcgatctaatcgatcacgggatcaactcagcaaagtagcgatgctatactttgatctaaacaaaacccgattattcttggcggtggagaaagctataagaagaggaagaggacgaccacaggggtgctggggtcgttctctcaacctaggacgcgtccctaatggacccaacttgatacacggcccattgggcctaaagaggtgacgcagcaccgtggacagaaaaggactcagtagtaaaatgaagattgcggccactctagaactgatatggacatgaagtacttgcacacctaaatcggagttcgcatgaagtcgtggcggccatcagaagttggtgctatgctgcagtccgaatccatcccgcgcaaatcctctccccgtttgatcctctccattgttcctgagtaaaacaagagtgcacgtgtctctggggtataaataagaatcatatgaatttaagaatgaatgcacctgatagttgagttgacgtgtacgagcgcgggtaataggaccatgaagttgtacttgtggaggcgtggatgtatcgttggtgttgatgtcctcaacaaccactagctcagttgatgggataattgcagtattagacctttttagtattagaacgggctgcgtgctcaagacacccgaccatgttgcattggtcgtaattatctaattaaaatgcgactgaatggtgggatgtgggtgcatggttttgctggtcgcaaccatggcaattaaggaccggttcgcgggatgcactggaagacatacagcgcttgccacaagcgggaatgggtaactgcttgacttgaagtatagctttccgctggttgacggatccaggcaagggtgagcgtgatggagttcggatgggccctgcgatggcctatgcggctttccgatttgcctaggcatgaaaggggactgcccgctgcctgttgggggcgcgggtgaaacctgaggtgtggtgtgtttggtcagagggggttatatgaaaggtcttgtcacaatcactcgacatggtgacgtgtccggccgggcatggttacatgccggtggattgtgtcttgtgggtacaattgtgcacctctggccagagtaaaactattcgaatagccgtgcccacggttatgggcgatcaaccagaatcaccgtgattagtctcagtcccaataaattgactcaatgcactgtagttcaggtggaatggttgggcctgttcaacgtggtgtagcgttgattagtggagattgaatgttaccttaattactcaatagttttactgttttgctcaataaaatgttttacaactgcctttatacaaatagccgtaaaccgtccttgtatccccttgcacgtctgcattgttggtgtggcttgctaagtacggtggttgtactcagcatttgctattgttcccccatttcagaagtgtagtgcttctgagctgaagacgaagttagaagactaaggctcaaaccccagttgagttttgcctgtggagtggagttgaagcccagctaggatcgccttttccgctgctgctgctttcgtttcggtgtgaggactaagtgcctcttctgtaagtattttacgctttatttatgtttggatctgtatattaagaggcggcattccagatgctgaaaacgccaaggattacattgctaatgtcgaggagaactttaagggctcctcgaaaacttatgctagtgctctcatcatgagaatgctcacatctcgttagaacgggaaggggagtgtgagagaaaacatcatgacaatgaccaacatggcggcacaactaaagagtatggacatgtccatctctgatggtttcctggttcacttcattatgaactcattgccatctgactacggtccatttaagattaactataacactcagaaggacaagtggtcaatcgccgagctcatctctcactctgtggaggaggaggagtgtcagaaggcggaaaggcaaagaagcaagcctaccttgttgataatgagaaaggcaaaaggaaggctgatgagatttgtgctgctgaaaccagtaagaaacccaggaactctccacacaagcccaagccaaaggggaagcctaagacaccagcttctcctgctcctggtccatcagcaagtgccataatatgcaggttttgcaaaaagccagggctcattcagaagaactgtaatggctttaagaagtggctcgctaagaatggaattgagttccgtgaggactatcgcaaagggggagcgaagtcttaaagtggcggacggaaacgaacttcatgtagaagctattagagacctttcattagttttggaaggaggccatcatttatcactagatgatgttctttatgttccatctgtcaaaaggaaccttatttctgtttcatgtttaaccgaacgcggtttttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaaagagataaaagcgagctaagcctgaaggcttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacatcacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaattgccatgggcacgactagcaaaaccatgcacccacagcccaccatgtaatgtattttaattaactaacaccattgcggtggcactaatccaaagctattgccaataatcaaagtctatgctttaatgtgaccccccttttgtgcactagttgaactaagcatggctaagcatctcctaaaccaacatctagtcattttaatacccaagttatcaaaggcgtaagggaaacaacatatagctgagtaataggacccatcccacatgatattgtaaaacaatgcaatatttaatagaaatgcaggatacttgtaaattgggtacaatatgatcaattgcaatgtatgacttgccttgctctcgcactgatgagaccacagcaacgtcttcgagcaaccacgaatcgacgaaacggccgaaatctacgcgacaaacaaagcacacaagcaaaacatgctataagactactgaaacaggaaacaaaaccatttttaatggattctatacatttttatgaatttactgagacttgaatggacttaaacggagctcggatgaattagttatgatttttagaagattctctgtgtttttactattaaagaaaagccgtaatcaatttattgcgcaataattcatcccagggctgacgtcagcataaggaggggtggcgccgacacgcgggacctgcgggtcagtgactcaaggagagagaggggcggctggcaagcgggccccaccgagcggcggctcaagagagagagggaggggcgccggcacgtgggccccactggcagtggcacaaggcgggaggggcgcggctggtggctcggctcggcttcaaagccggcaggccaagcatggcgaatgacggcggcacgcgcggtcgccggcgacggcaaccggcggcgcggacggcgacggcagacggcgcgaaaagcggcggcggcggccgaagacgacgatgcgcgcgcggaggacggcgacgcacacggaagagagggaaagagggaggagggggaatttttcaccgaggttggccggcgcgagtggagacgacggcgaacgacgacgacgagcgacgggaggacgacggcgacgggcgaacgatctccgggacctcctagggaacaaaatgggaaggattagagggagaggggtggtctacggcgggcggaaaccatggccgaaggcggcggcaatggtggtactcaccggcgcgcggggagaagcgggccccgacggcgggattggatggggatgcggcggccggggtagctttggcggcggcgaagctaatggcggcgcagattgactcggcggcggcgagcggcgaccggaggagtggaaaaggcggcggcggcgggtgtagcggtgcgggagtgatggagggcacgggagagagcggcggaaagaggaaaaaggtggaggggagtgcggggaagctttattggggctcgagagagacggacgaggccgggaggcggccggatttctcgccgacgtggggaatggagagagagagagagagagtttcgaatttgaatccctccgttgcggggtgcacgcgcgagtgggaggagtggggatggtgggcggcgacgtgggcgcagggcgcggagtggggcgcggaaggcggggaaggcgggcggcgatgggtggtggtttcggcggcggttggcgcaggcgtgggcggccggaggttagggaaagggctgacaggtgggccccacctgtcagcgcccgagagggagagggaggccgggagaacttcgggagtgggagggaggagcgggccggcgcgggaagaaatgggccgagccgacggcccaagaagagaggaaaaaggaggaaagaaaaagaaaaagaagaaaggattttttttccagggatttaatattgcactttgcttattttaattggttaaaattatttccaatgctctgaaaattccactaaaaatcctgttagcgtattttgacatgtagaacccaagaaaaattccacatgccgattccgattattatttgcatttattaatttagggtttctttcttgcctttaaacaaataatttcttccaaccatttattaattgaatttttgctagggaaaagaacttctgggcgcgacagttttagagttcattttggacacaaagaatgttttattcaatttaatgatgagattgtgggtcttgctctccagcaaggcaatctttatttgctctctcttgataattctgcaatgaatgctcatgatgttgtatgtaatgttaagattaatgagacctcatcgaaattatggcactgtcgcttaggcgatatttcgaaggggagaatggaacgtctcattaaggaagagatacttcattcattagattttactgaggacaatccctgcttagattgcataaaaggcaaatttactaagacaatgaagaaaggagcccctaggagtacgggagtacttcaattaatccatacgaacatatgtggcccattcccaataacgtcagtggatggttatgattcattcattacgtttactaatgattactctcgctatggttatatctttcccattaatgaccggtctgaggcactaaaaaaatttaagatttttaaggctcaagtggagaatcagcaaaatgttaagattaaagtagtgcgctcagatcggggaggagagtactatggcaagagtgctccatatgggcaaattccggggccatttgccaaattcctacaagaaaatggcattgtagcccaatactctatgcccggagaaccacagcagaatggagtggctgtgcgccgcaaccgcaccctaatggacatggtgtgaagcatgcttactcattccagtttgtctgtgaaattgtggatggaggcattaaagtctattgcccatatattaaattgggttcctaccaagtccgtacctaagacaccttatgaattatggactggtaagaaaccgactctaaattatttaaggatatggggctgtcctgctgaagctaggccttttaatccacatttaagaaaattagattctaagactgtaagctgtcacttcatcggatatccagaaagatctaaggggtaccggttttactgtccagaccatgtccataagtttgttgagatgagacacgcagtctttttagagaatgatcaaatccgtgggagcttacagaacagggagatagaccttgaggagattcggttctcgcaatcggccatccaacaggaaaatctaactgtacctcagattgtgccgtaggcgtcttcttctgtggcccaggctctagttgaggatattaatgaacctgtagcacaagataatgtgcaaactccacaacccactgagatcactaatgaaccattaagaagaacacagcgagagaggaggtctgctattcgcagtgactatgaggtctatattggagaagacattgggaaatcagacgatcctacttcatttaatgaagccattaatagtgaaagttcatccaagtggcttgaagctatggaagatgaattaaagtctatgggcactaatggtgtttgggatttagtagatattcctgaaagggtcaagacagtaggctgtaagtgggtctacaaaactaagtatgactccaaagggaatgtcgaacgattcaaggcaaggctcgtagctaaggggtttttacagagagaaggggtagattataatgaaacattctcccctgtctcaaagaaagactcatttagagttgtcatggtgctagtagctcattatgatctagagttacatcaaatggacattaagattgcattccttaatagtgacttggaagagcaagttttcatgacacaaccggaaggttttgttgtggaaggcaaggaacatatgggatgcagacttaagaaatcaatttatggtcttaagcaagcgtcaagacagtggtaccttaaattcgataatatgataagaagctttggatttatggaaaatgaagtggataattgcatttatatgaagagtaagggtggaagtttataatcttaatactctatgtggatgacatcttattggctagcagcgataagcacctgctgcatgagactaaggtgtttttgtcatctaaattcgacatgaaagatcttggtgatgcctcttatgtattgggcattgagatacactgagacaggtctaggggagtattggggttatctcagagatcatacattgacaaagtgctaaacagatataatatgagtaagtgctctatcacgcctgctccaatagtcaagggcgataagtttgggttattccaaagcccgcggaatcaattagaaaaggaacaaatgaaggcgattccgtgtgctttagctgtcgggagcttaatgtatgcccaagtctgtacgcgagcggacttggcttttgttactggaatgcttggcaggtaccagtcaaatctaggactagaccactggaaggctgttaagaaagtccttcgctatttgcaaggcactaagcactacatgctaacttatagaaagttagataaccttgaagttactagttactcagactctgattttggagggtgcatagacattaagaaatccacatcaggttatgtcttcactctcgcaggaggggctatttcattgaaaagctccaaacaaactattactgcatcgtcggcaatgcaggctgagtttattgcatgttttgaggcaaccggacaggcggtatggctaaagaatttcattccaaggttaagagtggtcgacagcgctaatggaccactcaccatatactgagacaataaagccgcagttttctattcaagtaacaacaagtcaagtgcagctgccaagcacattgacattaagtatcatgttgtgaaagatagaatccaagatcaaacaattaaggttgagcatataagcactaagttaatgcttgcggatccgctcactaaaggtctaccacccaacttatttaacgagcatattgccggcatgggattagtaggtgacctataagcaagattctagaatagaggcataagaatcaatcaacacccaataagattaagttgattcctatcaaggtattatagtggctataggtactgttgtcatagtgacattttattgattactatgacacattgctttggttcgctattctacttagactggactcgttagcattaagatcaagtgggagaagatcaagtgggagaatgttggttgatctcctggtaacgagaccagagagacacgtcgtggtctaggcccacccacacccacgcccacacgcggctaacggcgaggagcgagcgatacgctcgcatctcatccactacgtgcgccgatcggatgcgcatcgttctccataacggattctcccccgatctcctctagcgctatattaaaagggagaggccgtctgtgcttaggtgacgatctaagtacactaaaccctcccgataaaccctaacgccgatcctaagaagtgctggaaggagaccgaaaggcgttctccaacgccgttcccggccagtgcaggtggcggcctgaagggcgacgccatctgcttcacctccggcaacttgctaccacgacctcgacatcaccgacgactcctaccgcgactaagatggcttcaagctcaaccggtcagtcaattcccgcataagtttaggtgatcatgtatgtgctaaggataagttaatgagtataagatctaataattgtatcgtagtcaacacttaaattaataagattagccccatgtagtatttttattttcgtggttgggacgctttagataaattcatgcactaaaactagcgtttcagagcaagtttaatagtatagctaaccgttggctccaaattatctatagtcaatttaataatcaattcatacaataattacctataaatatatactacacaattaatatcttatcccatctgacatacacaaatacatcttagagtttgtgttgtagctgtagccagttgctcttctctcttctcttttatttcatcgaaacatgtttatagctagattatagtctctattaccacactaaattacaccaacgtaataaattgtattctgtccatttaatttacttataaaaataagtatctgacgtgacggccctcgctagatgggggaagccggaagcccaaagggcgtttaatttaataattcaactgctgtgcttctcctccggaaacgaagggtgactttagtcaaagactggtcaccaccccactttgcttttggcgacgaaaccctcgccgcgatggctacgacccgccgccggaccgcctctgcgattccctcctcatccgctccagccgacgagctccccggccgaggaggggacgcgctgggggcggagcgcctggagggttccgtaccggccggggagttggtaaaggcgaaggcgacgaagaagccggtcgcgttcgcgcgcgtctggtcggaggcggacgagctccgcatcctggagtgcctcgccgcgcacgtcgagaagcacggcgcgcccccgggtcgctcccagctgcccgaggtcctcgccggccgcggcctcgacaaggaggagttcaccgtctcggagatttacgagaaggtgcgccgcctacggacccagtacgacaaaatgctctccggtcctcggcccgtaccaggcgacaacaggttcgagctctcttgtgccatttggggcaaccccgtcgcgccaccaccaacctctccggctccggagaagagctcgattccggcgtcgggaaccaggggccgcagggacctagaggagctgcgtcctctgtatccttatctcgtcgatgaggtggagaggatcagcaccaatgagttgggtggacatgttctcaagatgggattggagttcatcgatgacggtacagccgtccgtatgaacggcatggcgaagaagcagagggttctggagctcaagacgatgttgaagctagatagtatgaggaaggaggtgacgaggacgttgctcaacaacatggattgacaagatcctccatcgtggtatgactttgtgcatgctgtgccccttttgttacatatagctgcacgccaatagttttaggatgcattagtactctatctattataagatggtaaggatgatccaatgatatgtgatctggtcatggattagtatatattagtttgcctagtaagatgatgctgatggtccaacggtatggatggcgtatgggttattaatatatgtaagtttatctagtaagatgacgatgatctatatatgatcttgtttgataccatcagccttatttatttttgcgcttgaaatgtcattgggccttcatatttgattggatgatttatggtcagctagttaaaatggattcagggattcagttaggcagaaagttatgtcagatgaaccagtactatattgactaaaattggaagtaacttgatgttaaggtaagttaaaaggacacttgatgttacagtatgttcaaagtagaaagttctcatatatataacaaagtaagttcattgaacacatgggatttgtgtactcgaaaaacctggaattgtatcttaagctgtcaggaccaccgagaaagatatctgaagctcccactacaaatatttggttttactactcaattccttacatgtctgctgaataaactgtgtattcaaatgcttagaatttagacgaagcgcaaagagcttaacacaatgaattgtgaggtatttagaacaattcgtccctatagatctatttgcatgatacaattttagagatcaaataagattgaatcaatatgtacgtagaactattttctatattaacgaacatgtataagtagttggtaaacgttatataaatacatttatgtaaaaacattataaatagagttggcggtggtgccagattcactgccaccaccatttgacttcttttagaatagcatagatagtcagatacagattattcttcctcttacaaatccataaaaaaacaataccgtatccgtatattttattttttgcagatagtgcctacaggcacatatagatgcctacaggcacaaatattaccgtatccgtaatatttgcaccaagttttagtaattcgcagtatcaatattgtgctgtgtgtactttatttttccttgaaaagtgctctgtggtcacttttgttttatcttttcatggggaaaatcaaattactaagaccttgtgtcgcatgggctgaaattttgacccatttatgtgtatgggccaagattttagttaaagttcctgccttgtaaactagtacatatggatgggttgggatctggcccattaaaacaagtcctgaatggttttcccggtaagaaattatatatttgttctgtatgaactcaattggttagatcaacctgatgtttgcctgatgaggaaagaaaacctttgcttcgtcattctgtacaaacatatatattttctgttgacaatactcagtgaaaaaaacacactagaacggataccctcatctcaattgggcggtaagccccatctcaatcgggcacagcgtccgtcacaggctagaagtcactgatgtgaagagttatctcaatcgggcaaacggccgtcacgaatgaatatatctcaatcgggccctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcatctcaatcgggcctaaactatagtccgtcatagatgactgatgacctcaatcgggcctaaactagagcccgtcacagatgactactgacctcaatcgggcctaaactagagcccgacacagatgactagtgacctcaatcgggcctaagctatagcccgtcacagatgatctcatctcaatcgggcatttagttatggcccgtcacagatgactataatccacaaaaaaaataaattttgtttttttgactagcctcaggcctttgctagccatgcccgctgcaaaaatgacagaaacaaacacagatatccaatatccccagctccccagcatcacccattcatacatatgcattcacatacacagacatcaacatatttcacacaaccacacattcacagccatctcatatttcacatccattcacatatttcaaatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattgttcatcattttagtttaagcctaaacattcctttggggttaattatttcgcggaggatgaagctggctatctcctcacgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatgttgtggcacacatggaatccgcactggtcacctatttgttgcttcaccgagaagtcttttttgtggatgagggtgtcatgtcctgtcttcttgaggcctcctctttgcacgtattaggcccacgcttcatctatcgctagttgaattggggtccaatcatatgcgttcttatcaattctagagttcaggtaatgacatgtactccatttaggtgttatgaccagaaggatccaatgggcactgcggcattaatatagtgaaagttaattaagtactcaaggaatgtgtcatgctgttgtgtatatttagttaacactcttactatttattataggcacacataatgtactccttgtctcggcgggaccacaaggtgtcgtagatgtagttgaccattccttgacggtcattctggagatttgtgacagtgaccacttgtggatgaaggaaggcaacttccggtgcatgcttctgacaccattgccaacttaacctacacataggatcaacgatcttgtaaggaagttaaaccgattgttattaccagaatgagttgggcgacaatacttacaaggagtagcacttaaggaggcttgtgtccaccgctcggagcttgtagaggtcgaaaagatccttgaagtcgaccacgatataatttgttggaccaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcaggaggggctgaaggagcagaggcgggtctctttggtggacgactgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccgagtcgacttgaacttttgcacagccggccctgagttgcgctccatgcactcttgtctctagggtcggcttgtacgcaagtccctcggctgctggaacagtgaaggtcggcatcaccctaactgtgagggtgcagctcgttggttcctgcgatagattaatcaatttttttagaatattatatatcatatggattcgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcagcggcagcctgggggatctgttgctcttttcggatctcttgcctaatcttggccctcatcgactcgagcttttcgtcgaatccagatgtcagctcagctcgtatcgactcccggatcttggctacaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcaaggcttgttgctcggcaaccaactccttctgcattacaatttagtggggtcaaataaactgcacgatgggaaacaatgcgaacatctagtttgattagacacttactatagcttcgtatacttgttgatcttctgcatttggcatgaagattgtgccatcatcatgtttctggtacctagccctggcccagttcctagcccgagggtgtgggatatcgccaaacatgagcggtgtgcacgattcctccgcttcttcatcctcacgctgccattcctcttccttaccggcatatccggcggtaccaagccggtgcggatgctggttcctggtctggagcaagcgatatgcctcacttctagctctggactcgggggtcgacttcttcgcatggaattccgactagacctgttccgtgatccaaggaaatttctctcttggatctggatttgccgggttgtagacgaactcgccgactagcttagtcttgaagttcttccaagcagtgcccataaccttgaaagcagcccacctgagacggtcctcatgctccgcaggataatcaaagctctccttgaacgttagccaagcaatgtccttctctgcggccggcacgagcttgaagtcgtcttgcagaatactgaatttctgcctccctatgaccccacagatagacctaaatcggctcaatattttccttggagatgtccgcaaccctacggcgtccaccgctgttatgcggaaccgttccttaggaattttgttccctgtcctaggagtacgtgcccttgaggacccactagttgtcgtcgacattggttcgccttgctgagacattgtctactttttttccaaaaaaacaaaaaaaacacaattgagtgctacaatctattacaatgaattgaatgtcacttataaaaataaatgaaacatataaataaactaaattgcgcatatcacaatgatagaattaattgaatggcacatataaataaattaaacatatcatcaaatcctaaaatcataaattcacctcataccatctattcatccacatagcatgcatctatcactaaattgattaatgcaccacattccatctattcatcatcatgtcatcaatcaaaaaaaatcattcgtttaccatatatcatcaatccctaaaatcatctatcactaaaatcatctatcactaaattcattaatgaaacacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctattactaaattcatcccaacatccacatttcatcccaacatccacattttcattatcaaccacatgcaggtagcagagggaggcgcgatggaggactcacatgaggtcggccgggggggctcggtggtggcggcggcgggatcggtggagggcgtcgccggtcggtggaggcggcggcgggctcggtgcaggaaggatgtcgccggcctcggtggtggctgctgttcgtgtcggtgaagaggcaggcggcgacgacgaggaaggccgacgccggtcggtgtagaggctcggtggcggcggcagcgggctcggtggaggcggcgggctcggtggcagtggcggcgggctcggtggcggtggcggcgggctcggtagaggcggcgggctcggcggcggtggcggcgggctcggtggcggtggtggcggtctcggtggcggtggcggcgagggaggacgacggcggcaaaggaggagttggcggcggtgctagggttctaaggaggcgggaaattgtagcgggacttagaaaaattttcgatccgatctgagaaaccctagttatattagagtgatgagtcatctcaatcgggctttgccgtagagcccgttacagatgactcatcggtgacgggctccatactaatgcccgattgagatgacattcaggcccgtcacggatgactcatctgtgacgggccctaagataatgcccaatagagatagattaatctctatcgggcttgaactaaggcccgtcaccgatgactatttttccatttcccagataagtctttatatttgtgagtacaaaatatatagctgctgtataataattcattttattagtcataacatattttcggatagtaaatgatttcaaatcgaaatatggtcaacaacaaaattgatcctctcatcaagatgtacaacttttattttggtcatttatctatataactttgtttctaacagcttgaaattgattttgacaatatgacaaatgtaaacagcatttgtgaggtcaatgtaaacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgccggctttgacaccagtgcgtagattcacccaacggcagcggaacaaaggaaccttgaacttgacgtagtttagctcccagatctcctcaatgcggctgtagtatgtgtttgacccaacttgatcctggaatgcatctatacggacgccgctgttttgcactgtgcttttgtcatcttgtttgacggtgtaaaatgtgtatccatttatatcgtatccttgccatgtgtctatggtccaagacggtcccatccccaacaactgtactgtctcatttgggacatccgtggacattgtcacacgattcttgaaccattcgttgaaccaagaattatgttctctgttaatccatgcatcagatcgccccaagttctcatctcggattttcactaagtgctcctcaaagtatgggccaacttctgcatatgttggagcacagcgtaatgagcctacgcgtacgacgtttgatcgggcctaattcttttccttccgattgtgccaacacctgacaaccttccctcgtgacgagacgctggaactctgataggatcggcatcggacatgtaattggcacagaactcaatagcctcctcggtcgtgtaaccttcaatgatgctcccctcgggtttagctctgttacgaacataagacttcagaactcccatgtacctttcaaacggccacatttcccttagaaatgctgggccacatagttttgtttgcttcaccagatgaacagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctgcgaatattcatgtcctgtagatcaaggcgcgcgttcaacccgtcctttgtcttcccgggaatgttcaacatcaggccaaccaaactctcacacacattcttttctacatgcatgagatcaatgcaatgacggacatcaagatctttctagtaaggtagccgccaaaatatggattttttcttccacatacccttctcctttgtcttgttacgttttcttttcttcccaaactcattgcttatgtccttgaccatattgtggacctcatctccggacaaatctttgggagcaggctgaaattctcttttaccattaaaaattttcttctttcttctaaatgtgtgacgtagcgggagccacctccggtgacccatgtataccatctttcgtgatttcttcagccaccggcttcatgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatggcgggaggttatagttcgcaataagaactggccaagtgctgtgagtactactcatgtcaccgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgctttgttcgggttggcaaagattctcttgaaacgataaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcatgaattctacagacctctaaccccagtggacacagaacctgctttgcttcgtatgtcatctcgggcaatgtgttctcaacaggaagcatagccttcaaaattactaaaagatctgtgaaactcttgtctgtccatccactacttgccttcagcttcattaggtccaaggtaactgacaacttagtgtgttttgctttgcatccagcgtacaaaggcgtctcgaaatcacttaccaacctgctgaatttcattccatctctctcattctgggctgggtcctcaacgtcacgtaacatgtcttgcagcagatcgtgatccacatcaaccatttcaccgcctaatggagaaggtataaacatgtcatgctcattttcatcttcctgattatgcgcaccacttctgtctgctgctgctccacttcctgattcttgctctccatgcttcacccaacatgtatagccctccatgaatcctcgttgtatcagatgaccgtgtacgtcctctccgctatcaaacatattcttattcttgcaatctgcacatggacaacacatgtaatcactgtttcttcttatccgatcctcctccgcggcgttcataaaattaattacgccctttcagtactccgtagaatgacgtttcaaatttttggcatacatccaacttcgatcaattgctaaaaaaaaaacaaattagaggcacatattataatattagtattgcaaaagtaagacgtgatgaaattgctcaattaatgatttatattactcacttgattgatccattttaatcacttttgggaatttaatttctattttccttggaaaaaggacaaaaaatcgccccctacagcttcccaccaaaatagtgaacagtgggatacagttacactaggtggtggggggtatttatactgtgcaacaaatatctgtaacgtccctaaaacaatcaaccgtgacgggcatacaagtaatctctatcgggccttaataaaaggccgtaaaaaaagagtgtcatgtgtgatgggcaataaactatctcaatcgggcctctagttggagcccgtcacagatgaccctcatctgtgacgggcttcttttagggcccaattgagatatggaaccctcatctcaatcgggcctcaactatagcccgtcacagataagtgtcattcgtgacgggctttagttttatgccgatataccatggctgtgcgaccatatctgcccgattgagattacttccttgtgacggcccgcaaattccagtcttgttatgggccgtcacagatggaaggatctgtactagtgacataagagtaaataaatttcacaaaactacatatatcgtggcttaaaattagttttcatatagttaatcgaacaaataggattaatctagtctagcaacctgaatttgtagtttatgctaaaaatatgtgaaccacagagaaacacatctgatgttcccaatttcgtatatttagttctgctactccatgccttttatgtttgttgagcaaactgtgcatttgggtgcttagaactcagaaaatatagaagacttaacacgagcttctttggcttttgcatgtcaatcatgtggaagatttgtactagttaattcctcctcttataaatccatcaaaatattatccgtttttatgaaagttctgtatatatgtattaattgttcttcatagaattttgtttacagaaatattaatgctactgccgatgtaatcttcagcatatgtaaacaatgtcatgctttctcgtaccttgatcttgtcataattcatattgcgctgtatgtctagttgtctacttttccttcaaaaacgttctgtgatcagtggtttgttttttcttttttgaatggtaatataaaataactgaggccttgtataggatggctggaatcctggccctttcgtttcaatgggccaagatttttttttttaaaaaaagtaagcggtaggagaggttcctatagtgaataaatataaataatatataaaaaagattacaaaatacatatgtacatgaaaatgggccaagattttagttaaatttattgtcgtatactcgtggatgggttggaaaacaaggtttcagtggtttttctggttagagatgatcgtattattctataagaaattatcaatcagttagatcgatctagctggtatttgccagtgtcatttggaaaaccttttctccggtaatgaatacaagcatagtttgtgtactcattgcaacaaaaacataggagtaaatttcacaaagctgcatatatcgtggcttaatttgttcagttacctatatttttctaaatttaataaaatgtaagttagagagaatcatttaatacactataatgatttacttttgcatctacgttttgaaagacgcctatatataggatacttattttcaggcgttataaatagattcctctatgagttttcattttcagatagtctgtaaaatggcccaacaaaggcacattgccaatttccacaaatagtgtaatcaattcattgtgacaagtttaaaaaaaattatagaaaagtgctgccttttattgtagtttatttgacaggaaagattctctctaaaatatcttaagctcacaccaaaagatagagacaaacactactgagtttctctaataagtttccaaaaaaaaaaatttccaccatttagtaccactaaacacacacttcttcagttaagtttcttccaagccgcagacaggattatctcacaagcatcagaagtcatcaccgtaaaagacaagcggcctctgctgctctgcatcaaaccagggagttaaactcaatatttaaaattgagaaactatgtgctgattgtctataaatatattgttgatgtaaatttggaatcgattattccgcatgagtttgaccatgatgcacatagtgtaatgaagacatgagtgtggaaatctctacgcgcatagtggaaatcatcgacccaggttacccaatagatgcataggtaaatctcatgtcatgatcacaaatagccatcacattttaagttgttgatttagatgtaccgatatatctaatcttctcatcatctggaactaatgcaaagatatgagtaccatcaactgctccaatgcaatcgttaaaatgtggccacatgcgacgatctttcctaattctgtcatggacagtaggaaaatttggattatttggacgtacaatatcacgtcccaaatccactacgacgtagagtatttcaaattttcttgaaattgtctcaccgcaatgcttgaaacggttttgtgccctttggtttgatgaaccatcacctagtatgtagagaaaaattgcaagtgcctctaatgtatgcatgtgtacagtaagttccagcttatatttactaaccaaaaaatcatttaatgcaataaaggtgtggtcattcatacgaagcatcttgtagcattcacctggtgtggccaaagtttcttgcacccatcccattccactgagacgtgatgtcctaggctcagccttatccaagtagagagagtaatagttctctgcaattcttcgagttgtacaaaaattgcttgcagcaatagcaaacaattacatggcaagcaaatcaaattcatattcttcatctgatgaaccatttttactctcactttgacatctacacattaaaacaataaatattattagaacacagatatatcaacattcatgaatatatagctgaaaataagtcagtccaatagtagtgcataacaagttcatagtaggtctaaaaataagttcacattcatgggtatacaacattaattaacaaggtgattttatccaacaatagtgcatgacataggtactcaataattgttctcataattgaatacaactgaaacaacaaggtgatacaaccacaaattgttcagaattaaatttaacccatacaaacatatgtctcaaacacatttatagttctgaaatgcattgacataacttgattaaagggatacaattcatggctacaccacattcaactaatttacatacttcacttcatacttcttcttaagccatccaaagcgacctgtaggagtgcgcaaataattaacaaacatttccctttgatccttcttgataaatatttcaattgcaatgaaatactcatttatctgttcaacagcaccacattcctccaccaaggccataacatcctttatagaacaatccggaggatcctctcttgttttagtgaaggactaaatagatgataaagtctgtgaagagagttcattactctttgacatctcctctaccatcttttgggatccactcttgttctttctggacttatccacctttgagccactacctctctttcgttttgtacttggttcatcatcctctgtctcttcatcgatctcattatcatcagcaatatgaattgactcattggtgggtgttggtatagtgccttaccataaagaccaatggttgacactggtattgcgaatgtcttcaaacattttctgcagtagctcttcattttgcaagccaaccttcataaacttggtgcatcctggtgtatcctacataacatggcattatacaatgggttagaacaattaatttggcacaatagttatcaatttaacacattatttcaaaatacttactgctttcaattgcttccaacgttccacagtagctgtaacagtttcctttgtgttatcccatcctaaacatgtttgagatgtcaacttcatccaaaaattgtattcaaccctaagcttatcccacttattcttaatttgaagcctagtgtacctcaaacctgttcttgctgcaaatttctcaatgacttcatcatacctaggattagataaataggtatttggacgattacccgcatctacttgctcaacaaaaatctcatagacaactctagtgttgtagtcattccaatcagcagagcccatgggcattttaacacccttcgaaggcccattttgagccatgcctatcatccactgactcacacaaatcttttttttcaacacaaacatatatcataggttcaaatttagtacttaacatatatcatagttactacccacacatgacatgagcagaaatcaaatgtacaaatcaatttatttttcatgataagatgaactagcagcatgaaagtaacatgagcaaaaaataaaatgtacaaatccagccatatgtttggtgtactacagccgtaataatatattgtcattctcccgtgattataacctacaatcaagcaatcaatccccataaaaattaaccaaagttgagggagaaatgaattgtgggtagccattgtcgccaccaatatgacattgtcattatctgaacttggatgtatatctatttatctgagacaaaacaactggacagtgacaattgcctaaataattctacttctagggaggtatgtgctttcaaatcattgcgcatacactgtcggaaagtgcatccttattcagaaaatatactagtaaaaaaagattatgacatgaagtattaagtgaaaagattgaagtgataatgtatgaactttcagtggtatataaggggtttaattttctcgtttcattgtattccatacatcagtcagtgctactaaggagtacatatgtatttattcatgtgctaaatctgaactatcaaattggtttactaaggtttggggataacttgcacacagatatggagaaatcccttcacaccgccgctgttgccatgctccaaaccctgctatcgtcaccgtgctgcgtgcacacagaaaggcgccgtcaccgtgcgccgccacctagttgcccaaaacgtagctccaagaggaggagagagagtagctctgccgccgtgtggcatcgcagtcatcgccgcagccgcctcctcgctcgtctcccctttgtctcctttctagcgataaggccccgagggcgacgagtggatgggaatcgcacccaccggttcaggttgatctaaggggtagtgcgatggcattttcctgtaattttgatgaaaagggatgggtggccctataattattttcagagtggagctgtggagccacgttttcgccgctccacctcaacaatacaaatttctcgagcaattcaccccgctccactccaaattttgtgaatctagaccgtctggcacagccccagctctatgtaagttggagttgggagctgacgctgtgataaacggggcctaaatgtgcaaatggtggaaatctctgctactccaccatgtgaacctcctctcggcggggcaaaaaaaacatctttgcatagaaaactattaaggaaccggcatgttggtatttcttacaatcacagattaattcgcaagcgtacggaatgccgctatatcacctccccttagagtaatctaatggtatcgaacacgaggaacgtgcatgcattatctacgatcttgattcaatccatgaacaacaaccttagaataatttggctagagaagattcctatgtctttttagttagttaattaagttaaaggttaaactctatctgtcttgctaagtccggccttgagctctatgatgtacccgaacgtgcaggtatacaaagaacaaacaatgttgtcaccaccaactgcctacctcacttttcatagagcacacaacaaacaaaggtatttttttaacctagacatgatgcctaagttattaattactattctagccatgctcaggaacttctttttttatccagagacctagtactagagcactcagttgcacactaatcgataaacacataccgatatatctcacataaataaactaattatagaacataaacaaactcaaatacttactttataaaagaagcatccaccgctgtacgagcgagagaagaaggccaataatcctggctttctccagaactccgtaggaagaatggcgacaacccagcactccataaaattctcgaaagaactctgatgtactaattatgaaactacaagtgagatgtactctacttgagctcaagtttatgtgtgttgaagtgcggaggaagacctccttttatagctgctaatgactgttcaaatggtggttaacccctcacaaccgtcattgggagttcatcccggtcttctacatgtaaggtggagataaggtgggccaagagtggctagtgggccccacctctctccacagactttctccagcagtttacaggtgggcacctatggcgattaaggatggtttggccccacttttaagtcggtttcgactgacttgtgcaccctccaatccttgtactcacatataattggccagaggttcattttaatcacatggtgggtgtattttctccttaaatgtcctgcaaacatatatttaccaaaactagtggaagtggttagtggtaaactcctaccactaagatttgatagtatatttgatacaacctctgtttcatattataagactttctagcattgcccatacacacacacacaaatatatatatatatatatatatatatatatatatatatatatatatagaaaaactattatatagccacctcccacctcagtcaaaggtcagtcaaagcacccccacatcagtcaaaacccggtcaaactgcctaccaactcccccaccacccacctcttctcagctctcgtcttgcgaaacagtgtagtaacgcgacagccatcgtgcagtaatactgtgtcttacgtgtagcaataacattaaaatttagttgaaatatagtcatgacggatctacttttgataagcattttttttctaacatcatggtgcaaatggttttaaaaaatcatacatcacatgagagatattgttattcgaagcttgggtttttttggatcttaactctccacaagtagtaatactatagcattactacttgttactactatctgttatgcgttactacaatcccatcacgacgttattgtaagtgtgtagtaaaagccataagttttgtagtaacaatgcgtcttactgcaatttatgaatagtgttactgcataaacatgtggtaacatgtaccttccatgtagtaacacttcaactttgtgcgataacaagtatatttagcatgtgagacttttaacccatatttttcttttgatttctggtttactaacgttctatatgttctacagtaacaaagtgttttactgtagttcttggatagtgttactacataaacatgcggtaatgtgtaactgtcaggtggtaacgtgtatatgccgtgcagtaacacttttacttttgtgcagtaacaagtatatggttagcatctaagactttgaacccatatatttttatttcaattcctggtttactgtaattcacaacaatattactgtcaaaagtgcagtaacgtcatatacatgcattgcagtaacactatattggagggaggagaccagttttcttgacaagagggaggaagaacgatttcttgtggaggggaatatgtagatgtattttgaagtttaaacctccacatgcactacagtatcattgtgaaaacggtattaaaaaacaatacatatcttgtgagatattgcttttcaaaaattggcattttgaactttaatcctccacatgcagtaacataatgtgtaccttgcagtaacaacggcctatacatgcagtaacatggttttaccaaatgtataaaattgttcaaaacacttctatatcaatcagacctcgctcaaagccaccaacagactttacctatagcccacctattcgatcttcatctcgtaaacatgacatagtaaaattacaattatcgtgcagtaacatagctacttggaagtgataacatacacctatcatgtagtaacacttctacttttgtgcagtaacaagtatatggttagtatgtgaggctttaacccagtaataccagtcacttgactgtaataacaacctatatattttgtagtaaccggacgcgtatcgttactacatgttttgtgccaaatactacaaggatttagcacgtatgagaagataaatttttactaagaaaactctctcacaactgagaaatagcctactggttagtgccatgtggtaatttgagttgaaggtcttgagttctattcccattgaaggcaaattattcctttatttttttctctctcaaaaaaggagagaggtggaggggggatcgggagaaagaaggggagagagggagcgagcgctcgggtggggagaaaagaaggggagaggggaggagcgctggtggggagaaaaaaggggagaggggaaggagggcaggagaggcgtgtggggtgggggaatcgggaggggaggggggcatagaataagtattctatacctcgggtgggtgtagaatagtcttaccctatatatatatatatatatatatattaatgaatctagacatacatatgcgtttagattcattaacatttatatgaatgtgggtaatgctagaaagtcttataacctaaaacagagggagtattttctgtgtaggagttgaaagttaaagtttgaactttacgttcgtcaacagaaggctcagccttggttacccactaattgggctcatcacttactatgaaatgtgaacaaggcatcatctataaatagagagttggaggagaggatttgtacacgtgagaatgaaagaaagaatgagaaagaagccacacccccacatcttgtgcctccattttttctagaattatgcaatccctcttgaactatactttagcaggaggggttgcgtaatgcgttatcagcatgatgttctactggagaccaagaaagaagaagggtaagaaattgtagatctgcatcgtatttcttgaatcgaatcacaaaaatggattcttctctccattcttgatatgttttaccactcgcgataaacaccgccaccgccgactcggagtcatcggtggagagccaattcgggtgttaagggcagtgccactggttggaagttgtgcccctcgaacaaatctcggatcgagtcatgcacttcattgtgttgcgtcatgacatccaggttgcaaggttgtaggacgcccgtgtcccaccatgatcgtgcaccgcaacatgaaggccgcgaactgtatcacgcgggaacaatgggagaaagaagaaagaagaagaacgaaaaaaggaaagaaggctgtagccccgccactcctaccatggccatggagaccgccacatcgcaccgtcggccagtgggccaccgcatggtcgtgccactcctagccccgccggcacatggtcgcgccacacctcgccatcggatggccacgtgtcaccatcctcgcatggccgcactccatgctaagcgtcggatagtgccgggctgagcctccgacatcgtcgcactacaccctgtggcgccatggcttccgccgccattatgggagggagaaaagaaagaagaaaacaaaggaaagaaaaaaaggaaaaaaaatggaggaaaaagtagcaagcagcactagctagcgtagccgctgtcactgaccacccgcaatggccgcctaccgaccgctcaccttgtgcctgcccgtatgccacctccggcaccaaccatcgtgccgccgcatcctcccatcatcgtcgcacgactacttcgccgtggctcatagccgctgggccgtgccgttgcaccctcgtacttggccgtcgtgcgcctaggctgtgttgcgccgcctcagcttcccttgcccatgcgcatggccattgggggaaagaggaagaaatgaaacatagaaggaaaaagaatctcctacgattttacaaaaagtccattgtagtttttggaaattaagcgcatatttcttgcattggaaactttacgttttatacactgaattttctagaaaatacacaaataaccctcttcatttgggatatttgtttaaatagcatttgatatttgcaaaatccactaaaaaaatgtattctctcataaaagagccaaggaattttgaatatcgatcccaaccatccaagttgaggcacttttcttgttgatgtttatgattatgaaatttatttatcgcattttttattattgattatttgtaatgctgtttttacctttaactaatatctttgcgataaaatatatagaattgcatagaatatattggaattatttgtgaaaattttgtgtaccattatattgcaacatttgtacatgttacctgaataaaatttgcacatattttcgaatgactaaagatgattggcatcgcgaactagaaagttcgccaaatctagattatccctgacatatgcaaccaaagttgaaattgtactgtagtaggaagctctgaacaccattaactcaagtgcgctctatttattaacttgatgagattgatcaagcatttctatttgatatctcttgaatgagttcactagacgaatgagggcataggcactcttttgactgcacaaaaaagtggtttaaaggattatgatgcacacccaccactcatagagcaagaactatgcgcaggaatggatattttcgattcaaattcactaagcaaacgatccgaagagtatggtaatacgatacaccgaatttgcacccaataatgtgaaaactcttgatgctctatctaaacgcgatgaaagtcgcacgcaagtatcattagtacgcatacaagaagtatgcctagctagttgagactagaattatgtaatgttcaggatagtgttaactagaagaacattgccttcccaaaccaccagcacacagttgataatgaaatcaacacgagcagcttgtctggtctgtatttacctcaacgaaagaagaatctagaacaatgcactcatgagtatgagaagaaaaggaaaagcacactcatcatgaagagaactcctagcctatttgcatggctacggatgtagaatctcctatgctaggctggatcggtcctaaaatttattttagactagaaaaacattgtcatagctgccgagcaaaaagctcactgtcaagttaattgaatccaacgtaccggaatactttgtttaatcaattcactttgtcatcgtttgttgcaatttttgaatacaatattttttcaatacaatattttttaatacaatattgaattgaataaatggtttctaccctagtagagcacacatttttctctgcaataaaggattatttctagtataaaatagtatatttgagacgtttactattttgttgctttttcctagcacatgattataatgctttgaattttgtgttgcacccaaacattaaagaaaaagattgaattgtggtccacataaccacaaatagcactttaagagaaacaggcattttttttaaaaaaaatagaaatagaaatactatggcctttgctagtagcagcaattgaaaattttggccgtgccacgatcatattacctatggaacaaatatgcactttataaaaacatttattgtactatgaacttcattgaactctctaaaattatgaagatttgggttacactacttgtttgcaataatttttctgccatattggtcttagaattataagatgtatggtcatagcacatatatgcataatttccctaaataaggaagatttgtgtgccagtatgcaccagcatgagattaacacatggaccacataccacgaaggtataatttcagcatctctgaagtggattgcatggaatacttgcgctcctatttttggtactatatggatagaatgcttctgaattagtcaacatcccgtgtctatttgaaactgcatatttgccaagattgatccaacaagatgacgtgaactcgaatgaatttcactaatcatctttagaagtccataaggacaatgctaaagtagcatttgatgattggtgaattggcatagactagcattaagtaccaaatatcgagatgaatagactaagtgatgcggacatcactccttcggatacacacaacaatcctccaacggtcattcaaggaccgataacaagagctcgcgcgcgataattgaatttagaggtgagctcgttcttatgttcttctttgtacgaatttgagaatagattgctacctaatgattatattgtgattaggaacaatggaggggacaaggagacacttggagaacgacttagagtcatggaggatcatcgaggacatccaagtcaaggtggaggcccaaaccaagtcaacttcgagtgcaattcggagtctaggaccagtctgcactaaaacgggcacctaggtcatatacatgctcggattggggcgttctttatatggatggaaagctaagaagataacatttccaatcactactaaaaaagtgatttttctgtacgagagcccatgatttttgtaaacggaccataactagtggcgtctacaaaaatcgagcgtcattttcccatacggctccttaagtggcccatatggaaaaatcgattttcccatatgggcctcttaaaatggccacaagcaaaaatgagctcatttttgcatgcggctcacttaagcgcccacatggaaaaatcaatttttccatacgggccacttaaggagccgtatgcgaaaataaaatttgaaaaaatttaaaaaattgaaactagtttatctcaatcatatgaaatccaaattagatgatttttttcctaaatgtttctaaaaccatgctctatcatgttattgcgttcatattgctattattttggtcattttttcttgtgactttgtttaattatcaattaaaagtttgaatttcaaaacttcaaataatattttgaagtagtaaatgaattcagatgaaaaagtcatcaacaacaaagttgtataactcatcaagatctataacttatattacattcatttcctcatccgacaaagtgatggaaacattttcacaaaatttacatatctctctccatagtttataaaactatataagagatatacattttgtgaacaatgttacagataactttgttggatgaagaaatgaccaaaataaaagttatagatcctgatgagttatacaactttgttgttgatgactttttcagttgaaatcatttagtatttgaaaatgttgtttgaaattgtcatattttgaaaatcaagttcaaactgttcaaacaaagtcatatagaacaatgaccaaaacaaaagttgtagatcttgatgagttatacaactttgttgttgaggacttttccatttgaaatcatctagtacccaaaaattatttgaatttcctatattttaaaattcaaattttatagttcaatcaaactcggatggagaaatgacaaaaagaaaaatggtagatctcaatgagttctacaactttgtttttaactttttcatatgagtttatctagtgtcataaaaatcgatttgaaatttaaaaagccacatacgaaaaatcgatttttacatacggacgcttaagtagcccgcagtaaaaatggtccctcttccttccctgttccgcagttcaaaaaatttcacacctaaccctatcttatcctctcctctcagtcttctctctctcactctatctcttctctctctctctctctcagaccgagagcggcgcggggtgtggcgggcacggtggcggtgccgaccgagagcggcgcggggcggggagggcacggcgggcgcagtggcgacttcagtggcggggggcgggagcggccgcgggctccagtgccaagggcggcgggggcatcgatccgacggcggcggcacgacctcacatcgatccggcgagggagaggccgcgggctccagtgccaagggcggcgggggcatcgatccgacggcggcggcacgacctcacattgatccggcgagggatccagtgccaagggcggcgggggcatcgatccgacggcggcggcacgacctcacatcgatccggcgtcggcggcccgtttcggcgtggatccagcgacggtgcgacgacggcgtcgatccggcgtcggcggcccgtccccgcgtggatctgccacctctacctccctctgtcatcgccatcgacttccccgccctgccccgcggcgcgacgacggcgtcgatccggcggcggcggcgcgacctcacgtcgatccgcgtcggtggcccatcccggcgtggatccagcggggacgcgacgacagcatggatccggcggcggcggcctgtccccgtgcggatccggcgccgacaacgacggatgacggtgggagcggtgaagtggccgacgacggtgacgaattcggcagcgcggaggccggctggattgggcggcaatgggctagggttcggctttttttttatttcgctgaattcattttcgcatgcggctggtataggggaccgcttgcaaaaatccaatttttgcatacggttgctctagccgtatgcaaagatgacgatctttgcagaaaatttcgcacatgcggctggcctagccacatgcgaaaatcgttgtcgtccgtctgcaaagacgtattctgtagtactgaatagttttggtcccacatccaaattctttccgagtcaacgggaatcgaccgaacaagttgacgtacataatctgtcctggtgctgcgtcaccgtatttgtgtctttgggccgtgtatcgtgttggaacccattagggttgcatcaagggttggttgtacgaccctaaaatatatatatcaatactcgccgtaatcattatggtttgggttttgcttagattattctgtcaagaacagtttcgtcgctagatcggtttgtggaaccccaaattcaagtgcttaatcattcatatgcaattgtgttgcaatctatcttgttcttgcttgtgttcttcgattcgcatgcagtgattagccttctcgacgaggtcaaccgtgtttcggcacggttgataaccagaggagacgtggtgctgcgattgcagggctcagtagcgtgttcgttcagaagccggatcgatttgtgtcgcgactcctcccaaatcgactgtttatcaatacctatcataagattgggacctaacatccctcatcagtaagacccgttctaatatctatggattgcagtatttgctataacattattgtaatacccgttgtgtgacacatgtagtcctaaaagtaagtggattctgatagaaaatccaatatcatttatgaggataaagtagaatatgtcacacatatacaaattgtatatgagatacgtgagaagcaaactcactaagcatatgaaccccaagttcttctatgcacataaattggataaaaacaacataatattgcggaatgagttatgtgaaaatcatgcagatttgtccactaaatcatcgttgacatcttatcttggataaatatgtccgagaaaccgaaataatgagaattagagaaatgcaaaattcagagggagaatactgttaactcattccagaattttgatatgaaaaatcaagtgcccaaaatcaatatagaaatattgaataaagaattgggtggattgtacttttcttcccttggataagttttccctacagtttttaatcgatgtttttaatgagacaattcgtacgatattacaaacatatgctatctactcatttttctccaaaatttcccagtgggtttttacggagttttgatgaggcaaatgcatcacgcagtgagagctaatgttagaaaagggaaaatgttagaaaaccactggcatgtagaagtctagcctagttacccactagtttggcccatcactaatatgaaatgtgggcaagacattgcctataaatagagttttggaggagaggatttgtacacttaagaatgaaaagaatgaataagctaagaaaaaaagtcacatcctcatattttgtacctccacttttatagatattatgtaatttttctggactatacatggttgcataataataataggcagactattttgctatttcatggcattctgaaatatattagcctactctgctttccaaccgaaatccactgcagcataagtagctttttgaaaagaaacagcagcatatatatatatatattgctctaattaaagccaaacaccagaaaccaatagaaaatggcaaagaaagttattcctaggtccaccattgctgtaggatgggacatgtgtatgagctctagttcatttggaatctttaattcacatgcactccctaacttgatttaaaatacaggcaagcatcgtcaagtttcttttttatttgtttgtttattataagccgatagggagggcacgcggcgaaacatggcaacaacatggcgacatccgtaaagtacgagttctattttcatatctatgaaacctaatgattttctacttttctccatctagagttcttcccgaagctctatgaatttccctttcccaatactggattcgttcacagtgcaccagtcgatcgtcttatacagcactaataatcaattgaatcgataggaattcagtggcacatgtcacacgcactagaagagagagtaggtaggaaccatgcatatacaactatttagtaaagatgctcaaggaagcactggatccttcctgctaaacacagccacatgcatggcagtccctgcccaaaaaagatattcattcaataaaagagatataaagtataataatacatattactgcattttaagaacggtgaggggcggcaaacaatttttttaatgaaatatgatgacccctattttacatttagggttcaattttcagcaaaagttatggttatcatagaggtatgaaaggcacgcacctacaatggaacgtcaaaaattggaccttcctcgctactgcgctgggcacctgacctctgctgcacgctcgagagcccaaaccagtactttccgcgtaaaaaacatgcaagtatacgagtgaactaatgctcgatgactcttctgcggcggttctgcgctcagctttgatcgttcgtcttatttgaaatttttttataattagtatttttattattatgagatgataaaacataaatagtactttactcgtgacttatgtttttaattttttttaaataagacgaacggttaaagttggacgcggaaaaccatggctgcacttataatgtgtaggatcgaacacaagcaaccaagcctaccagagggggtgaatggtagggaaaactaaaaacccaaaaacttttagtggaaatgaaagttacacgcacaacctgacccacattagtcacacgcactcacaccaacatccacacaacttttcaaaccaattcatcgattaaatcatttgtaaagccaattgttcatcacaaatattaatcatgacaatgatttcacaatctcctccttgataaacacattggcaacatcttcacaatgcaattttatgtttttgaaaaataaaaaaaaatcacaagtgaaaagaaaaactctccccctttttaaaagaaagaatttctcccatcaattttcaatcaaagcacaaaattgactattttaaaatcgaaacaattcaattctccctctttcaagaagcatgcattttgtatatttctctccttttgataatgatttcatcaagaatacaaatgaaaaataataaccaataaagcaccaatgcaatgatgtcatgattgtcacttgtaataaccattttttttcgagagctttgaaatgtacctaaagcaattcaaggtcatgttttgcaagacaagggagataaattaatcaactagttaacaagcatgcatcatagtataaacatgaatcaaacatattacaattatgctcaaatcaacaataaggattcatgatttcaaatgatttataatgcaatatattcacaagcacataggttgaaaaataaacactatacatatatacctattgcatttatcactctttctcaaattagctttagcacaaaacaaccaagagaattttttaacttttatttgagcctttttgctcactttttttctctcaattattccgggtacatccttgtcgtcaagactgtttctaaggattcggcacctattatttttgctcacatcgaatacgtccttgtcgtcaaagactgtttccaaggattcggtattcatttttttcatattttttattctcttttcacaatgaacaattaaagctatttgaagaataacaattcaataaagcatatacataagcatttataaatcaaaccatatgctagcatcaatattgcatattttcttaattcaagtaacgaatttaagtgtcatgcatcatctcacttaaaagaaatatctaatcctcatataaagactaaaatgcatacaagctaacatagaaacaaatagacctcaattattttgctaccatgcacaagaatatactagaggtataaaacaaatctcttctttttcttatttttatttattttcagatttaaaagcaatgtatgaaaataaacatgaatgcatgaaaaagcattaactccccctcaaattaaccttcaattctacccgaaaataaatcaagaagaaatcaaagattttgaaaaagacatccaattgccaatgacatcaccaaggttctcatgaattgacatgtatccacttgtattaaaaaaactactacctgaaatactagcatatgaaaagctaataatcgagagagtagaaccaaaaatatgtcaatccaaaactaaattgatgttacctttaaaagcaatcgtcatctcaacgttgaacactcatggggagtatgccaccaaaatacctacgaacgagaagatgtcgaggcctccgtgttggggttagaaataagaaattttggaatccaacactgagtcacacgatcagtagaaccagtaggtacatatgcactaacaaaatcagaaccagacttacctgaaaacttaccttgtcgcttcacaaaagcatgatttgaattatatgcaaagttgccctgaggccggtctgaccgctgctgtcccagcggtctaaccgggctcctcgaacaaaaacctgatttttgccaccgtcgttttccaaaagaaatttctgtttcctttttctgtttgcgggcaagtcgaaaacaaaaaccaaccaaatgtccatcttttccacaaaaagaacaagtgtacttctcacgacaagtttgtgaagtagatgtttttgaaattgatggttttgcaacaacagaaggttttgcattcacaacatttgatttcgaagaagatgcattcaaagaagacatgatgccagcagatttaaacacagtgttcttaggctcagattcaatcaaaatttcacctctcctacagtaggaggatgtctagcatgataagcataagaatcaaaacctaaaccacgattgtgtgtgctaactttagattgatcaagaatcatgttgaggttctttttactatcagaaaatctttgcaaagaacttttcaaataagaaacctcctgagtaagaatagcacaatctttgcaaacatccaaaagacctttttgttttctacaagttgagcaaataaacacctcatcttgtttaataatttcttccatgtgtttaacacgccctaaagcatctttcaacttcatctcattcagaatacactttgaacaatcttgagaaatcaaaacaccattgttttgttttgccttatttgcacatgaagcattgaccaaagaacttgcacaaaaagcaactttgtattttttcaaaacgttcttggtcaaaatcaactcatcaacaacacgagcatgtaaagcaaatccaagagcaaaagaagattccaactttttagattttttaatctcaaattccaattttttgcaattaacagaattgacatctcgcaaagcattaatttcagaaaataaaacttcacaagattgacaattatcgtcattaggaatcaaagattttaatctagcaatttcagcattaagaatctcaatagtatgatccttctcatcaagaacaatagaacatgtttgaagtttcttaccaaatttgtaagcagtatattctaattgatcataactaagcttttcttcattatcatcatcagattcatcaacatcagaacttgcattacgagcaataaaagctagatcaacaacttgcttacctttgctctcatcttcatcttccgattcatcaaaagcttttatgatttcttggattaaccactgcatgcaatgtttcttcttctcctttgtgttcttcttcttgttcacgtcatcctctttgactctcccatcatcttccttcttgcctctcctaagcttaggacaatgtgagcgaagatgatcaagtgctccacactcaaaacaacaattcggttctcctcttttcctgttcctaacatttttcatagctcgagaaaatttgttagataacaaaaccaagtcctcctcctcgaactgttcgagttgatcatcagacatggcattaaataaagcaagaacagaagacttcgacgaagaagcaccaacgtccaaagaagtcgaagacgaaaccaaagcacttgacttagaatcgactttacgagcaagaatattcatctcatgagttttcaattttgtgtaaagcgaatccaaagtcaaagtagacatgttaacaaactcctgaatagatgtaactttcatctcccaaatagacatgtcaagatcattcaaaaagtgacgagaaatctcaaattgtggataatttgcatcataagaagaatcaacagatctaagatcactcaaaattttattaaccgagaaagataatcatccaaagcttctccaggtttcatcttaaatttaatatactcctttttgaaaagatcacgatgaagttctttaatgttatttgttccctgatgaaaattactcaaagcaatccaaatctcatgggcagtttgaagatgaacaacacgatcataatcagaacgagaaatcccactcaaaagaatattgcgagctttgcaattttgttcaaactcaatttttgcagcatcagtattaataactttaggaatcacataaggatgagaaacttttctccaaatatcataattctcacccataatgtaagattgcatcctactacaccaaaaaaaaaaatccgttccatcaaaaacatgaggcttagttgaaaacctaacagaagtagccatggcaaaaactttagatcgataaaaatccaaagaagaaaacgaggctctgataccacttgtaggatcgaacacaagcaaccaagcctaccagaggggggtgaatggtagggaaaaccaaaaacccaaaaacttttagcagaaataaaagttaccctcaaatcgatggaaatctcgacgtagtcctgtcgccgccggtcggaccgctcgcacgccgccggttagaccgccggtatgtcgtcggttagaccgccgaacccgatgaaacacaaatcgaagaactctcaaagtagatgacaactttattgcttctctttgtgtttacaaagtgcaacaacagcactccttacaaaaatctcgactaaactcgaaaccctaactaaactatcaactctacgctctccaaaaaccgataccgggaggacacaccctccccctctatttatactaaaaatcctcctactcaaagtaggagtacaactcctagttccactaggactctatctttaattatcaaatcaaattacaatcccaaattgtaattctctcaaactacagccgcagccaaccgcatcggactcgatctcctgcgcttgctccttcttgggcctatcgcacgtgggccgacgtgctactgctcctggaccggctcggcctccagccagctgccaccgaagcccaccgggccatcacacatgcatggcacaacatgcatgcatcaatcaccatacatacatgcatatgctacgaccagcatacacacatatatgcatacacgacctgctacagtaactcgaagcactgtagcaccatatacttctctctaatttcttccaatctccttggtgaacactggcacttacacgcacacctcgtaaagcccgttgcgaagatcactcccacacggtatccatccaccgtgtgccatctcgtatccaacttcgtcacccggtattcttgaccgtctggacctcaactcctccccgagtttagtcccgatctccaccgttgaccgaagttgacctccaagaatcctaactctagtcaccttctcacatggtatcccgaccacagtagacctctgctcctccctgagcatagtcccggtcctcaccattgaccaaggctgacctcaagtcacctacacacaatcagacaaaacaaccgtttctgggcacagatatcacaacctgacccacattagtcacacgcactcacaccaacatccacacatctttttaaaccaattcatcgattaaatcatttgtaaagccaattgttcatcacaaatattaatcatgacaatgatttcacataatgggacggaggtagtagtttttttttataaaaaatatattttcttaagttttggacgagtaggattacttcaagatttatgctaaaatattaacctcatccgctcattccattaccaactcaattgatccctatcttgacccgtaacacgcggataagactcccctagctttgtgaagcacaactacaaactgcacaaagtgaaggatctgtttccatagcacgtagtgccgaagtgcgccttccgtccctccccttggcccgcaccaacgaggcccgtcgatcatccctttcctaccacctccctccttctacaatatatattattacacatttacctccactttttgctcaggtccgacggaattctcctaccctacctctcctcccttttctctggcttctccgactaccagattcgctgctcctatggtcctaccttcctaacaacaaggcttctcatatataccatgttgtcaatcatgtccaacgctctctctatcttcaggggactgatgctagcactattgtcaccgtcgcatcactgcctaccactagtctttcaccattccgaccatcccaataaagccaccctcaccaccctctagccacctttaattagagtaagttttatcctaacaaagtaaaataggctctatgttttgtgatcggatggactaatttattttcgattggttgatgtaatgtaagtagctagcgaggtgacatgcgtttgggagttgctggttcaaaagaagaaacgtaggtcacatcaaaattaagtactcagcttaggtgcatgacatttgattaattatatgcactcctaccaaggagcaatatcatatgcttatattacagtgacaccaaacatagattacgtactaattaaatgcactgtgcacgtcacacacagcactgacgctatatcactttgctcacgagtcgcgcatgcatgcacccggccattaaatcacatacataatacacgtacaatacacacataaaaatatacatacgtgtgtcgatcggtgtgcatgtagatataatatatatgtaaaaaccgatcggaaaaaggaaaaaattagaactcaataagagtatatatcagcagccagcagaaattaatatgcagtgacgatggccgggcgccgggggagctggatgggggatcacgaggaagggtggtggtggtcgtcggcggtgggcggcagcaccggcagcaagcccttgtcctggaggcttcgcacggtttcgtagaggcactggcggacggggacgaagtccatgccgaggtcacggaggcgctggttggagaagaggtaccccttcaccggcggcgccgcctcgtccttgcacctgctcgggacggggtactccgggaaaagcttggcgagggcgcggcagaggtcgccgcggtgcagggtgctctcggcgcagatgtaccggccccgcgcgccgccgcagtcgtacacgcggacgtgcgcctcggcgacgtcgcggacgtggacgtacgcctgcgctgcgttcacgtacgtcttggccgaccccgtcaggtacttcatcacgtgctccgtgctcgcgttcaccgtcgcctgcagcagcggtcccagcaccagcaccgggttcactacgaccaggtccaccccacgccgccgcgccacctcccacgcaccctgctccgccaccgtcttcgcgtagcagtaccagttctgcaaaattatgaagtattatatatatatatatatatatatatatatatatatatatatatatatatatatattatatgatcatgtttccaactgattattaaggtcgtgttccttattatactgaaaatgaagacgaagctagctagagcacggaaaaagaagaaaatcattagcgtataattaattaaattttaatcgttacaaacttgaaacccatataaatttatctgatattagttttagagcaactcctatatatagttataaaattttctatattccatatataactatttattcttagaagttctgcacaagtttatactattaattggagaactatagatcgattgtaagaaaagttgtagttgttagaagcgtttcaaaaagggctgaacctatatacgttattattattattaaaaagagattgcagattattttcatgtaagatgaactatctttcgtaaatatgagtaattatgaaaataatcctgctctgtttggtctcaactacagaggagtaaatgacaattctggatatatttgcgcggtagtaggtggaggaaaagtatttggggtagttaagaagagctcctcaaaaggaaatggcttggtctttgtcaacttgactacgaaacaccgatgatgaccatggaagatgagaaatcaacgtcacctctttttagccacgtttggtaaaacttgacatgcgttaaaagctttgacgaaattaagcagacagtgacaaaccatgagcatgaattcagtaatcatcatatattagtatacataagttgatataagtcgtagtttcaaagatttgaagccgtaaagttatataacctagaatcttcccagtctcgtttaattattcttttcagatgaaaactaattacttagtatataacaagttgatgatctttaattattagcttgttattgaaggcgtatatatatattccctccgtcttaatttaaactcagttatgggtttgtgagtttaaagtttgaccgtccgtcttatttaaaatttttatatgattagtatttttatttttattacatgataaaatataaatagtactttatgtattgcttttttctaaaatcaactttataaattttataaataagacggagggtcaaaagttgaatacagaaatttataactgcacttaaaataaaagctaattaatttgcatgcatgttaattaactatgcatcggaggaaagctaattaagccagctactaggtacacacatgacatgacacgacatacctctgtcctcttgcagtattcgaggtcactccagcaggtgtcgtcgacgggcttgttggggtccctgtaggggttcatgtagacagtgccgatggaggacgtgaacaccactcgcttgatgccggtgtcggccgccgccgttatcacgtatctcgtccccctgatcgccggctctatcatcttctcctgaatttgatcagatcaaaccgatttgttagttactagttaattatactgcttgctcgatcgagaccgttaattgccattgaagtacatgcatgtagtttacatacaggatcatcggtgacgggggaggcagcgtggaagacgccctcgcagccggtgaaggcggcgacgaggctgtcggggtcgaggaggtcggcgcggaggaggacgaggcgctcgccggcgccgtccagggctctcaggtggtcgttcttcgggtccactgccaatatcgtcagcaattaatggagttagtactaaaactagctatatatatcaaattaattatacactcagcaattaaagaagatcgatcaagaagagtatgtattgcagtgcgtactagggttccggacggtgccacgcacggtgtagcccttctcgaggaggcgcttgacgagccacgacgcgatgaacccgccggcgccggtgacgcacacggtgcacccatggccggagagcgcggtggtggccggcgccgccgcggctgtctcgtcagtcggcatctcgatcagtcgatctcctccctgaatttcttcgagctagttaatttaatttccctgtgatatatgttatcacgccccctgcagggacgacgacagctacgcgtgtacagttgctagctagtttgctaggtacacctgtgtcgtcgtctgctagctaagctagggagcaagctgcaggtttttgagtggtgggtgcagcggatgcaaggagacgaggcacgcaccgtggctgtatttatagaggaaaacaacacgaatatggcaagagagacacagaccgagagcgagagtggttcaagacggttggaaaaggaaaaaaaaaatatggtagggcccatttgatggaagggccatcacacaccccagttggtgagaaaacttcttttattttccttgtgcgctcgtaattgattttgttcctatccattcccaaatagtacactccttattatcattttctcgaaagaaaatatttatcatcaacatttatattgattgcgctactattaaaatcttgatcatattaaaactttaaattatcagatatcgtctataaaccaaagctgtacggatatgcatattttaacgtgcgacatatttatataacactgtatatttttaaatatttacaaattcattactaaaattgtaggccggagtgtgatcgatcaaagtttaaggacctgttcactttgatgccattttcaaccttaccaaattttgataaagttgccaaaaaagtggctatatttagtttgttgccaaattttggtaactatataagaaattctgcttggcatcaaagtgaacatgccctaaatatatatatgataaatatttgagagcagtggtagtactcatcactagctagctggtaagaactattctacgaatatatgcatgatcagatttttcacaagcggttttaatttaaattataggacatcctcatcattattaccagcagattttcttatgaccagcctatagaaatgagcctggaagtttgaaaaaaaattcactttttaatagtgcgacaaggcacctgaagactggatatagtgaattactgaaaattattatattctacatgcacgcgtgattcagaagcttctgtaggtatatgtgcatgtcaggacatatagaagcgattggcaatatagctgctgggtcgtacgtaggccatcagctttggcctttaacttggattggagttggtacccagctacccccgatcgagatatcacttagagcagccataatggttatttataggctttttacaaaagatccatgtcagaatattttcctacttagaatagattaaataaaaagagagagcaaaactatctactaacctggagatagtctatagagaaaaacgtggcaatagattagagaactatagatacccatgtagacataccattgaagtggtttactattaatctaatctattgctgagatgtacatgttttatagatagcaccttactttaccattgcgggtgctcttatattctagagctggcacgattgctacattgaccacctggcgctattgaaatttaagataaatcaggatttatggacagtaaaaaaaactaatcaccgtctacacgtccagtaatcagattaacaacaacatgatccctgattcttgtaacacaggctatgttgctaaaatatttccttgaatatactaaaatgatttgctctttgaaatatgtgaagcacgtgattaatagttgtttacacctaaatttgacacataagttcaaattaagaaaaattaccaagatttgggaaaatcgccggtttcctccacagggccggtaagaccggcggcatgtggccagtcagactggcagagtccgagaccgagtctatttttatcgggtctcaggattccttactcgcgattcattaatatttacatttctcgatgcccatgtagccaatcttgtgtagaagaatggagagtcacgtgttaaatccgagaaagtcattaattaaaatgataggttgttggattgaaatatgcctatcaaaataaatttttcagatttgaaaatatatctatcaaaagtagatggagggagtagtatatataaagatgcacaaattccttgttgcaacaagataatcaatacctagagagacaaaagagaagtatatctatagtataatactaagcattaatatagtcttttctatcgtgttgacacttgttacactgcatacgcgcgtatatacggcatcatcgcgtcactgtatccaacccaacagtgaagtacaaatacataatttctctatgtatagtttgtgaaagagtgaagtgtacgtgctatttattggatccatggatattttgtgtaccaccatgaaattaatagccataagaatttattttgggaattagtctgtcggaaaaaataaaattctcagtgatcttttttctatcgtcttatttgaccattgtatacatatccaaatggaacacaaaaatttgttttttttcagcagctcctaacttttcggtgtagactagctacgagctattcatgaagaacagtacgaatgaatctatcatattatcattaagaagatactggctagctaaacgtacacttttcacctagctagctggacttaaagcacaagggatgagccgacgatcgaaaaaagcttctagaaaaagttgatataataatgtgcttattttcctgcacgacggtgcaatatattatgtacgatgtgaacgtgacaattgaggctttgatgccttcagctttactagtactactagattttcctttcaacttggacgtcgtctttttgaaaaagatcatggctagtgcatacatagtgcatctttatttagcacgctcaatacgcaagaaagcgatcgaacgtgtagaaatagaatcaaaaccggatatataaagctatagcatgcaagaaattaaattaattaagctgaagcatgaacaaattaattaacaagcatctctttaatacccaaaacaagcttttcttgcaccgatcgcatgcatgcatgctaaaagattcacgccctggaaattagcacaagacaaattctaaagtgggaaatcgggtatacttcgttccagtagttcttttttcccacaagttgagttcccttcacttttcggtcggtaagatgtctcctgttttttctcctcttttgccatttggccctcggaggcttagaatttgggatcgtgcacaccaattagtgagcatgcatatgggcactagaatatacaagcgtacactatatgggcatatcttgagattaacgaaatcaacacatgacatcttaatattgatatataaatacgtcacctgccaataaagaacatagatctactagaaaaataatttatcgccacgaaaaaaatcgtagcataatgctaaaattgtagcaataattacatgttgccacaatcttaaaattgttgctagccgtggttataaatagcgttgtaataggttattgcaacgatttttatttagttgtaacaaattttgatattgccataaaatggatgtggcaaaaaaatatattgcaacatttcacatcgttgcaatagataactattgccaccactccatgtgtggcattagttctacgtaccaaattaaatgttttaataaaaatatattatcctaactattttcttttgatatgttgttatggctaggattcgaacccaagatctctccctcacgcgcgctctacattttgtttacaaatgcatatcattctatttgagcctgccgatctgagatttgaatcatgaatttgagtagttaaaagatttcaaataaaaatagttaagttgtagaggactaaattgcatacaaaatttatctaaatccgtgcccatatgaaaagaataagttaaattatgatatgctaaattttttattgcaacgaatttgttcatcgtggcaacaaaaaatagtgaaaagtgccatgtactatgcaaattgccacataaattaaaattgtggcgatagaacacgtttttttgcaatagtaatgttttttgtggcgatagctcatttcctattgcaacaaaaatactgaataaaaaatgtttgtatatcggtgcaacaaaatatagttattttccacagaaaattatcattgcgatagtacaatataattatttttcattataataaattggtggcgatagctcaattatctcgtagacagactccactaccataaacctaaccaattaaccaattaaattactctagctagctaccccttgctagtaatttgagtaactctatatacactactagaaaaaagatattctattaacaggcccatggagaaatcagcacatgatgtcttaatatcgatgcacatatcacctgtcaataaagaacagaacgtagaaagattacagattacagcacaataaacctaaccagttaaattagactctagctagccgtcccgtgctagtaatttgagcaactttatagacactactaaaaaaataattttctattacgaggcatatggattttgcaggtgtattttcaaccgcgatgattcgcctgcgtagttgtgatgggggttcattggctgttgttgacacaaaaaaaaatgaagtcctgggagatctgcttagctctggtgcaggttctaaattatttatgcggacgtgctagtcagtatgatcctgcaaataacaagagagataaattgatgatcaaagagtcgatcggctaacaagctgatgtaacgatactagccgatgtcgtaaggtaatttggaaccatgccattataattttgcaaagtttgagatatgccatcggtatctcaatgacatgtaggacccatatgagtcaatgacatatgggtcaggatggcatatctcaaattttgcaaaattattatggcatggttctaatttcccctaacaatcggctatatgttcaatatagattttgatacttggatcaaatgatataaaggcaatcagacaagcagtgagacttatagtcatacaacaatctaatccaatagaaaccaatcggccaataatggtatgataaaataaatgttgatccgatggttaaagcatatatcggtttgaaatctgacgtcattaaatctacatgattaagtaatcaatgaaacatttgctgcaattggctaaaatcaacttgtatataatccttataagccaatacaacacttaaacaatatctagataactcatcagctgaaacctcagtgaaacattgattgatgcctattaacttaaataaatataactcacaaccacaaccccataggtcaaacccaaccgatgcagcataaggttgataattgtctaatagatttaagcaatccaatatgacaccgatcaaagtggtcatgcattaaatttaatgaagacaataaaaccacacatcaaataagatcggctaaccctccgatgaaacattaacatgaacttatcggcttaacaagatttaaattaacaatctagtaggtcaaacctaaccgatgcagcacgagattgtatatgttaatctaatattcaatgagtcgataaatctttctaatgtgatggatagaacaaatctatctaaagtgacattttgtttaaagaaacattaacttgatcagaatataaatagtaatggaactaaagatatagacggtataccacataggtaacacttgcatcggcccgattagaatatcggactcaaccgaggaagtcctagccatgccaatgcaagcgaagatgatggaactcacttcttatcggaggtcgaactcaatcgatgcagcccatgtgcgaaaccaagaactcgtcgaaataaaacctcgtgggagtgtggcgatgcgctgaagatagacatattaatatgtgtagatagattacagggacctcggtgtacatatttatactcttaagctaataagagtcctaattgtacacgattcaaactttcgtaaagataaaagaaaatatacaagttctgatcgaatactaaacatactttcctaaaactaaaaggaaactgactgactgcctaattaatagataaattgccatgccacatcctccttaaagtcgacctcttctagatatgattcctttaaaattgattaatttacttaaccaactccatcaagaatccaactgctggtgaccgataatttctatcggatcattctaagactctgaagccgatattgtctctaggccgatgacaactttggagtttatcaaaatttggcattaacagctggccatttgcgaaatccatttttgcatgacagacggcttaatattataatgattaagcttctaattgtcctttttatatttttctaattggtccttctagtcatgttttatctagctccacgtaccagaccgtggttgcttctttttcccttttctctcaagtttggagaacacatttgctgcagctgtttttcttatgattcatcatgtgaaaattgtccgaatgaccggtcatgaggtttaacttgaagattaaggtagcttacattgttagcatgaacaattcaattgtcaatacaagttattcaggagttcatattaaaaaaagctatctaggttaattgttcaactcgcttcgtcaaaaataaaatatttgaacgatatacaaactgtgcgttgctagctccaatatagagaatggttgacatctcattaatttctcgtttaaaattcccatcttaggtcatatctctaagaaaatgtatagtagaaacaaataactcgacaagctgaacctcaactggctaggttccttgtggtggaaccaacccacccgggttcaaaccctagatttgatacgggtgctcgcatttacggctaattattctttcagtggtaggtgacgtacccgtcgacagcgaagcgtctgtggtgacttcgtcaatcggaggtgctcataggggtagggtgtgcgtgtgtgcgttcataggggtgagtatgcgcacgttgtgagcgcctgcatttgtacagtgtttctaaaaaaaagaaattactcaataaatcgtaaaaatatatactattaatgggtggctccaagctagacacaactccacgaaaatgattagattcctctgcttcttgttcacaagtgagcacttgcggcaagtgtatccctcaccacacaagagcatgtagctagtgacaaattcaacacgggcatcacgttgttttctacaaaagaatccaaaagtcgctcatgaattgtttttccaaatggttgttggtagcagtagcatagaaagcatgcgatatttgacgcaagtatgcttcaaataatgacctgcctgaagaatatataatgtattaattatgcaacatgcatgttacaatctattagaaaaatacacataccatacttggttgcattagagatacaaccaccaggtacaggaattcactattctacgactcatgcagctagcactcaaccagcttttcctattgtcaatgaaatatttttctaaaatctagcagagtttgcaggtgtattatgacaattttgtttagggcaactgttttatagagagtctagtgctttggcgctaactgtgtttgatcattcagtataaattgctaattaataaagagaatttgtcctcgaatataaattgctgatagagatattgttgcgtttcaacgaaatgtgccgaaagcaaaaaactgtataactgaatttgatttctccatgccacaaattttcacagttgtgctagcttccatcacagcttaaaaaaagtaagaaaagcgtagcacagttgccacaaaagaaccctaaaaatctccttggtaacgatctttgctattactacattcgtcctatataaaggattttgtccatattgttaatgtgcaaaatctattgaagtttgggacagagatagtatttgattacagttacgtaattaaacattataatagaccagttttgaaccttacaacataaaaaaaagattagctcgctcattaaaaccaaacatggaggtggccggggtggaagtggtgcatttactatttgataatagtagcatttactattataactactaccccctttatattattataagtcattttgatttttttctagtcaaacttttttaagtttgactaaatttataaaaaaatatagcaacattttcaatacaaaacaaatatattatcgaaatttatttagtattatatcaaataaaactaatttggtattctatatgttgttaaaatcttctataaattttgttaaaagtgaagaaatttgattagaataaaaatgttaaagtgactaaatataaaacagaggaggtacaaaacacatcatcgtggatggactcgaactctcatcccagagaattttccgaactaaattcatatcaatatgcaataattaatcgaagtagtatcaaaccagtcactgtcatgcatagactgttagaataattgggctaggcccaacttataatattaaatctcaaaggcccataataaatgttgaggataataataccacctctggatttaagcgagaaatatctcaacctaaatagggagttattggaggctccctgttgaccagttgaggtgggggtcggaatgccacgcgcgcgcgctgggccgggccgtgggcgtggctggcggcgtgcgtcacgtcactatccttttgcagccactaacccacgttcccacgattccctccgcaacagcgcgtccacgttctttctcctgatagataaggaggccgcgagtccgatccgacttcttagcttctttcccggtgttagtttctccctctccgcgcctgagttgctctcgcttccccgcttctgatctcttgcgcgcacgagagattggaagaagcagtgcctccgaaaccacaccttcgcctgagatctacaccgggtaggcgggtgatcaggtttttggggagtgcctcctgcacgactgctcatcgccatgtctggagttgctgctgccactactggcggaggtggtacgccgccgccgacaggagctggatccggagctggtgcgccaggaggaggtgccgtgaacgactacaacaacagaggcaattctgcctcaccatccagcgaagggccattctcggggtataatcttctcctcctgctactgctgttagcgctatactatgtgagctatgttcttgttcctgttctacatgatgcctctagcatgttatcgcgttactggtatgttcctgtttctgacattcatgatgtgcatagtatgctactggttatgtctgcttatgccatgatcattgtttcaatttcttggattaaaatatgccgaataatgactatatttccaacatagacgacattattctggtcttgagatcgacataaagagtctattgtggctgctgctgctctatctctcgtccgttcgtgtgggagtctaccacatgcagtatgcagtcagccaattgcatccgcatctagctattactcttcacccatccatgccacgagcgattgcacaccaatgtatgccactgccgccaaagcttgagccctccttcgcatccccaccccgccccactagcacgtacgcacgcacacccactacacgtatcgacgtataatgccaatatagacacatgcatttcaaaacgaaataaagatataaccaacgtattattgtgttatttaaattcagaacctatttggtagagcttaagcttcaactttatctcaactggagctggagcccaatcaaacagtttcaacttcacccaaaaatgagtggagtgggctgaagtgctctcacgaaataaactagagatgcggagctatgttctgctctacaactctatacagactcaactcttgtagttaattttaatttaatctatgctattgcaactttgttaaattaaagaaatactactactattcacgacatcggctagttgccgtcggtattttgtctaatttgaaccatgccattatatacgtctcataccaaaattcccctagccctcgtggtacacacctatcaagtttctgtttttccccaactcttcgtcttgctcagcaagatcggtgtcttgtcgtgagcaggatggcggaggcggcaacagtgacggtgatggcactagagctcgatgaggccgatggtggagcgggagcttgacgaagccaagccgtgcgtgggagctcgagggggatggtggcgggttaggattttgactgaagatggaacgggcggcgggtcaagagctgacttagacaacatggagccaatgaggacaacacgaagatggatcttcttgagacaccactggaaccgcagccacctggccgagtgccaccactcctactacttgctccgccgtcgacgcgactgctgccgctcgctttgcgatcgacactaccacttgctccaccgccctcgccgccgtactacaacccactgccgtcttgctctcgagaatcttccagcctcgccgagctacatgaatgactagggaagaagatagtaagttaaggtgggtcccacttgttagcctctaaggctaggggcattttggtccatatgaaaatacggtatgaacaaacgtagtccaaccatggttgagatgtatataatggcattgttcaaattttacaaaatactgatggcaccccgtcgatatcgcgactactagtgactttttttaaaaagtttggtaaagttgcaatgacatggattccaattaacccttaaatttaagagttggagccctaccaagcaacccctctgttggttttctcccatccttacatggatgcatacctctctatgtacaccaaaattaattttacaaagttggaatatctttataattgtttatgtattttccttgcatttttaggaagcatagatatttgtctcgatgattacgaagttatacctttatccgacgttttatacatatatacctctgaactaacactatgaggggtatatagacctaactatgactagaaacgtgatatcctgggccaattaggatatagtttgtgtggcccgttagagctatatgcgcatgttaataccaccttactagtttagcaaaggtggaaccaacttataagggttcttcccttcaaccacatcactcttgaattaaagtttttacaaaaatgatgctaaaagtgtgagtgggtctgtcgtcggataggctgggttacgtggtgcagactgctaaaaatggtattagagccaaaccttacagttgcacgggtgtatgtgacatcctgatccacttaggatgagacatgtgtggcccataagtgctgcttgtacctctatccatataattcctatgttacctcttttacacgaagcaagaatgaaagtgtaagtggggtgatatgtgtaagtaggctcacctgttggattggctgggccgcgtgatttttgaagacaggacgttatattaaacttgtttttcttaccagtttaaccatggtttaaatttggccagtttatttttttactttaaaaataacagaaatacctctccgagggaaaactctaaaaaaacaatttggaattgaaaaataacaaaaaatactaactagcttgtttgtatagaattctatttccatgtcccaaaaaaataggggtaaagattaaatgatgtgtaataggggattaaattctttatcaaatatagatgtatgaattatctgtttgacggctaaataataatagaagaattctataaagacaaacagttttcaggaatcgtgctacctttctgaggagtatttcaaaaactagaaattaatttaaagaaagtgttttattatgatgggtcaaaactttatgtaattcccaccaaatttgatttagtattaattgtggcatatacattaataattttttaattaaattgcactaagggactgttcagattatagccaaaataaaccttactaaattttggcaagttggcaatattattttttttatgtatttatcaaagtttggcaacaaactaaacatagacacttttttggcgactttgcaaaaaaatggtatggttgaaaatgacatcaatctgaatagcccctaaacatcctttttcaatattttgtatcatggattgaactttatatatatgcaagtgtcattaaaaatcccttgtgaaaagtcagtgttgttacatgtttgtgtaagctaaattttagtttttgctgttttcataaccttactctgtataaatattatatattctacatacagagactatataatgatatatgtattgaaagattatacaatctattaacttaataaagtaataaaaaaggagtctccacgttcgctctcatggtctagaagttctcacattaatcaaaagaaaataagagaaatagaaaaatcgaaggagattaggattaggtagaaacgaaaaagaaagaaagaaaacatctcatgacacgggaaaacggacaaggtctctgaaataagtgtgaactgggtactcctataaactaaatgtaatcaatcagtacttgtcatgccaataaatacatctcatagcaaaacacaagataaccaaagcaagtcataaatcaaaagttcaaaattaaaaaaataagaaatattggtagctagccgcgtaatctgcgcgggtcaccatgctagttaacaacataatagatatataccaggtcaataatagattcgaacaagaaaaaaggagtctccacgttcactctcatggtctagaaattctaacattaatcaaaagaaaataagagaaatagaaaaatcgaaagagattaggattaggtagaaacgaaaaaaagaaaaaaaaacatctcatgacacgggaaacggacacggtctttgaaataagggtgagctgggatacttctataaaccaaatgtaatcaattagtacttttcatgccaataaatatgtcggtgacatgggatcaggagtatcatgactagaggtttgaggcagacacaatcgcccacgtggcctggcaccatcgggggacgtcgggcccgagggtgatgtgttcgccctcctcttagtccccccgagggggtcgggccggacccgcctcggccccgagggccgaggcgccccgacccctcgtgggttntcgctccgcgtgtatggggtagggancncacnngggctcacctaaccacatttattgcgatttggctgagcgtgtcaagccgcatgtaacgcagtgtagtgcactcatttatccggtctgtgaccagtcacagaccggtcagatcgcgggttaggtggcgacaggcgatttgacgcacgcctcgccccatcctgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgactccggtcatgtcgtcagcagacagtcacgattccacgtcgcatctgctcccggcgaaagtggaggtagttgtgagccgtcccatcagaaggtgactcggacggcaactatacaaatctccgtccatttatgaaaaggtaggggaagtccccacaaaaaaggggaaaatggtgcatgtggtatccccttaagatataaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctctcgcactccttcgtgtgcgccaagcttttcctgttcagcccaatggccgagccagcaaaggcgcgcgacctctccccgagtatgagcggtgacgacggggagcaaaacccacgccaccgagctcgtactccaccgccccctccacgccaaagtcctaggcaggagaaggcgctcgagagggctgaaggatccgcgacttcgacatccacaggaggtggagaagggcggcgagatggggagcgtcacctccttgtctacggcgacggcagcacgccccagggcgcgctccaagctgcaggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgccaccaccggctccgcgtcgtcgagacggagggcgcggcgagcggcagccgctgttcgccattcggccgccactccttcgtcaacgcctccgacccgggatgatctgcgtggggaaccggatgcccgcgtcagtatcgagcgccggcgtaatggccgacgtgctccccacgcaacggagggcacctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggtgcggggttggctaatgaacttgccacccgcatctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggtagcttcgaccgcccccggatccgctgctcagacagggcggcgtgacaggaggaggaagaagaggtcagcccataccgacgacgagggtcatgtcctcgccgtcgaggccgctttgcgggccacccgaaaggggaggcctgcgggcgacaaaaagaaggaggccggcgctcccagcagggagcgcccaaccggcaagtggtgcaccgtccacaacacttcccttcacgacctcgcggactgccgcgcagtcaaaagtttggctgagcggacgaggaagtgggaggaggagaggaggcaggagcgccgagagggcaagtccccggcagttccttccggcaatcgacgaagtgaggctaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccgtggaggacagatcgcaatggtggtttcccccactgtttgcaacgtgaagctggggcgtgtcctcattgatggaggagcagccctcaacatcctttcccccgcagcctttgatgccatcaaggccccggggatgatgctccgaccgtcccagccgatcatcggtgtgacgccggggcacacttggccgctaggtcatatcgacctcccggtcaccttcggtggacccgccaacttccgcacggagcgggtgaactttgatgtggcggacctcagtctgccctacaacgcggtcttggggaggcccgcgttggtaaaattcatggcggcggtccactacgcctacctccagatgaagatgccgggccccgatggccccatctctctccatggcgacctcaaagtcgcgctcgcttgtatggagcagcgtgcggactgcctcgccgtcgtaaccaagcccgagggtggcgatgagaggcttggcacatccgcccccgtcgccccgaggcagcggatagtcacgtgcgatgaggtcccggtcaaggaggttgccctaggcgacggcccgtccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaacgaccttaacaaggcatgtcctaaggatccttaccccctgcctcgcatagatcagattgtcgactccacagcggggtgcgaccttttgtgttttctagatgcatactctggttaccatcagattcgcatggctaaggaggatgaggaaaaaactgcgttcattacccccataggaacttattgttatacaacaatgcccttcgggttaaaaaatgcaggtcctacttttcaacgtactactcgaatttctatgggtagccaaataggacgtaatgttgaggcttatgtcgatgacttggttgtaaagacgcgcaaccaagaaaccttactctcggatctagcggaaacttttgaaagtctccgctccgcccgcataaaactgaaccccgataagtgcgtgttcggtgtacctgcgggcaagcttctcgggtttttggtctctgcccgaggcatcgaagccaaccccgagaagatacgagctatagagcggatgcgcccccccagcaagcttaaggatgtgcaatgcgtcactggttgcatggccgccctaagtcggttcatatcgaggctgggagagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtatagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaagtcatcagcacagaagacaagtgcgccccgcgagactgcttggacgaagattgccccagggatgcggcccctagcgaagaggatcggcccaaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtaatgcagttcgacggctccctgtctcttcagggcgccggtgcgggggtcacgttgacctctccgagcggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacacctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatacgcctgaccggcccccaaggcctgtcggagtccaggcctcgggacccgaggggagtgctcccagttcccttagattgattgcttggatcgccgagatccaagcatacctcacagataagactctacccgaggaccgcgaagggagtgaacgcgtccatcacatctccaaacgatacgtgctggtagaagggaccctctatcggcgcgcggctaatggaatcctcctgaagtgcattcctcgggaacaaggcgttgtgcttcttgacgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactacggcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcactaatgtgggagggtccgtatcgagtggtcggcgtcccccggccgggctccatacggctggccacgggcgacggcactgagctacctaacccgtggaacatcgaacaccttcgttgcttctacccctgaggggggggtcgggtgtcaggtttcgggctcgggccaaccccgcaccccctcgggcgtgcagggttggccgggggctgccacacatgcacattcttatttctttttttcagtatttcaataaaagcagtttcaatttcctaaaggctgtatctgtgctgttttttccttttgaagaatcttgacttgaaataggtcactcgcgctcaatcctgccctcgggggctcgggtcggctaaaatcgccaagcggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcctcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggttggcggcatcccagacctgcgcgcgcgcgcggtcctcggtcccaggagggaactcatccagcgccatccatggagaaaaattggggtccctggcctggtaactcgccaggacgagctccaccgccccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccctgcagatcggcgatggtgtgttcggcagctgcgaggcgggcggctaagtcgctttcgcccgcggccgccccgccgctgcgcgccctcgcgtccagctccttcgcccgcacctcgagctcagcggcccgttggttcagtgcggccctctcggcgcgggcaccttccaggttatggcgcgcctgctcctcctgcgctgcctcgcggaggacaggctgtccgccagctgttgcgccgcggcctcggccccctcgagagctcgctcccgctcggtgagcgcgtccttgcggaggcggagcgcgagctcttcttcggcgcaggcagcctcgtgcgccgccagcgttgcttcccggatggtgacggcggcctcgcggtccgccagatcgctctccacgacgcaggcgcgctcttccagcgccatggcgcgcgcctcaagggcctcttcgcgccgccgggacgtcgcttcggtctccgccgcccgctgttctcgggcagcggcagcgtcaagcaccccttgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcatcgcccctcttcgacacgcgcccacgcggcgtcgagctccgcccgctctgcctgcagggcctccacctgggcacttaacccatccaacaccgtggtgtttgcggcggccaaggcctgcagaaggggctctgcgttcagtggggcgatagaaggcgtggggaagagccgccttggaaaggatgccatgcggctcgggccaccgatggaagtgccggactcggggatgttccccggacccgtttggccctgagcgtcgcccgagggagtgggcccaagcgacgtgcccgtagcctcgtcgccagctgccccgaaagttgtcgcttgagcgtcgcccgagggagtgggcccaagcgacgcgcccgcggcctcgtcgcgggctgcctcggaagtcgccatcgcctcgtcctggcgaaatccggctttctcccgagcggcttcctcggcctggcgggcccgggcggcctcctcccgagcggtttcctcggcctggcgagcccgggcggcctcctcagcttcccgtaggcgatccgcggcctctcgccggtcagattcccgcctccgggcctctgcggccgccggatcctcggcctcagactggccggatttggaatggcgggagggacgcgacgggatctcgctgaaacaaaagaaaagaccagaagacgaacaagatgggttagtgaaaactcatgttgagagaatgaatacagccacgatggatgagagacgaacctgcgagggggtcggttaaacgaccactttggaggggaaatgaggtttccccgagatggttctgtctcccccatcttgcggaaccgcttcttcttgcgctccccctcgggctgcggtgtcggcgcggcccctccgggcgcctgctgttagcacgcaccgccccgccctctcggggaggagatgggggaggtgttcctccctgcttcctcttcccccgggcgtcggcagggcggctgctccccgggcccctgtcgcgggacccagaagcacgaccccctcccggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgaaggacacctccacggagttgagattcagcacccgttggaccaatatcttgaagtcctcaggagcccagtcccatctcactccctggtgggtcctcatgaagtcttcggacccggtgtactcccaagcgccccgagcgcgccgctggagcggcgcaatccgacgacggaggtagtcgccgtacaccatggcccctgtgagcccctgggatcgcaggcccgccagacggtcgaggatggcgtcatagccatccctcaaatctaccggcgcccgccagctggaggcctgcgccgggggctggctcggaagtcggtggcgcgcttcgtcggtgaggggggtgtagaaccagtcgctcttccagtcgtcccacttcttgcggagggcgcaggggatgtagcgattcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactctagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcaggaaggcggcagcacgctaccatcgagcagagcggagcctcgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcctattcgcccgcttgcggcgcatgaggtggatatgcggttgtggcagtcgagatagatcatatcgtgcgcgcggtaattacgctcgccgaccgaagcgacgttaccatatctccagacgaaacgaatcgccatgtccagattcgtatgctactcgagtaatgtggcagtcttgaagagaccgctcattattgacagccgagttaccactgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacacaatcgcccacgtggcctggcaccatcgggggatgtcgggcccgagggtgatgtgttcgccctcctcttagtccccccgagggggtcggg

SEQ ID NO: 62181 - DNA, 10418 bp, Oryza sativa
  unsure (1)..(10418): unsure at all n locations
aatctcttcttcatcatcgcctggtggtcctgatgtatttccaatacgttagacgaataaaccgaggttatttaaatcagcatcacttgagaagacgggttacctgaggatgttcctagctgagcgtgaggtgatccttgttctttatttggagacccaatcatcgagtcgttaccagcctctggtccttgagaagttgtcgtctgcgcttcaacttcggggatttcttgatcgagacctacatctgactggtttccagtcgggggctcttgggttgttgcagtttcagctgctgccgactggtttccagtcggcggttggtcactcggatcggccttatcacccgaagcatgggcgccagtcggttggctttcggcagtcggctcaggatccttggataaatttggctctgtcacagccggatcaggatcttttccagttgggtctatgtcggatggtttcctgcaaagtgttctttcaatattcagtattattttcatgagagaagcgtgccgaagtgaaatggtaccaagaggctttatacctagaagatgttctaatctttggcgttgggcagttagccagttttttcctgggcatggtacgctttgggagtttattaggcgagcccttgtccccagatttgttgtcgtcgtcgccttcatcgttgtcaagcaccagttttctcttgcgagaacctgtctgtccagttggattggaggtttgaggttgcgaatctggtctgattgttggccctccacctccctgaacggtgtgctggcgaggagaccggcgctgagtgattgggggatcagattttatcaatacatattcctgaataagatgcctccatggttagttaactcaatatgaagacaagatactattttggtcataggttgaagatttcagatacacacctgcggaggcggattgaatgcattatatggcacgactggcagctgatgtgagtagctgacgacaatagcatttgagaagattttatacattctctccttcatgattttaaaatccagagagtctggttcttcgcgattaggatcatgcttgtcgtcaaactcaaaagctgtacgggatctttctttaactggcgccagtcggcatttgatgaagtgccgagtgatctgctctccttgtaagccttgttctttgagttttagcatgcggtccatcaactctaaggcttgggctgcttcgtccccaatcggaagagagttccaagtatcttggtacactggaggaagacaagagtactcgggaagagcaggctcaggattctgaacataaaaccagttcgcatgccaccctttgtttgaagtcttgaagggcattgagaagtacttctggctcagagttcccctcagctgaaatccggcccctccgactacacatggcttgctcttgtttggttggggtttgagaaagaagattcggcgaaacagagcgaagtggggtttaattcccaagaaggcttcacagacatggatgaaattggcgatgtggactatggaatttgggtttaggtgatgcaagctgattccatagaagcttaatatcccgcggaaaaatttcgaggtcggaagagcgaagccgccataaaagaaatgagagaagaccgcaacctcgtgtgtatcgggggacggaaaagcctcaccgcacgctggccgccacccgatgatctccttggcagggagaacgccgtgcgccaccatctccttcaggttctcctccgtcacgtcggatggcgcccattggccttcaaagctttctttctcttccaccattgattttacccgaatgcgctgatttgattcgggggatggctagggagaggtgagggattgaggcggtgaattacgggaaggattttgatgaacttttcgaaggtggatttgagtggattggtgaaccctagtttgccggcgcagctccgtactgtagcagggagtggggaaaatggcgagagttccggcggggaagacgaagtggcgcttggatcacgggattttttgttaagggtatcggaggtgcgaatgggcttaggcctgaacagtacctcagcccaatacttttaacagcgtggcccattgtgctccttagggacttaggcattttttgctttggcaacttatgcgcacaatagtgttgcccaatgctgataaaatctttttttacgcggtcatataattcttcggaattattgcaatgccaatttttcaggtgtggcctgtcacgttcttttagggactcaggcacttttcgcttacgccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcatttttattgaccaatagtatggcttaggctgattatatattgtagtcattttttttaggcggttggtaaatcctttatgagtttatttactcggattttacaccacatattcctgttttcattatggtggatagtcatagcttagactattagacttattcattaccataatttttataatatttggtgggtaatctttagagttttttattcggatgcctgtcaagtgtgttcattcgtgaaccttttagagtgttaaccactcggattctttttattatggctaanaagcagtcggctagagtgcctctttaggcgccgcatatgcttttgtcatatgatgcatgattgtgctattatttttgttctcaactatatgtttagtttgttaactaatcacatagttggaggctacacctaattaggtgcatctattcgatgcaccatattccttatttttttttgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactagatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacaccacccgtgcacttccgatttattcacatgtctacttgaacaatattatgtgtgcaccatagtgatatgtttgtgcattgcaatatagatccatacgactaagaatgtggggcgatgcatgtatggggccctatgactgaagatgggctaggaatatggatttagcataaagcaccggatctaacaagttttttcgttaaccaacatatattgtacgctttgtgcaaggagggatgactccacaagtggaaaatcttatatctactacttgaaaagtacttgaaatataagatcttcccttttatgcatgtatgacaaattagtggcaatggtgattattaattgcaccgtcgcatttgaaagagggttcatgcgttttttcttctagtttaatcttttaaaattctgtaagtgatttgtgcatcctaatacaatttggaattcaaaaactatgtttagaaaagagagctcaaatcatcccaccacgcataatcttcgataaattgaagttcttgaagcctaaacaaaactagctaatcaactgtttttgagaatatatgtggtgctaaccctacatcagcttttatttgatttgtcccatcacatttcatctcatatgtgctataatttcaagagcataataacacgtagcaacttttaatattacttagaaagcagaaagtaacgatgtttagttattaatcatttttgtaatctctcaaaggacttgctttggtaaaggattattaattcagtcctttaatttggtttaaaaatcaaaaatcaactatgtataacttaattaccaatatgccattgccattgcaatttactaacctgaaattcactatatatccaaatctcatctattcatctcactgttaaatgaaaatacattattttgattccactaggcaatttcatcatatattttcctcagcaaagagaactgaatacttaataccagaaagtaataaaaaataaaaaaaatcaacaagaacgacattaatttaaaccacaaccgatgtattaataattttaaaagtagcacaacattgttctcttaaccgaaaaacaaagataacaatagtgttcagaacacaaacaaattaaacagcaacaagaaaaatcacacggataaataatacatgttcaacaatagaacatatatcaaggacaaagaaccatagcatgcatctctaggacacacacgatcaccaagctgtgtgtgtcctctccccttgatcatctgcatgcgataatcgccattgcttcactgcctcctccacgcagagacgcagaacattggcttctcctccctgttgaggatgagccacccgccgccctccgtcaccccatacctcctctcatcccctcctccgggaagccgcgccgccaccgccctcacccgccccgccgccgtcaccacggtgatcgccggcgcgagcgcgaacccggcggcgcccatccggacgacccacctccccagcgtctcgtgccgcgcccagcgcggcccgtcgtgatcacatgcaataacgtccttgatctcctccctgaggaggtacctctccgccgccttccgctccaccgtggcggcgcccgcctcctccatggcggcgaagagctgctcgtagtagggcagcgccgaggcgaagcggtccgtgaacgacggcacgaagtggttggcctcgttctcggtcaggatgatggccctcggcgacagcaggtggaagccgcggaggagcctgtccaccttcgacgacatgttcgccggcggcagcggggaggtgatcatgctggccgccgccgccgccgccggcgacggcggcgccgtggtgctgaggatgccggcgccgacgaggcggtggagctggagcgtggagacgatgaccacggcgtggtcgctcctcaccccgagggcgtccagcttgagcgcctcgacgctggactcgacgatgtggaggtcgagcggcacgccgtggcggtcggactcggcggcgaggacctgcgccgcctggccgaggaagtgcttgtgctcgtggacgatggtgaggcggaggcatgggcggaccgcggcgcggcgcgtggcgaggccctggaggagctccacccagtgggcgtggtggatgccgccgaggtcgacgatgtggatgaacttgtcgttcctcgtcgtctcgaggatgatctcgttcacggcgacggcggcgaggtggagcagcgggcacaggttgaggaagctctgccgcgcgaactcggcctcccacgcggtgagggcgtcgccggcggcgccggcgtcggaggggaagagcgcggcggacacgcccctccagggccggatcaccacccgggccatcgcctcggcgaacgccgcggccacgcgctgcacggcgtcgccgtccgaggacgccatgcgagcgatgctggcgagctcggcgtccgcgtccgccggccgcgacgcggccagcgcctcggcgcagcgccggaggtggccgtgcagcgcggcggagcggtgcgtggcctggttcctcctgtgcgccgccagcgcgctcgccaccgccgcgagcgaggcgttctgggcaacggccatcgtcgccaacggcggcgccggcgctggcgctgctgctgctggaccagccatcatcggcgccgcagccatgggtggcaccgagacagccacagccgccgtcggcgttgagccgagcggcctcagttgcaaggacaaggacatgctgccgccttgtccttcgcctgagccagaggcgttctgtgacgccgacgacgatccatggccaccattatcggctgctgccacagctgccggagcagtagccgtcgccatggacgccaccggaaccggcaccatggacccgaagagctggaaattcgtcatcggcacggcggcggtggtggcagcggcggtggtggtggcggcggcggtggcggcttgcgctaccatcagttcagaggtgttcgcggcggacggcgtcgaggacgaactcttctccgttacagctactgatctgataaaaaaaaagagaacttaaattaaaatagtgtcacgtacacaatcttgataagagctagctagtgagtgagataaataagtgtcacacaatcttgaggtgaaaagtgggaaacacatttatttaagcagacgggagaaaaagattattacaaacagtgaagaaacacaaaaaccctagctagttttatcctatgcatggagacactatacatgtatttcctgctcgtgtaatctactttgaagaagcacctaaaccctagttactttttttttgcgacgaaaaccctagttacttgtattaatctatggagacagtacaccacatgtttcctgctggggaaaaaatctacaatggagaattaaacgcataaaccctagctacttgtatatatcttacatggacataagactatacgtttcctcctgaaacttttctatctgagcagatctattgaagaaaaataaaaaataatagttgtatatgttgtttctcgcttaccttaacgcagacacagatctgcgacgaggagaaaccctgccaaaagacaaaagattatgcatccgttagagaactagcatacaacagatccagatttgttttttcaacaaaagaaaacagcacgaataaatcagcataaattaatctgacccaacgctttcaatcaaaacatacataaaatccctttccaaagaaaaaaaaaagaaacatacataaatcaatctgaatcaccccggcacatatcagatctattattaaacatcttgatatatggagttattgacaaatcagcatgaattaatctgactcaacgctttcaatcaaaacatacataaaatccctctccaaagaaaaaaaaaccatacagaaatcaatatgaatcaccccggcacatatcagatctatataaacatcttgatatatggagttattcacatggcagagaaagagcaaatcccatgtatatatgctctagctatctcaagtcctcaacacagatatatagtatatcagaggacgaacagagatgctagctccttatacatataaatcaatctgaaacactattagatctatacatccaagataaaacagatttgtttcacagataagcagagaaagagaaagaacacaaatctcgcatatgctcttgtgtctctctatctctatctacctcaacaaagacgacagaaaccagaggaagaacacacagatagatcgagagagatgctctctctgctgccttaccctagaactcgacctagcttttgctggctaggagaagatcgagacgagcagagagatcagaagagagctcttgcttagaaatggacggagcgagctagcagatgagtttgggagagaggacgtgaggtgtgggtgcctatttgtagcggagggaaatcaatgcatgccaaatttgcaaaaaagagtgtttgaaatttggacaaattttgtgggcgcgggctacagctcccctacctccggtactcgttcacacatgcgcctaaaatcgaacgttaggggtgcatatatggtcttcctttttaagcatccatccatgaatgacgtacagctttcaaagctagctaacactgccacgtttgagggaaggttcaagccagcattcctttttctacttgtgttaaatatttttatgttccagttttgtcgtcctaaaaagaaatatatgtaaaaaagtttgttcaattttaatttgttatcctaagagaaatttgaattaaaaaatgctttgctcacaaaatacaaattggaggtgtaaaatgtatatttcggttgcacatttttaccagggaagcttcaaatatactgcgtgaaaaggagatgtatgaaaaataaatcgatttatattagcggggcatgtcaaattgatttgttcctgtcacgtttcatctcatattatgctttaacttagagagaataacaagttcatttacaacatggtaaggaaaagatcgatctgctagtacccaaataggtatatgatctgaagtagtactctagcatagccagcagcttgcaccataaatatcttccttatttatcctttctcgactgcattggactagtgctcctcttttagcaatcgccataaaagctagagggctgacaaaagggtgatttggaatgttagtacatataaggattcctagagtattacttgtcatattaattacctctcattcaaatttattaccattttatcccccaaccacctttccatcctcgaatcacccctcgtctaattagtagggttgaaagtgatttggattttccgtccgaccggaccttttttcggattcggatagttttgattggatatatccggaaattttcgaattcggatattttttctggaaatgaaaacgaatatgatatatgtgatatctgtcggaatcggataacggtctaaaactatccgttattttccatcggatatccgcattacacgtaaggctgccataacccataagctagcccaacccaagaggcagcccatcccaacaacaacaacgagggttccccacactcactggcacacagcacagccgccgcctcctcctcacccgccacatcgtccccgcggggccaagccgccgccgccgccgcgtcccatcgcctccttgcccgccacatcgccatcgcacgctcccgccgtcgtcgctccctagggcgtgggaggcggatccggcgccgccgaccctccctattgccaccgccactcccgccgtcccaccaaaccaccgtctggccgccgcttgctggccatccgctgctgcctccaccggccgtcgtgggcgctgagcccgccgctgggcgccggctaccgagagagagagaaaaggaggtgagagagagagagagagaggactgagaagtggtgaggagaagaggagaaataatggtggagagagagaggactgagtgtctgagtgagagtgagaagagaagataaggttgctgaaattttgaagtggtggagagggagaggacgcaagacattttagcaaaaataaatttcgaattgaattttatgataataatgaactcatatgaaaaagttatcaaaaacaaagttgtagaactcattaagatctatcaattttattttggtcatttctccatccgagtttgattgaattttaaaatataaaaaattcaaataattttttgggtagtaaatgatttcaaatgaaaaaattgtcaacaacaaagttgtataacttatcaagatgtacaacttttattttagtcatttttctatatgactttgtttgaacaatttgaatttgaatttaaaaatatgacaacttcaaacaacattttcaagtactaaatgatttcaactgaaaaagtcatcaacaacaaagttgtataactcatcaagatctataacttttatttttgtcatttcttcatccgacaaagtgatagtaacattgttcacaaaatttacatatctctcatatttggttttataaactataagagagatatctaaattttgtaaataatgttactatcactttattggatgaagaaatgaccaaaataaaagttgtatgtcttgatgagttctacaacttttatgttcatgactttttcaatagaaattattaactacttcaaaatattatttgaagttttgaaattaaaatttttaattgataaaacaaagtcacaaggaaaaaatggctaaaataatagcagcaagaacaaaataacattatagagcataattttaaaaacatttaggaaaaagaatcatccagtttggagttcatatgagtgagataaactagtttcaaattttattttcgcatacggctccttaagacgcccgt

SEQ ID NO: 62182 - DNA, 747 bp, Oryza sativa
gccgtgaatgagaccactgttcggcagtagttcatcaaacgatcttatttactacattgtgctggtgatgtatactgcaaagtttacatatatatgatcctttacggtatattatacagaagctttagatcatggcaactgatgcaaacgtgacatgctgcgcacgcgccacattgatataataaccgcgcaattggacaagaataggacgtgcaacggacacgtacatggaccgatgactacccacgccgatcggattggaactcgcccgtctttataacacccatgcatcctactatgcatacggcaagggcaacgcaaggctaccgattcatcatgcccaaatcaagcttttacgaacgcaaaaaaaaaaaatcaatacacgggaaattcaatacagtagtactccactacacactactagtgctagtgtgctactactactattttccgtgtattgatattcaccggtaaagtcgcaagggaagagagaggcaagaggggcccggagtgccggacccggagaaagcatgaccagaaagcgacggagggggcaaaactgccatcctgtgctactgtaaaaatactcgtagtactcctcctacttctactagtcagatactaccttttgagtttttcttatattgtttgaccactcgtcttatttaaaaaatttgtgcaaatataaaaaagaaaaattttgcttaaaatactttaaataataaagcacgtcaaaaaaataaatat

SEQ ID NO: 62183 - DNA, 8591 bp, Oryza sativa
tccagacgcggcaagttgtgatctgtcggtgatatgggcccgagggtatcaagactagagggaggaggttgccccggtacccacgtggcactcccccaaagggggtcgggcctggggtaggttggcggccgccccctctgagcctctgcatgacgccacgtgtgcgggattaggtgggcacccccaacgctcacctaactacatttagggcggcgcgcgcgggagagggggagagggtggtgctcggctgaggggaaggggagggaaaacagaataggaggttaggataggactttcctaaaaaggaaaacaaatgcggtgccgttttaggtaaagaaacggaaatggtcccgcgaacgaaaacggacagttcgttatgcaaaacgaaatcgcggacagagaggggagtgaattgggcacaattcatgaccaaaggcaaaaggaagaattattgatgtgatcttgacatttttaaacttagaaacattgcctccggtgctttgtgaattgcactttaagtcctgttaatgagtttagagcaaagaaaattcaaaaaagaattctccctggcaattctgattattaagtatatttgttaattagggttttctcctggttaaccaaagtaatttatgtagatcatttattagtgaattggaaacaaaggaaagggaaaactccaggtgtgacaccgaaatagtgcgcctacatattgctcacatgtcaggcggcatgcagcttggcctgcctcatcacgtcatgataatgagaagcttttagcctctcatcccggccggagtcggtccatccgctctggtcaaagcagggctcccgtttctcggcgcaaacgggaactcggaagtcttcattcagtaaaagactaggcctacatgtcattggcatagaagagtggcgtcaaccctggccgcctgtggaaggtttcggtcagggctgacaccgtggctactatcggtgatatgggcacgagggtatcgtgtctagagggaggaggccaccccaaaccccacatggcactcccttgagaggggtcgggcctgtggtggagcggcggctgctccccccacacccaaataggggtcgggccgccccgaccccctccgcattcctgccagtgtgcgtgggtgttaacaaccaaatttggtaatgccatgggccggattcaaagctagagtcaaagccgatttggagaaatgctatttgagaaggcagagtacgcatcggctgccgcatgaatcggctacaggcagtatcggctgcaacatataggctagcgccaaatcaacggactcaagccgatgcaaccagtttcgaaaaagacagtcccacgtctgtcatcgggattagtcaaagctcttcatagccattgccacgcaaggattggagtcctaaaaatgggcaattgtatctattaattaggacatttttctgtttccttagagatatgtttggtaagagtccacctaagggatttattcatattttaaattgtattagagaaaagaatcgtgtccagcaaggacatattatgtacttcgggtataaatatgacccgacaccatgtaatcaaagcacgacagttcaataatacttcggcgcatcgccaccctattatattttcgttgtttcgacgagtttttgctttcgagttaggcttcatcgggttcgatctccgacgaagaggtaaagcttgctatggcggattgtgttctcgggattagtgcttacatctttatgacactctaatcctgtctatgtgaatcgccaagttatcatatatactgcataatctagattgatttcgtcatctaacctcatcggctagcctctatcatcgaaaacggccgatgggtttaagcttcgaagtccatctagactatgcgatatatcttccatcctatatatcttccatcctgaatgagtttttatcgatttgcttatggaccttttgtttcctttcacgcttaatgctgcatcggttaggttcgatctattaagtattgtcttgaaacgtcttgtctagctctttctttgaatgctaatagagatagcatcggggtttcagccgatcttacctgatttagctgtcttgtttccctacttggtcatgaatcgtctaaatctgccctttatatcaagatctcatccgcttaaagtatattaagcttcctatcagtctgctagtccatctttcttgttagattgatctttgttttgtatatttcattcgtgctgatatctttatctgtactacttaaaagaaatgtagtggtgatggtgaagccaacatagacgtatctgtgcctccccctctcacgcccacactcgcgcctcctcctctcatgcccgtgcctgacagacacatttcattctacccgtacgatcgggagatccaatggccagattgatccctcgcgctcctcccctacacatgcgcccacaccactagcgccctcctggcctccctcatccacccgccccactcccgtgcgacggctgcgccgccaccggctgggcgtccccagatcgattcttcgcgctcctcctctccgctcgcgccccaccccagcaccgccgccggttgtaggtcgtcttcgttgccgcgcgattccacctcccccgccgatggctgctccaccgtgccgcctccgtcatcggatcggcgggacctcacgtccctcacgctgcctcccctgcgaagccaccgccggatcgcgccacctggtcggccgaccctcgacgacgcgaccccgcgttgcctcccctgagtccacctccctcccgatttggggggggggaccacgccgccgccggctcctaatctccctcgcgtgccgtcaccggcgccctctccatcgttccaccgcaccgccagtcaggatggcgttgatccctcgcgcgctgtggccggattcctccccaccccgctgccagtcaagccgccggcgatccttgtggtcgactctaactcgcaggccaccgaaccagccctccaacaaggtaactatcgtggtatccatttttattacagtataaatgcaaacttgtgaaatcagtggatgtgaataataatgacagtgccatgtttatgatgtgtgcacacatatcccactactaaattatcaatgacgatgtcctgttttgaacaatttgattagcattttcatctttttatataatgcaaatggtttaacttctcttatgattgggatgttttatgtttatatctgtaaattcagataaagcgctttaattagtagcgtgcatatactacctttatgtattatatcattcgactgctgcaacaatggaattcatccaagttccagaacttcttttacaagaaattgagcttcatgtttcatggtttatatttatttgtgtatttgcaatggagaagagaacaacgttaaattattttacaaacaatttgaggatatatatggcggcggtggagggaggcactggcggcggcggtgtaggttgggatggttgaagacatcaaccgccctgtggtatgtagtcccacgcttgctctcccgtgcgacgatatatatgatttggccgttgcttaattcagagaagttctagcctctgaaagtgaataacgttggcatggtttgtgccatcttcttaatgagtaggttttcttcttggcattggtggccccaatttggatgtcataaggatcattgcttcaccagctgataaaatgtcacttttaatgatctattggctatgctatgcgatttgagatgattttataggtgattttatgctgatcagcaacagaagtggttgatattggaacttaattgaagattcacgaatatatatttaaacataccatatgtaccctctgtaagtttgttttcttttgaattctgataaggtttatcttttaatcctagatatctttgttactacagtgtattattactcatgatatattacattgtacactactttctcagcattaaggtggtggcatattcaagaagatacttgagggagagaaataggagaacccaaaggattctaattgccacaatttgagttttttgtttagaagagttcggttgatcttatggaagtttcatattaattcctatgaatcttcggctctcttatgttttccgtgtgagatttgtgctagattttagttgtacatgtatcagatgaccatgtgtgatccctgtgagatttatctcacgacctaggttatacatgtattcagtttgagcaccaattactaattaggacaaactgactgaatctatattttatagttatggtttgattttttaaatgaatgatttgtttggtggctgattcaatgtgtttttgccttttaggctggtctgctttggctattagagccatttgatccagatgaatatttcttccttcattatcagttggcttgtttgttatttactatgacatggctgagctggtacttatggtagttttgatggtgcaggttttttctaagacaggagacatgcatgctccatcagcacgatgcaatagtatcatagctaatttagttcttagcagcgaagtcgatgctcatgatagaattttagatttttgttttctttcttctgtggtgtttatcaccttttggttgttcgctttacattaccaaagagcaccgtagcgttagcatgggcatattactagtcttggtacaaagtggtatcggagtgctagccgatacacgttaggtttgccctatcggctatgctgtgagcatacataatctctgctttgaggcacatttagatattgagtgacttatattgtctcggcataacatccgatctatcccaatcacctgatctaagtgtgtttcactggatagactacgtatcattgacatctacagccgatcgagtagatctaataatccctacgtttcatctgaccccgccggtctgacgcaagtcgcatcgacgtggcccaggacgatatgtcatcagcaatccaaccgatcagctatcgttgatggatttaactttttcctttttccttccttgttggttgcaggatcaaaccaactagcacgctcagaacccgaaggcaatctctttggacctgcactagagttaagcagatctctcaggccagtgcgtgtttttcgcgtcaacagcgggttaagtgggcgcgcccaacgcccacctaaccgcatttaaggtggatcctgcgaccgcgccacgttgcatttaatgcggtgtgcaggcttggctgataggccacgcgatgcttgaatgaccggtatggcaaggcgggtgcgcctgtgagctgactgcctaccaggcggcgtgcgcctgtgccatccggtcacatcgccatgatgagaagccttttgcctcatatatagaccggggacagattccctactccggttcaaattagggtacccgttccctggttggattgggtgcccggaagtctttagtaattaatgcagaatgatgcaggcgtcccacatgtcgtccggcgtgatctgatgggggccatgccaaggcgctgtgcgcatggttttccaagtcagatggataagaaatgtaataaatgtaaagaatgttttccttatcccctaggtggttttttgggcccctgtggtaaccctttgaggtataaaaggaggtccaggtctagtggaaagggaggattttcggatttctaccgactcatacactagtgttcctcgcagaatcaaccacacacaggagtagggttttacactcctcagcggcccgaatatgtataaaccccttttgtctcatcattctcgaggggcccgaccccttccgcataactcttgctaccaaaccacgattctcacccgctgcccccgactaaactaaaagggggctctccagtcccctacttgaggagttcaccctccgacagctggcgcgctaggtacggggcgcgttcgtgagtttttgagggatttttcgatttcgtgtgcgccaagtttcgctcatgaggccgaatggctgaagaggcgatcgtgtacacacccacacccattggaggtgacgacggcgacgaggacaggcgggaccagagcccgcactttcgtcgtcgagctcgcaccccaccgtttccaccgcttcaccgaagccctaggcgaggggatggccgcggcaaggctgagggctccgttacttccccactagcaggcgagggagtggggcgttgcgggtggggcgcgtcgccgtcttaggtacagcaagggaagcacgactgagggcgcgctcctgcgtcactcgcccgtcgccctcgatctagaggccccgatccagcgctggctggacaatgtggccaacttggtcaccactgcgcaacggcaactaaccgctagcgggcgaacatcgatggtcggaacgtattgcactccggccaccgcctcttcatcgtcaagacgaagggcctgccgggcggcggctaccgcacgtgcctcatccttgcttccctcgtcgacgcccgcgggcagctgtggacgtcatgagagcatatatggtggagccgttgctaggctcgttatcgagcgccgacgtgatgaacgtcgtgccacccatgcagtggaaggcaccgcctcctccagagcgccacgccaccctaggcaaagggctaggccctccatttccccattgagtagggctagctaccacgcctctgtggcgagtcttcggaatgtccgatggaccccaaagtttcggcccagcctcaccgagaagtatgacggcaacgttaacccctccgagttcctccagatctacacagcaatcatagaggcggcagggggtgacgaccgggtcatggcgaacttctttcccatgaccctcaagggccaagcgcgggtttggctgatgaacctgcctcctgcctcggtccactcctgggaggatctctgctggcagttcaccacgaacttccagggcacgtatctgggctcgggagaagaagcggacttgcacgcggtgcagcggctagacgatgagtccctccagcagtacatccaattctgccaggtcagcaacaccattctgcatccctgctcatgtagtgatctacgtgctcaggggggcgtgcggcacaaccacatgcttgaaaaagtcgcctccaaggagccccagactaccgcgcagctcttcaagctcgcgggccatgtggcttgcaaggaggaggcctggacctggaactcttctcacttcggtgcggtggccgcggatgccctcgagcccgcggcccgctccgggcagcgggagaagaggaagaagaagagatcggcccgttccaacgacgagggccatgtcctcactgctgaaggtgccttgcgacccccgcgcaagggggaggccacgggcggcaagcaaggggacgccggtgcccccagcggggagcgctcggcggacaaatggtgctccgtgcttaacacctccaaccatagtctcgctgattgccgctcggtcaagaacatggccgagcttgtcaagaagtttgagcaggagaggaactagggtcgccgcgaggagaatgctccggcgatctcgaccgacaaccgatgaggtgaggccaaggagaaggccctgtcgaggagcccgatggcgaggatctaggcttctaggagccccaacatgctatcaccaccatcgacggaggggcatgcattcacgcctcccgtcgaagctttaaggccatgaagcacgagcttctggccgctgttcccattcatgaggtggctcgaaggtcgcattggtcggaggtgaagctcaccttggatcacactgaccatcagccatgcactgcccgagggggccagatagtgttggtggtctcccccaccatctacaatgtcaagatgggtcgtgtcttgatctatggcggcgcggcccttaacattctgtcccccgctcccttcgacatgatcaaggccccggggatgcatctcaagccgtcgctgccgatcatcggcgtgaccacgggccacacgcggccgttggggcatatcgaccgccaatttccgcaccgaacgggttgacttcgatgtggcggatctcaatctgccctacaatgtggtgctagcaccgcgttggtaaagttcatggtggctgcccgctacgcctacctccagctaaagatgccgggccctagcggctccatcaccgtccactgagatgtcaaggtcgcgctggcttgggtgaagcagcgcgcaaacagcctcacagcggccaccgaggctggggacgacagcgggaggaccgaggcttccaccctgcgtgccccgaagaagcggatgacctcgggcgacgaggtacccatcaagcagatctagcttggcgatgacacgtccaagaccgccaagattagtggtaacttggacaccaaataggaagacacgctcatctcatttcttatgggcaaacgccgacgtcttcgtgtggaagccgtcggatatgctcagggtccccagggaggtgatcgagcaccgcctggtcgtgcgcccggacatgagacctgttcggcagaaggtttggcggtaggccccggagcgc

SEQ ID NO: 62184 - DNA, 25333 bp, Oryza sativa
  unsure (1)..(25333): unsure at all n locations
aaaataaaagttatagatcttgatgagttatacaactttgttgttgatgactttttcagttaaagtcgttcactaacaaaaaaaaattctatttgaatttctcaaactttgaatttcaaatttcaaatagtttaaatagagtcagatggagaaatgaccaaaataaaaattttgcacctcgatgagctctacaactttggtttcagtaacttttctatttgaattcatttatcaaccctaatttttcttcgaagttatcaaattttgaaaattcaaaatttgaattgttcaaatgaacttatttgtacaaaggaccgatacaatagttgtagatctcgatgagttatacaattttgttgtttatgatttttgatggttgtgtatgtgaatgaatgtatatgaaagggggatgttggggtgtgacatatcccagcctagggcttaaaaggattaatagaatactcataccaacaagttacaactactcttccggaagccgatctccaaagaactttgatattaaacgtgcttggcatagagcaatttcgggatgggaggaaggacaaaagaaagattggcgtgagagaggtgggacggcatggcaaggctagccaaaaataaaaattattttttaatttatttttttttgggattatactcatctgtgacgggcattaacttaggcccgattgagatgactcatctgtgacgggcattaacttaggcccgattgagatgactcatctatgactatgacgggctaagttaatgcccgtcacagataagggtcatctgtgacgggctatattttaggcccgattaagatagatcatccgtgacggcctatagtttgacatgtcgtctgggtcaaagctatcggtgatgggctttaattagggccgaattaaaaaggttcaatcgcttacggccggtntgtcggaattaaattacttttcacattagtgacttctagcctgtgacggacgccgtgcccaattgagatgggggttgccgcccgattgaggtgatggtatcctttctagtgaaataaactacgataaaaaagaaataactccaaaattaaattttaaaattcaaaattttcttctaagcataattgtaagagaaacaatttggctcggagtttgaatcgattagatatgtaaaactaagattcaactccaaaataccttgttggtgtccttgacattgtacaactaagacggtgtttgaaattaatgaaaatagagaggatacatgaattgagaaagtcattagcgcatgattaattgtcttttagttattacaaacttgaaaaataggtttatttgctattttaaagaaacttctatttagaaatttattttctagttttaattaattttttttcatttttacaaactccgataaaatgattacttaaaaataaacttattttataacaaaaggaaggggctagaatgaacttattacaggacggataaaatagaaatcactattttttctatttatttttcatttagtctataagaacaaagtcatgcttaactgattatagataaccattaaatttgttgaggggcgttttatgcataatttagatctgttgggttctacatttttaaacatcatctattactgttgcttgatctttctttttcccatttcatatatgcctaaggatttttaaataaacaatacaacatttatgtaccccgaattacacagtatccatgggctatgcaatcatcgtgccaaaagacacgcttatttccaacttccaagtatgcgctagtagtagtgctttggtatgcgttttccctcttttttttctatttaattaactgttcaccacaaggctgcattaaaacatagacaaatatactgcatataataaaaaaagacaaatatcagatctccctatatgactgagaaccatattggtttccctgataagtccagactaaagtcaaaatttaaatttttaaacttaattttaaagttgattttaagatatttttcaacgtagtttttatttcagtattgcttctagttcgctaacaatacatgtataaaagtttaaactataaattaatttctatttttgataagccgttttgacttagtagaaaatatgtacaactgatgagagcattaatctgtgttcgacagtgtgagaaggtgaaaaaaaatctcgttttctatactgtacccgaactaataaatgatgtgttttttcaaaagaaaaatctataggaaatttacttcaaaaattcatattaatccattttttaatttaaaataagtaatactacttaaccacattattttgtgtatcttaccattgttctattttctcatttactcaaacacactcaaagcggtagttattttgggataaattttaaacccaaaagagcagtttttttttattgtaaacagaggagtaaatttcacctttagacatttttttttatcgccgttgtttctatttggatcacctttcaaccatttttttcagtgttgtccggataatactacctttgtcgcattttgtaccatcctcaaccgttttatccatttacatctaaattgtcatatatcaaagaacggactacgacatacagctgagggagtttattgacaaataagaacaagagtactcgagcttgttcatatgcatgcaccaaaagaaagtaacaaatgcaagattagcccagtccgaagtgaaaacattggtcaaaggtgatcaaaagtgaaacatcggtaataaaatgtggcccaaaataaaaatttactcaaaagaactttataggaaagttatcttaaaaaatattaatccatttttcaggattaaaaaaattaacactcattaatcatatgctaatgacttatctcatttttcgtatctatcattcttctcttttctccttcactcaaacacacccttaggtttagtagttattttgggacaaattttaaacccaaatgagcgattatttggagatggagagagtaattagaatgtgaagtgggcccatagggcatctatataagtaattttcttatctattgttactagggtaaaaaatcaagagaaatattaattaataaaataaaaggacttaaacataaaaggtagagagctgaaatacaaaatctaccaacggtacattaaggttatcgtgcatcgtgaaacatatgtgcttctattgtgaatacctcaaagtgcatgatcttcacaagaatttgataaaagttgagctaattcctataaagtctagcaaaatattttcattaattgcccttgccaatatatacaagccatacagagaactctaaccagcacgtttattttcccgaagagctagctcttgccttcgctaagaatcgttaattatatggaagaattgctaaaaagtgttacacgtgaacgtttacaacattggccaaataaaacattctgcattttagcacaataatattttttacttcttggcccattatacagcaaagtcatgtctcttttgatatattattttgagcttagatttttttttccaagtttccgtttatctaagtgaaatatgtttgtcgggaaataaacatttccatttttttccaactagaaatattgcagatcttttttccaaataaaaatatcacagataccaccgattattgtcgtttggttctttttattccatttcatatatatttaagaaatcaaactaattctaaataactctacaacatttatatatcttaaacgaaaaatataaatattcacgggtacttttagttggtgagccaatggcgcacccattttctagtttgtctcgaaattaaataccgtgaccgtgtcaggttccacattattcaacgttcctcattacgtgttgctgtctgaaatgtgagaaggacacacctacctaagctgacagcaactagggtgaaacggatcagatattaaataatattccatctgatccgatccgaatccgtccgaaataaggatatgatattggtttttaaaaatctggcggatatggatgtggatatggatagtatgatacagatgcggatgaggatatggtatatccaaaatccggcggatacggattatccgacatttttattggattatccgataggtcctttaccggataatccaaaattataaacacatataaccactctatctattgcatataacataagttggtccatccaatggcctaattcatctattacccgagatttcttactctgaggcttttaccgtttcatgtcacacttgtgtagctgtatttttttatattatgaacatcaactattcatgttgtttagtacttaagcacgtaattattacaatgggtcgtttattgactattgtattattgtcccttacattgctaactcaatgttgtattaaatgtatacacacgtaacatccgataaatttaatccgtttcttaaccgattccgcaccgactctgcaccatttccgacatccgaaacaatccactccgcatccttatccgtacactatccgcatccgctccgaatccgcttaaaaaatatagtttaggatatggtataaccactgtccgtccgaatccgctccgttttcaccgttagcaacactatcctgtacgataaatacaatatacctacctgtgacccacgtaatcaagcctgacgttagcacaatcgtataccataaatacaattcgatgatataattagcatgaggacatagaattctaattaaactcttaattaaacttacgttcgagatgttgctttcccaagcgatcaagtgatcaagaaagcgcgcaaagtggatcagtccgaagacaaagtcctcaaatccatgattccatgcacagtatgaaaatgatgtcaatcaaacatgagtggggcctgctttgcttcttcctctgccaaaatattatttgcattgctttttcaatctataaatccagggctaatttcaggatcattaattagttacggagccgagatggaaaaggaagcgagcgcgatggttgcgaggagaagcaccagccgccatgattggaggaggtggtggtggcggctgctgcctctcgcctgctgcttcgtttgttgggtggcctccacggcggtgacggtggcggcggcagccggcgtcgccgtgacgagccttcctggtttcgacggcccactgcccttctccctggagaccgggtatgtatactgtatgcaatgaatgactgttcttccaatcgagatatgtctcttttttttttctatttgattcgcgaaatgttttgatatgaaggtgcatgtattgtcagtggcggagtatgccaaaaaaaaatataggtgggtcgaacacgcgagacatataaatcatcatacatcaaagtagcagttaaacaaagttaacaccattgaattatcatatataaaagataggaacaattttgtttttaccactagtttgatatccaatattaattttacccctattttttagggtttttgtttttacctcagtttttccaaaacgaaccagccgtttattcctgtttttaacggaagtgagcggagctggagttattgcggtaaagaaatagaaaagaagaataaattatatattttgcaaaatatgtagtgacctttgttcctcctggttattttgcaaatgtttggttgtatcgccccgagaaccgctgcttcctctccccgatccccatctcaaacagtagaaagtgaggtggcggcagcggcggcggcggtgacctggtcgggcgatggcgacggggagcaagcggcgtcggagggtcggccaggcggcgggagcagcagccgtcgtcggcgacccgaccaggcggcggcgacctgaacaagccacgaggagcaagaggccgccatggctgagaggagcagccgtcgtcggcgacctaaccaggcggccgccacaggctcgcactcagcctcgctgctgccgcccgttctgcttgagctcattctttagattgtcgttgtagaacagaatcacttctgtctaggataggatccattgtgattgctgcactgccgcactggtggctaatgattgttcattcattctttttttttacatatagtaaaaaaattgaaatgctgccaaaattatcaaaatcctgaatctgatcatgccactattatgttgatattctatccaaattattatattagtcaaagattgtcaaaatcatttgattttcgaaatgttccgagccacatgtataatatagggataaaaacacaatgaatgatggttgcaaatgtgcaacaataagtgagggtataaacgtcattttgccaataacttaaccatataaagtaaaggtaaaatgtgctttcgttttgaaaaacagggaaaaaacgaaaaccctaaaaaagaagggcaaaattaatattggatgtaaaagtaggggtaagaatgaaattgcccctaaaagatattatgagagctgagaacatttggaggcataggtaagtccatattccaagttttcaaggcctggaatgtcttcttaattgtatcaacacgaagtcctcgaaatatctcattttcaacatagcacaacatcaagtcattgagccactcatctgacatcctattgcacaaatatgtcttattatgttcatagctgagaaagctctttcaacagatgcggttgccacagataaaagcaatgctaactcaattagacgttagactaatggaaaagtcacgttcttctcagtttctactatcttaatggccaaacttccaaaataatggcagccaacaaaatcatcaattcttggaacatgtagaatgaaggtctcaagttgatcccttatattagaaggatcagcatttgagaaatcttgatcatatatttcagtcaagcgagcaatcttatcaatatcaaacttagagaatgggtccttggatcaatagaagaaaagctaactagtagctctgatgagatacctcattgaagcgatgattcatctcagtgataatagcatcaagagctgcaaagaaagtgtcaagacgctaataatgctcttgagtgattaagttcccttgcattcttgatcgaccaaatcttggtattggctcatccatatttggcactggaatctttttttttttgcatcacaaaatgactaattacctcttcaaataatggctgccaagcatcatttctcaaattgaccaaacgtgtcttcacatcaacaagcaatgacatggcttgaacaataatgtactatatattcatttaaaaaaaactgttcgttcattctaatttgggtcctaccacaagcagtcccccttctgcattgatcatgcatttattttgagatttattattgtgaaccctccatgttttttccttactgtgatttgtaaacttggccgatttgaaggtgcccctcaagcaatgtgtccccgacatgtttgcggtgtccaccttcttcgtgaggggcaacggcgcattgactcacttctagacgtatcgatggattgagggtcacttagtggcctccttaataccggaccttctccttatcgttttcccacgtctttgggcctcgctgacggttgcttctggccttgccgaaaactcatgggttagggacatccgtggcgctctcacagtccctgtcctctcccccgggactctcgccctacggatgaacaagatggagctacaacataagacatacaaagtatatactactcaaagaacatatattcaataaagaaatatataaaccgtgagcataaataaataaagaagataattctattaattcaactatagtcttacacaaagaggaaagtactagagacatactcaaaactccgagaagactatgggaccgaagctcctaagctttattcatactaaaaactatagagaatacaaagtggaagagtgaattgctcctttaggtgtgtgttgtgaagtgaaatgagctcctctatttatagcctccgaatgatggtagttaagtcggttgtaggtcaggaaacgggcataactgctagcaagagtgaaggaggagtcgccacgtggaagctcagtggcggggctagcaagcctagttcggctgaaccatggccaccacctttcgccatcgcctttgattagaggatgacatgtgggcccctatgacggttcccggttgtttgttcccattctaagtcggtttgcattgacttgtgggcccatcaatcctcgtactagcatgtgattcgccggaagtgtgtttcttcgtatgccggcttcatttcctcttcactttagtgtataattcttgcatccaagttaattcactaatcctaatacaactacattatttattattgatatacgtgtaagaaatgctaattttccctttattcattgtgctagttagtggtcgaaattggtacgtaatgaccatcaacacagtggtgaggacaacggcttgggctagggggcgtagctatgatgagtgaactagccctaaactagatcggtcttaatctagtcaaaccacctccttgaagagtatctatttgacaacgtcacagatggtaaccatcggtgacagtctatagagggacaccgtcacggatggtagcaaaattctatcttcctatatagttggtacccactaagaggtatttactcctataaagcaatacatgcaagaagccacatcatcaataattttaagccatcagatgatattagtacacagataacaaccgttggatcaagaagctacttattcatcaaattcaatcatttattagttatccattcacctccctttgcttcacctcatagtcacacatagcaccattacatattttgtgcataacaccattttttcttaatacaactcaaattattgtttaatatgtgtgttctgttttattatgcaagatataaagatagcatataattattaggtatcgttatctgaatccattttcagaaaaaacttgagtgaagtagagagatgcaaattgtaactacaatgatacccatattgagtatgaaaataatattcatatattataacaatacataatgatgcttggaaaaataaagcatgaattgtattgtaataacataagtcatatataaatccatattatcatatattttgtatatacatagagtcgcacctaaccatttaaaaccatgatttcgtttgacgataaaactacaaaacccgcggtaaagacgtggggtgccaactagttgtactaaatgattgaagcttcgcaacaatagcaaatcaaaataatacaaaggcttcaattacgaggataggccttcaatgtgatctgaacaaacatacgccacgtcttctttagtgtcatcgtctaggtctatgtgtgaatcaacatggaggtttatgctgtaatcgtccttatcgccgatattgtcaaccccaacaatcattcttttgtcattcctaaagatgcgcagcttcttgtttgcacaacctattttgcaagtacaaatggttcatccacgtaactaatcctgcttagatccaaatttgtcaaaccttcctaattgacttttactccagtgcataaattgacccagcggcaacaaaacaatgagactttgaacttcgtgtagttcagctcacagatcagctttatgcggctgtagtttgggttggacccaagttgatccagaaatgcctatatacgaaccccgctgttttataatcttgtttgacggtgtaaagtgtgtatccattaatatcgtatcgctgccatgtgtcaatatccaaaaacagtcctactggaaaccatgttaatgtttcgcttacgccttctgtcaatgttgcaatatgattcttaaaccattcgttgaaatgggagttatggttcttattgatccagttatctgatcgactcatgttctcctgctggatcttcattacatgttcttcaaagtatggcgtaacttctatcatattttggagcatagagaaataggcctactcataggctagttgggcctgctatattctttttttgcctactgtgccgacatcagataaccttccttcatgacgagatgttagaactcaaacatgtaatcaatgtagaactcaataacctgctatgtcatgtaacattcaatgatgctcctcttcgctttagctctattcctaacatacgatttcagaattcccatgtacatcttgaatgggtacatttcgcttagaatatgtgggccacataattttgtttgcttctcaacatgaacagggagatgaacatgatatcgaagaaaggcagtagaaaatacatctccaggtgatagagggttttgacaatatcttcctacaagctatcaagaccaattgtatctataacctttgactaattgcattgaagaaggcgcacagatgcatgattgtgtgatagaaattagttggaagaatattccttacagcaactggtcagagctgtgtgattaatacatgacaaacatgggatttcattccaaccagttttagatcgtccaacaaaacatacttccatatcatcgctgaatagcccgaaggaactttatatcattcaagcaggattacatatggatcctctcttccatggccaatttgtgtcaagcaagagggaggtacgctcttgctatgtctagattagttaatggagtgagttcacttcaaatattaatctcctataaatctagatgtgcgttcaatccatcttttatctttgctggactattcaacaatagccctatcaaactatcatactcattcttttctacatgtttcagatcaatgcaatgatgcatctcaatatctttctagtatggtagtcactataatatgtccttagtattaatatgttttcttttcttcccaaactcattgcatatgtgttctcgtgaaattcgtcgcacacggaggcctaggagatttgcatcgatttagtgcaggtcctaaatcttgatgaggtttgggcatgccaattaatttgattccgcaactaacaaggtggaaatcgatcgatgatgaagaagtttttcatcaacttgggaagccgataatcaacttagggagatcgaaactaagatcttgctagaataaaaggtggcgatgcatcaaaatttgatagcagctaactttgtatgttttgccttacatccgatgtatagaggtgtctctggccaatctggtgaacttcatgtaatctttcttgttgtaagatggcgaacaaggaatagtcatgcgaagcgcttcccaaaaaccatattgccgccttctcccgatgcagggcgttgaaggcgaaggttccagagacctgctctcccgatcaccagcgcacgccggcgagcgggatggagttgactataagcgatgatgcagtacagaagaggaggaaaaccctagattgattttacgtgtgttgcgtggagacggcggctcaactaatgtagagatattaggacgcacgtatgatcactactccgcataatcgaaccagacatgttgcgcataacttatctggactccacgccgtttcatgcactggattattcggagtgtttccaaaaaaacaaatctgaatatcccgcagcaaaacaaaacaccaaaaggaggcaacatctgcgcaagggtgacgaaccaattttggcggaccattcgacgcgtacttcgtgcactcgcgccgccatgccattccaggccaggtgaggcaagcgagcgagcatgcacgtgtgttccccctcttctctccacctcacatgcctcaagtggcaaggagagcatcctcccttatatagagatctctctctcctaaggtggtattaaacaccctatgcatgccatcagatgaggtgggcttgtaattttccaaagaattaatctttaaatgggataaggctcatctattaattccaactacccccaccaaatctcaaaatcccactgagatttgcctttttccaatgtactgtttatagaccagcggttcgatggagactaattaaggttgaatatccacctggaactccaagctacacttactcacaacttgaacaatggactacgccttaaattgcaagccttatgcaaataagtttcactcaaagtcttatctggtactagaagactacccttcgggtggacgtataagtcgtactccttggtctcttattaagcttcctagaagattcacccaaaatctccatagactgcgaccaacagtcaagctcacaaatgtgagttctttcaagaatgctctgcaggatagcatcttcgataattaaagccaacagaactcattaaggcatagccaacctgccttgcagctcacgagagtacatgcatcttcacttagagagagtttagattgctactctcctccagttaactaatgccttgttcttcccaggttctaattcgcgggatctctgatcacatagactgggttaccgcttgatgaggatgtaaggtcccgatcttccgataggtattgataagcagtcgatttgagcagagtcgtgacacaactcaatccgacttctaaatgaacatcctcctgagccccacaatcgcagcaccacgtctcctctggttatcaaccgtgccgaaacctggttgacctcaccgaaaaggctaatccctgcatgcgaatcgaagaacacaaacaagaacaagatagattgcaacagaatgcatatgaatgattaagcactcaaatttcgggttctacgaatcgatctagtggcaaaactattctcgacagattaatctaagcaaaacccaactctaaacgacgctggctactgaataaatatgattaggaatgtcgtagggttgccctagggggcacaccctattgggctaagcccacaactcaattacaaggcccaaaacccaaattagattccgactggatgaggtacatggcttgttttgcaggttcccgacagctcggtaggaattttgatgtgggaccaaaaccatctgaaagtagactccataagctttccaacaaatactaatgggccccgaaattccttctagatcagcagctaggtccgtttacagttgatgctgtcaagaggcccgaatccgaatttaaaacgtgtagaactttatctcttgtcttctatggaccaaaaagtgatgtggtaagatggaagtggacttagagaaggtcttgatttggtccccaataaacttctttaatcatccattcattccttacgcacagtctcttttctttcgcccaagcaagtacctctgcaaacgaaagcacacaaaactcattgtgtagcaacttttgttcaaatatataacaagtaaatcaaatatagaacatatgtatctttggttcattaatacataaggtaatcatggttatatctgagctagttgtgttcctatcatcctccccttcttgattggaaaccgtcctaggttttaggttgtcatggagcgtattgaacttacctttatctatcacaacatccggtgaagaacatttcttgatggccatatggttggatcctgaaatctttgtagtcgaaaaaccacaacactcctcttcttacaaaccaacttgtaactcatttaaacaactagaggaacttgatagagaattacgtatacgcatgcggtcctttagacaatacctttcatcatgaaaaggaggtgtagtcaaattagaacaaatatatactcgatgcatattatattctcctttactatcataattgccataacatgaaaaatcacattagaagggtatggtatttaagaaagatagcaatttaagctcttcattctcgctagcaatgtgaataacatgttcaaacgcaacacatggtctcaaaccatctccttctatgcattgtctatcacatttcgtgatagtcccttcgtgaaggatctaccaggttgcttgctgtttggatgtaatccaatggtataacttcggagtttctcaatctcctgacaaagttcaattgtcttttcacatttctagacgatttcatgttatcattagaactgttgactttgacaattaccgtttgattgtgacagttcataaaaatagctagcaccagtttttcaaccatagacagatccatcaacagaacacgcagccattccgcctcaacaatagcagtatcttctgccatcagctctgcttctatggatgacctcatcaaaatagtcagtttgcaagaccttcatgaaacagcaccaccacctgatgtgaagacatatccactagtggttttgatctcatccacatcagagatccaattaaaaccactatattcctctagtaacgcaggatacctagcacagtgaagccccaattccatagtaccttttagacagtgcatcactcactcaagcgcacgccagtgatcatctcccaggttagagataaaccggctcaacttgctcacagcaaaggagatgtcagtcctagttgtggtaggtaggtacataagtgagccaataatttgggagtattccaattgattcctagcaattctcttcttcttgcgaagcaacaagctaggatcataaggtgttggagaaggcttgctattagtagccaaagtgactcaagatcttctccacataatgggactgtaagagtgtaatcccatcctcacctctaattagcttaatgtttaggataacagcagctactcccaaatctttcatatcaaaattttgagataagaatgatttaacatcattaatcaactcaagatttgtccaaaatattagtatgtcatcaacatacaagcatataataactccctcaccccctccatggtgatagtacacatatttttttgcatcattgactgcaaagcctacagatatctgtcgacgggggatacccgtagaccggatatagagggtattggggtccgttggtatgaggatctacgtagtacgacatcaagccctaatctagttggtatgggattatatgatggaaaccgcagattacaaagggaataacataactcgatgaccccgatgagaacgtagttgagttgattcgactagatctcccgacgacttggcttctgtaggctccggctccgtaggctgtgggggatgtgttggcagtaatcttcgatgccttaggtcctttcccagggcgtcccttatatactgcgggtcagttgatatccaagtaggactcagagatatcggacccctcacgatatggtaacgacccagtctcgtccgagtaggactcctttcatccgcagatcctgcttctatcacgtgatacatttccttaacgtatacggaaactattcgtatacgcgcgggtataccgtatcggtacccatcgtacatccaaggatagagggtataccttatccgtaaccctgacagtagccgacttctgcttaaatgaactcatgttatcgatcgcgacttctaatgtcggaattgttgtcattctcttctggtcgatctcgctgtgaaaactgtagagactaagagtcatcgacaacactgcgtgaagttcaacggtcatgagtgaatttaaattgaagtctgaaaactgccgcacataacggacccagaattttccggcggcaatctctctcctttccttgggatacgtaccgtcggtagtgtgcttattttgggcatccatttgaagtccgttcgccaggaaactctcctgccttctagcgctcttcgtcttctccgctccccgcaaagaaaaccctagcccacttccttcatcctattctccggcgatcctccggcggcgatggatcttgagaagtcaactttgaccaccgcatccatgaagaagctctaggacgacggtgccctccccggtcgcgggaccttgcagtgggaggctggaggtacagtaccggaacccatcttgggttgcatggttgtagtcgaggattatatttcttgcggttttcttcctccgccttccgagtttcttcttctcgtcttgaacttctatggcctttctttgcttcacctgaaccccaactctatcgcctttctgagcgtcttctctcatctttgcgaggcctacattggggtagagcccttccttgatctcttccgcttttattattagctgcgcttgatggaatccagcagggtatctggatgtgttggattctgacttcaggatgccctgaagtcgcgttacatcacctactagtgcccctcttctcgcatcaagtggcggacgaggtggttctatctccagatagagaactcggatcccgtccttgttgtccctgaggagcaaccggaaaaaattccagagtggaccaccaaacccaccctaactccctccctccaatcctttattgatatcatcgatgatctccgaagacgggggttgtcgggatacgaagtcgctgccgacttcgtaggtcggcggattcagccgctgcaggcccgcgcccatccagcctttgattattctgggccagaggacacgacccgggtctctcctgacttaccgagtttccgttctcgatttattggtctaaacagtgacatcgtggggcgccatgttggtcaaataatgatcagcgcactctcgggggtgggcaacatccacatcccaccttgcgacatggacgcggccgaacgcgccaacacgattaatgtgatcgtagtcgatgattcctttatatcttccctgtctagactgcaccgtgacttcaagttatgcaggcgctccctttgacggacgtcatcgggccccttgtggaccaccaggcagcagcatcgttgaaggagagcgtcaccaaggaggcatctgacgctgtcactgccaccacgagtggcagcaatgttccgaagaggggaaggaaattctcctctgtactcgggactcgccggaaggcgacaaactctgtggtaagctcttctcttgttctttaacgcgtagtcggaacgacttgacctcacaccatttcatcttggtcaggactcggacgcgtctcctccacctcagcgaaggcaaaggctggtgacgatcggtgagaagtatgtaaatgttcttgaggtcttttcattctcgaagttgtgatcgactagcctcatgaagaaaaagaaaatcttcgctggaaggcgcgggcaaaggtggtgcacggtgggactgatgctgtctctagcgcgtcccctacggcgacttcgacagaagtcgtggtcgctactaaggaccaggaggcgacaccgagtagccctgtcgtcggcctcatgcccacccggggcttgtccaccgatgccctcacctggggggagctccaagtggagatggagcgcatcctccaggccggcgctcgtggcataggtcacgagatcgaggaggccagggcggtggcgttgtcggcgaaccagcgtgccgaccagctggcacgcgatctggcggaggcccgcgaggacctcctaaagatgagggagctggtagccggcaacgagatgcagcgacgcgggctcgaggactggatgtcggagctcaagggccacatgatcaacatccgcggttcgctgcgaacgtcgttcaccagcctgcaccaactcgccagggagtgcggtgtcacgactaccatcccggcacaccccgatgagttctcgttgacgtcatcgctcacggaactggctacggcgatggaggagatcccctccaagcactcggccatgatcggcgaggagacgtccaacggtatatgcaccaaggcgtgccatgtccttgcgtgcatgaggctagcgcattccgatctagaacttaagagggccttggatcagggggtggccgatgacgcgcgcaaggttacgatggaagaagtcggtgacttgggggagtctatccactccctttttgaagagtaggatatccatttttctttgtactccttaatctacatgcttgtaaaactctatgcgggtcccaactgcttttatcttgaacatctgtttcccttgtttccatagcatgtgatcctgagtacttttctcgttgtagatatgctgttttcaaggatgtccagcagcgtgggcagcccgatgtgccggtggtcattccgctgctcacacttgagccacatacgccgctggtggagggcgataagagcccgtccgtggaaacaaacatggccatgacgtccttaggttcgtgccttgatttccttcgctcctcgtgttcggatttaattaattagttgtgttctcgagagagaagagtagcttgacttagtccattccgtgttgggaagattttgagaacatgttggctgatcgagatcgtcgaatccagtactggaagacgaaactcgacgtgaccaaactcgaaagggccatggtggaggtgaagaaggactaggccgttgaagctcttcgaggtcgcgaggtgtggttcaactcgtacctcaagagctgctacacggcgatggcgggggtttgcaaggagcttcgagttcaccatggaaatcccgaggagtcagcggctggctacatctcgtggttgaatggggcctatgcatagctcgaagggattggcaagcgcatcgatgaggccttgaagcaggagtgtcgtcgagcgagccgttacgccggagggcatgtgctggcctatatccgagatctccgcccgcagctgcaccttgagttctttcgtgaagggttctcgcattatcggaggacgcccgcgaagatcgatggtcttgcgcagtcgatggcgccacttgccgagaacgttttttgctccatcgattggcgttggccgtcctggtagcttttgtgtcctatagaaaatatctcaaggaagcatgtaacatactttgaagtatttatgacttgtaaggaatacttgtaaaatagaaatagaatgtatctaactaaatttccttactctgggtatgttgtgtatgagtgttttctcactttgcgacttcggctagtcacttgagccatacactctccctagcccccacccttgtcatcggagaatcgttctcgggggataaggctcttggacccttgacctgccttggttgaaaaagcactgaccctagcccccaaccgtgaagttggaaaactcaatttccgattacacggcttggttaatacgcactgtgagaactcgtagatgaccagatcttacatggtcgtttgtctctgcatgatccgacaaggccttatccgctctaggcgtccccagccgaagttcccttaggttccttaaaggccttgtcaggatggtgtaaaaggacatgaggataggtttcaactttaggtgtcatcgtggtctgggatcgtcgggaatgaacactttgacaatattatttacctgaaatcaactttattgaaatcatgagatgtcttacaaatatggatattttttatttatacataaaatttacgtagggaataacagaactcgatgatacgacgagaacgtagtcgagttgattcgactagatctcccgaagacttggcttctgtaggctccggctccgtaggctgtgggggatgtgttggcagtaatcttcgatcccttaggtcctgcccagggggtcccttatataccgcgggtcagttgatctccaggtaggactcagagatatcggacccctcacgatatggtaatgacccagtctcgtccgagtaggactcctttcgtccgcagatcctgcttctatcacgtgaaagatttccttaacgtatacggaaactattcgtatacgtgcgggtataccgtatcgttacccatcatacatccaaggatagagggtctaccttatccgtaaccctgacaatatcaatgttctatcaaatttgcacaccttgccttctataccttcaactataaacccataaggttgatccatatagatctcatccagctctacattaagaaaagctgtcttaacgtccatttgatgaatgagaagaccatgtgaggcagctagggaagtagtacatgaattgtggtcaatctaccaacaggtgagtaagtgtcgaagaaatcttcgccttctttctgagtatagccctttgcaacaagctgatccttgtacttttcaatagtaccattaggccaaagctttttcttgaacacccccttgcatcccacatgtttacacccatagggtcactctgtcacctccaaaatcctgttagcaataatggaatccatttcactatggatagcctccttctagtagtcagcaccaggagatgcgtatgcttctaaaattgacttagactgtgttcatttgggtgtgttgggatcaaatctcctgtgcacggaaaacggagtggtccattagcgcgtgattaattaagtatttattaaataatttttgaaaaatggatcaatataattatttaaagcaactttcatatagacaattttggcaaaaaagcaccgtttagcggtttgaaaagtgtgaatgcgggaaacgagggaggtgagttgggaaagttgggggaaagagctcaatcttaggagtgtcatctacgaggtacacagtgaaatcatgactaaaagacttagtagtcctttgtttcttacttctccaaggagtctcactgtcatcctcctcagtcatcctcctcagtgatatattcatgtgtatgttcagtttgtcctggtggtgtgattgaactgagaattatttcacaggattggctagaagtactgtgtgtatcctttattggaaaaaagctttcaaagaaggtagcgtcatgagtctccataattgtaccaacatacatgtgaggtacctccgatttaactattaaaaatctataggcaatgctgtaatgagcatatcctagaaagacacggtccacagtattagttccaagtttgcacttcttcgttattggtacattgacattcaccaagaacccccatgtgcacaagtaagaaagtgatggttttctctcgatccattgctcatatggtgttttgtccttatttctattaggaaccctatttaagacatgattcgaggtcaacaatgcctccccccaccatgcctgtagtcccacagtatccaacatggcattcaccatgtcagtcagtgtgaacagggaggcgtcctctcatgtatgatgccatgtttctcacagaataagtcaaactcgtttgagaaaaactctccactacgatcagacctaaatctttttatctttctgtcaagttggttttcaatttctgccttatagattttaaaatagtctggaccatcatctttcgttttcaacaaatacacatagcaaaatcaagtagcttcatcaatcaacgtcatgaaatatcgtttttctcccttctcaagaccccatccatttcacaaagatctaaacgtaggagttccagaggtgccaagtttctctccccggctgccttgtaaggcttgcgaggttgctttgattgcacacaattatgacacttagaacctttaacaatggagaacttatgaattaaacacatactgtaaagccgagacatcaagcctctacatagacgggaggcactcataaccaaccaataaaatgtgacataaatgtgagtgccaaacattagcctcattatccacactcatagcctttaccaataaaatatccatgtttagacacgactactttattagattcaaacaccaacttaaatccatctctacatagatgggagacactaacaagatttttgtcgatagtagggacatgctgcatgttcttcagttgcacgatctttcctgaagtaaacttcagatctaccgtgtcaatacatgaactgaagcatgtgacctattctccattaggacggtggaatcccgtgcgacctgataagaacaaaatagtgagatgtcagcacaaacatgtacattggcccctgtatctacccaccagttagtagactgattaacagaaaaaaatagtaggtaaattaccatacccgctttcatctccagtgtttccaatggtcacattggaagacttagaagactaccctgcaggtgccttcatccccttgcgttgtggacaattcttggccagatgaccaggcaagccacacacaaagcaagttctccttagacgcgatgtctttttcccgagttttctcctcaacatcaagagatgctattaacccctcaacatagtattcatgtctcgtgtgttttaagtgcaatattgaaatttttccaaaatgaaggtagtttcgcaataatgcacccgaccacaaatttgtcgggtaagacacacttaaggagttcgagttccttagcctttgtatgtgtttcgtgagtctgctcaactacagaatggttatcaatcatcttgtagtcttgaaactgctccatgacatacagatcattgctagcatcagtagcatcgaatttggtattcagtgcatcctataactccttagtgtcaatcatgtgcatatacacctcgactagacgattgccaagaacgctaacaatgcatccaattctatcatttatgaattttttctgcttttcagcaatgagaattcctttagatttgccattactaacccagaagcatttcatcgccgtcaaccatagagtgaccctgttctaccatcccttaaagtgtataccggagaatttatccagcctcagtgcattggcacaataagccatagttaaaccatagtgcctataataaggtttttggattgttgaatatataaacacataatgatttagtttattccataaataaatcatgacactgcagatgtaaactagcattatcgcatcatacgatctacacatgtaaactagacagtaaagcatgagcagatggaatatgcgaaacatattgaatgcgtatcgagggttttcgaaaaccagcttctcagtaggaaggactcacaataccatgcgttgacgacggtgcacagcacgcgagcgaagagaaagatgagctgatgtgggcgaacaaggagcagtcgtgcgaagcgcttcccaaaaaccttattgccactatatcccgacgtagggcgttgaaggcgaaggttccgaaggcctactctcctgtttgccggtgcacaccggcaagcgggatggagtaaactacgagtgacggcgcagtacaaaggaggaggaaaaccctagattgatttcacatgtgttgtgtggaggcggtggctcaacttatatagacatatcaggatgcttgatcagggtgctgttgacggtcattatcaatcagtttcacccgtcaatattaccaaaataaaggagaactagttatgcttccaatgcaaatttatgttggaataacttatgttccactagcactacgattctaacctcttgcaaagaataaatacaaaatggaggagaattggcagcaaaacggacaatcaatcaatcggatactgtcaagaatcagacttgtggacaagtgggctgaaaacacagaattgacacgatccaacaggcccagaattcactgttctggataagggagaagtcaaagaggccacctgctgagattgggccagtttggctcagcccatggttcggccgatctcgtcgtttagccgttcaatgcaagattggcgttggactgtctggattgctttcttatggcggttgaagggtattactgaccttcccaacaaccataaccgtcattactaggctatttaaggccttcacctcctcacttcttccacacactcaagcaagtagcttctcacattttctcaagttttgtatagtctctagagtatagtagaatagaaatagaatagagttcttcagtcctcggagtcttcggaagagttcgggtatggctcttgtaccttttccttctttaataagacttgtaatatttatagaatatttttctcaatatatttacagtactttacttcatttggatcattcgagtaccagcttctgatttattatttgagatataattatctagctagattactcgagagatgcaatggtgtgggtataatgttcatttatatgattgctctatgtcatgacgatgattgtagagtagtatttggtagcataagcgaggtgcttaggctattgaatatcattatttggggttatatgctgtgggacagtagaggtgggccgctggtggtgacagctcagtatgtgtattcctccacgttagtatataatcctgagttactttcctagggatggtactccttcgtattttagccgcagttggatggccatgacgggttgtcataaggaactcggcaaccaggggtggtctctcgaaacaccaggaggtcatcgtaaggggggtattggttatatagttatatagtagataatatagactaaagttgtacgtatgtatattagaagtataggaaatgatttttttcttattcttttccacttagcctagaattagtatgtatgagaatattgagtgcttctactttgtgtcactctacacttgaattgaattaacccctgcttagactttgattattacaagtaacatataaatattagcttggttctctctattataatcttcccacgggattaaacaaatacgatacccttagaatactcttgggtaaatgctacaatggtatatccatgtgcttgcggatataatctgtaaccataatataccatgaatatgtatgtgccattgctgagaattatatttctagtaatgttaagaaataccaacaggcgcttgcacgatctccactccgtgtaaccgaactggataagtcgtgcgtaacttatccggactccacgctgtttcacgcaccgggttattcggagtatttccaaaaaccaaatctaaatttcccacagcaaaacaaaactgcaaaaggagactgcatctgcgcaagggtgaggaaccaattttggtagaccattagacatgtacgtcgtgcgcgtgccgccaggcatggccaggcctggcgagcgagtgcgtgcgtgtgttccctctcttctcttcacctcacatgcttcaagtagtcaggagagcatcctctcttataagaaggtctccctctcctatagtaggcaagttggtattaaactccccatgcatgtcatcccatgaggtgggcttttgtgactttccatataattaatctctgaatgggctaagactcatgtattaattccaacataacaaacatgcacatgtctgctccatgttcttcctgattttgtgatccaacacccgcttcatcttcaatattaataacgactgatcatgc

SEQ ID NO: 62185 - DNA, 88445 bp, Oryza sativa
  unsure (1)..(88445): unsure at all n locations
tgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgcaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatccacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttaacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggctgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgctgatggngatatcgtnttcaccgccggcctgcctccgtcgccgccgactggtgtcctcgcctatacggtcggttggtcacaccaccgttgatgggcatcgtcatctacaccgccggcctacctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgctgttgggcgtctacgacttcaccaccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcatcttcaccgccggcctgcctccgtcgccgccgattggtgcctccacctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacgtcctcaccgccggcctgcctccgtcgccgccgagtggtgcctccgcctacacggctggcctattatgccgccgttgttggacgtcttcgctttcaccgtcgaccgccttcgtcgccgccgactggtgtcttcattgttattgatggacgactttgttcccacattggccacttctgccatcaccaaggggaatattataaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggtgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttattgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaaatccttttcgcatccctctcctctccgcgattccccactcccggctgcagggcggtgcggcgatggccgacgctccgccgccggtgctgacgctgcaggtgaagaagggccgccgcggcggggagacccggcagtggcgggcgggcgccgtgctccgcgtcggccgcgtcgccaccggcaacgacatcgccgtgcgcgacgccggggcgtcgcagcgccacctctccatcgagttcctcccgccgccggcctcgcggtgggccgtctccgacgtgggatcctccaacggcaccctcctcaacggctcccccctcgtgcccaccgtcccctccccgctctccgacggcgatgtcatcaagatcggggagtccagcatgctcgtggtctccatcgcgcccgattcggatcccaaccctggccctaggcgctcctcgcgccaatccgccgcagtggtgggggagcaggagaaaccccctgcggtcacccgccgtggcggacggaagaacgctgcagcggcggcggtggcggttgagccgcccattgcggagaaggaagagccagagccggaggaggctccagtggtgactcgccgcggtgctcggaagaaggccgcgcaaccccccaaagcggaggagcacgaggagggcgaggaggaggtggtcgcggcggtggtgacgcgccgctgtgggcggaagaaggccgcagagccccctaaaccggatgaggaggaggagcaagagaaggggaaggatgaggaacaagaggagaaggaggaggaggaggtcccggtggtgacgcgccgcggcaggtcgaggaaggcggcgccggaggcagccgttgcgccaccgccgccgagggcaaggtcgacgagagctgctgctaggagaggcaaggcagtggacacaagcctggatgagagggagagcgagatggccggaaagggacggggaagggctacaaggtctaatgcaaggaagtgtaggatggccgttcctgaggacgatgacgatgatggggaacagcaagagggggctactgctgtggcagaagagcagataaaggatcaaccgagggcaatggcggtgactgacggtgaggaggaagatgataaggtggaagccatggatggagaagttgaacagaatgacaaggcatcagaggaggaggaggtgccagtggcgcggagaggacgggcacgaagagctccaaaggggaaggctactgcaagtagtaatgctcatgctgcttcggacaacgcggttgaggaggaagacggcggtagaggagagggagcggctgtggaagtggagggggagagttctgggagcagcagcttggaaaccatgacactgagggagtggtttcagaggatgaatgtgtacctccctaggatgatcaatgaggctgctgaagaggcgctttcagccctgcgggagaggcatcggcgtatagatgagtacatttcaacgcttgaggattagcgtgattcatggtatgttcatctctcaagagaaatctttgtccttctgttacttctcttcagcaagttcagttctctttatgaaatttcctactgctgtcagaatgttctattatgttcgaatagctcaatctttcaggtctagcaatgacttttctgcattgcccagtaattgataattcattttaattactagatacagtatatgtataggaactgtacttgaatgcagttggtattggggccgtatctgcataaatttactatgccatgcctaatgccttattgctgactatcaatctggattgcctcaacatttgcttatgttaaagttttctcgcaacaattttgtaggatcatgtttattgagaaagttcttgcataccaaataacttcatcaggtgctcttgtcatatattttatcttcacttcataagtctgatttatgtcctctcccagcaaaaaccagaatgccgagtgcatatctggctaatctccagtgcaaccattacccattattagtctccaacatatgatgggaacaattacgatgtagttgacagttactgtttagatctgaaatgaatgtgtaattgtgaagcaagtgtgatctattcattcttgcatattgaataactgtttactgatcaattctagccattgaggtgtagcaattaacatagacaattactctctccgtttcataatgtaagacattctagcatttcccacattcatattgatgttaatgaatctagatagatatatatctagattcattaacatcaatatgaacgtgggaaatgctagaatgacttacattataaaacggaaggagtagaacatacttatatctgcagtttgttctttgcctgtaatgtttcccttttgcatccataacatatttacatgtaaaagctgcctctgtcaccatatgatgtgcctatttccatactgctagtgctatgacactccacgttcctgatctgctactatgggactgaagtttcatgagtgatctattacacaaccgaacagataattgttcagctgcagttctttgttctgcttgacgttttgccacagccaatgcttgatgccttgaactaaaatgacaatgttgaagaaattttttgcacgactctttcaagatctaaaattgccttttggtgccacaccgtcttattcagcaagctttacaacccagtgacacagaactcgcaaatagtttttcacagtttcagcgtttccgtttgagatgctgaaaaggaagatacatccagtggatcatatttttctgtgtaatccttgctcccatagtctcatgtattgagctgtggcagaagtacggtttattttgctattcatctactaatgcttgtgcttagcttttatccacaatttgcttaacatgccatctgtctgcaggataattaggagctatttggtcaatctgacgtaggggtgatgcctggagataacattaattggaggcaatgctttgctgaagcgccacaaagatttgctgaagcgccacaaagagccattaggtgatatttcactgggatcatctcattatcgattccagttccaccaaatgccgcaaaaatcattgatgcaatacactgtagcactcttcatgtttactctagttatgtagtaccagtactctagtactcatgaagtaggacctgggttcgtaggcctctatgcaaaggcattcaacatgcatcgcagatttcattctgtaaattgcctctctaaggtgatgtttattcatgcctaacctctatctggaatacaacgcgacaatgttttgaatgtatatgtcgtttctaccatggctgctattaggagtcagaactgattattttgcccctcccccgttttttacttttgaataacgtgttcctggatgatcagtatcaactgttgggaatttgttggtgaagatgagttctcatgttttgatactaaatcagaccaccttctagtctcaatgacctctctcatctcacttggaaaatgtacctgatttgttgcagtgatcctcatattgttaaaacccactctttaatgggatccttcgatcctctacatgcaacgctcagtaataatctcaggtgaaaaatgaacgaatgctcaatcttatctttattttcagcgatacgaagcgcacaatgcaatttcacctgcacagcatgaactgttaaatcgaatggcaacacagaagaaaggatcagatgcaattatctaacaaagaacaacacacgcatggcaacatctggtatccatgccattttgtggagaaaaacacacccatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaatttggcatacgatttttgtaatgcatactctgtaaatttatgagcctggcatccttgagcctattggacgttatgatttagagaagcatcagcaaacaagaaaaaggtgttatctttctgcactagttcttgaacagtactataacaaaaaatatgtggtggtatgttctatttcaatttcaaatgtcagctaagatcaattcttctaaaatgactccacacaaccagctaccttttgaagtccctttcagtttatctgcattaaatcaaccacatatttgaagtgtatcaactagaaatctccacacaagggaatacaccgtatttttttcccctttgtctgaactcaagtgatagtcaccgcaaaacaatcctaaagcattaactaggttcagacttgcagctgcctagcaaaccgaaggcttattatacagacacttcgatcagcacaatcaggaaaaacaaatgctatcttaacaacagtttatcacacatcacaaatgcagaagcaataccttcgatttagtttgcaacttttcagcaaaagcaagatactgcttcagagtgtactcctttgcattgcctaaggctgccaccatagcctaaacacagtccatccatgtttacaacatcaaagatgcattcatctcacctggaaatgcagaactgccaaaacaaaattcacaaactcacctcatcagacatgaacggtgcaacatcaggcgcgtaggcagcgagaacagcggatgccgtggcagggccaacgcccttcagcacggtgagctcggtgatggccttgcggaggtcaggcagcgctgcgaacgccttgcacgatgctgattctaccactgcatcctccaagcccttgacgaaatccatcagtctcggcctgcacaaaagaacagagcaacaatatgattattttttcccccaacgagtttgataataacagggtagtgtaggagtatcatcaactaaccaactagggtaatgattgatttgccaagaaaacgagtccctaaatcaatggatcaaatcagtccaagcacccttaagatactagcatcatccaattgatccacacatttcggcacgatttctagggagatttgagcgagaaatactactacaacatcacacgcccctgggaaccagaagttcaagtgctctaaagaggaacaggaaagaaaatctaagagcgggatgagacgacctccacttgccgcgggagagcttccattggaggaggcgcaccagctcgggcttggcgaggaagggctccgggtcgcggcggcgcaggagatcggggaggtcgcggcggtagaaggagtcgacctcgacgaggtcgggcttgcccagggccgcgagccggcggtcgtacgccgccagcgccgctcgccactccgccgcgtcgccgctcgcgaagtccaccgtctcggccatcgtcgttaccggaggcggcggcgcggtggaagaggtcacttcggcgcctcaagagccaggaatttcaaacagactagtatctacccatgtattaatatctctcgataaatacaacttcggcacatatcattggatatctactctattatattatcatcggtcgattggattgattgttcaagttcttctattgtctttatatcattatttatctgagcgttagaatttacctcggacatatagccaattgttcaagaccatatcaaatcggcttattggctgatcggttcttttatcatcaatttatctatcttgtcagttatagtatcaaactgactgacacgtacaaacctgatattttaggacttgcactggagcaaagcacgtatagatgatgtcagcacaagcccatctatagatagatgtttgttcctccttttttttgcaagcgtcctgtgcgttatattcttattagacactctttaggcccattcgtgaatgatcctatgtaaatgtaagcttctctattgcctttatgcgtacaaaaagattattccgtataagccttttctagtcttatttcgataccttagttatcttctagagttaggtataattatgataaataattatttctaaagtgtgaatgatattgtccattcaaatatactccctccgtaaaaaaaaaaagacaaactctaggtttccgtgtccaacatttgaccgtccgtcttatttgaaaaaaatatgaaaaaaattaaaaagacaagtcacgcataaagtattaatcatgttttatcatctaacaacaatgaaaatactaattataaaaaaattcatataagacagacagtcaaacgttggacacggaaacccagggtttgtcattttttgggacagagggagtttgatccaaatgactacaattattctaaaccacaacaaaaataatgatgttggcataatatatatttaatgtggatgttttttattttaccaattttcgtttttcgtgtgctggaacacatcaatttctcccagtggcaacgcacgaacacctacctagtgtaaaaaagaagagagaatctactatatgctactgagtttgtctcagttcaacgatttgctactgataatgtctctttgtgcaatataccgatgggacactgaggagagtacaaagttcaagaagattgcaatatatcgatgggacactgaggagagtacaaagttcaagaagattatttgagccagtgaacatatcattatgatcatgatggtgagcagcgtagtggatatatgtcccacgccataaaagaactagtgtgcttcttggaggagcaactccagcaaccccaaaacacctcagaccacgtatccacccagacatatctacgtaagttcgataagcatatcagtcatggtaactaattattttagtaaacaacaacattgaacaaactctccagattaactcggaataaaaccataaaaaagtgggaacaaactctccaacaaacattaacctgtaggacagaggcttgacataagacatcgggacatagatgataaacattaacctaaaggcaaggatcatcgatgtgatgctcgccacgtgaactacaatcttcaccctcttgatctccatggttttgggttgctcgtcatcgccaatttgaaccaccatacttattttctctaatatctattttgtcatatataagtcaacttaaacgcataccacctatacacgattcttggtagatgagcactacgcgaccatccgcagtagctagtagcgcctcctttatctcactctctcccgcaccgtcgttgcaacagtgcctaagagcgaagtccacgacaggcaataccccacatgcccccctacgctcataaaacaaagggtaccttatagaaatagttgatctccatggttgtgggttgctcgtcgtcaccaatggagcttaagctaaagtggaggggaaacctatagaaataaacatcaatatttgaataaattgatcaaacatttaaaattttaggatgagataatcaatttaccatttattttggttaattacaacactttgagctaacatatatcacttgaaagaaaatagataacaggatgacaaaaacgaatcatccacaataagaattaacagatatcacacctgaaaataaacttacactaataaatataaaaagggtttgttggaaccatgctaaatttgagatatgccacccgcatctcaatgacatgtaggacccacgagtcaatgacatgtgggtcagggtggcatatcacaaattttgcaaaatttgtgtggcatggttcaaattgtcccatataaaaaatgcattatcatttgcagcgtaaggaaatcaaacttaatatgaaatgcattcctcagcacgagacggtagatgtgtacatagtgctaacacaatcagatgtagagtacatatatcatcctaatcctcaagacgaaaaatacgtgtagttttatagatcctcctacttctcggcacgaggaaatcggcatcgaagatccatagcatgcctagtgccttgacaatgctacgatcgtgttgtctagcaagtagggcagtacccaaggctgcaattagccctacctcacgtgcagcacatgagtacctgcatgaacataaatataagttaatcaaattagggggcgtttgagagggaagtgagttgaaagacctcatttacatggcaagcattaaggcccatataaataaaacattaattaactctatccatttccaagatatagttagttttataaataatttctgacactattccaaagccaagtacactcatccactgttgtttaaaaatgtatttgttgtactacaatgatgaggaaagtagtaacattttcaacccaagacaaatttattatgaaaatatattcaattattgatgtgatgaaactaatttagtattataaatattactatatttgcctataaacttagtcaagacatatccgtaaggtcggtaaggataccagtcatggtaactaattattttagtaaacaaaaacactgaacaacaaactctctagattaacttgaacaaaaccacgaaaaagtgggaacaaactctccaatgaacactaacttgtaggacataggcttgacataagacgtcgggatataatgataaacaccctgatgacgaggatcatcgagcacatcctcgccacgtgaacgacaatcttcaccctcttgatctccatggttttgggttgctcgtcgtcgcaattcgaaccatcaaatctcactttctctaatctcgtcatatataagtcagccaaagcgcctaccacctacgcactagataagcatagcgcgaccaaccgtggctaataacacctactttctctaatctcgccatatataagtcagcctaagcgcctaccacctatgcagacaagcatagtgcgaccaaccgtggctaatagcgcctcttctatcttgccctctcttaactagacaagcacaacgcgaccaaccgtggctagtagcacctcctctatcttgccatctccgcaccgtcgttgcaatgttgcaacggagcgaagcccacaaggggccaatgggggcacatgcctttctatgctaatagaacaaagggtaccttatataaatagttgatctccatggttgtgggttgctcgtcgttaccaatggagcttaagctaaaatggaggaggaacctatggaaataaacattaatatttaaataaattgatcaaacatttaaaatattaggatgagataactaatttaccatttattttggttaattacaacactttgagctaacaaatatcacttgaaagaaaatagataataggataacaaaaataaatccaaaataataattaacagatatgacacctgaaaataaacttacacaaataaatataaaaaatatattatcatttgcagtataaggatatcaaacttaatatgaaatgcaatccttagcacgagacgtagatgtgtacatagtcctaacacaatcagatgtagagtacatataccatcctaatcctcaacacgagaaatatgtgtatatataatactgcgtatagttttatagatcatacttcttggcacgaggaaatcaggatccgaggatccataacgtgctagtgccttgacaacgctaagaactccaacaaacaccgctagcacagatccaactaggaaccgtgtgcactcaaccacgctgatgcaaagatcatgctgtctaccaagcagggtagcgctcaagctgcaattcaccctacctcacgtgtaacacatgagcacctacatgaacatagatataacttttactctatataacttaatcaaattagggggcgtttgaggggaagtgagttgtaagacctcatttgcatggccagcattgaggcccatataaacaaaacattaattaactctatccatttccaaaatatagtcagttttataaataatttccatgacactattccaaagccaagtaccatcatccactgtttgtttaaaaatatatttgctcgtactacataacgaggaaagtagaaaaaatgttagtagtgctttactactccattcattgcccagcttattttggtccatcattggggagggatctttcattgcacggcttattttggtccatcattgattggggagggatctgaggaaaagacattgaaagtatttcattttattctcaattttttctaaacaaactattaatacttgtactttgaaactgagagagtagaatttattgattatcgtcatgctctatgcatattaatcatgagattataaagtataaggagattatttgagccagtgaacatatcatattgatcataaccatcatgatgtgcagggtagtggatatgtgtctcacgacacaaaagaactggtgtgctgattggaggagcaactgcaggaacccaaagcacctcaaaccacatatccaccgagacatctccgtaagagcaactccagcaaccccaaagcaccgcaaaccacatattcaccaagacatatctccgtaaggtcggtaagcatatccaccaagacatacctacgcacgattctttgtagacgagcacatcgcaaccaaccgcgaatagtagcgcattttctatcttgccctctccgcaccgtcaatgcaatgatgcaacggagcgaagcccacaaggggcaatggggggcacatgccccttaagctcatagaacaaagggtaccttatagaagaaatagatgatctccatggttatgggttgctcatcgtcactaatagagcttaagctaaagtggagggggaacctacagaaataaacatcaatatttgaagaaatcgatcaaacatttaaaatattaggatgagataagcaatttaccaattattttggttaattacaacactttgagttaacagatatcacttgaaagaaaataggtaacatgatgacaaaagtgaatcatccaaaataagaattaacagatatcacacctgaaaataaacttacactaataaatataaaaaatgcattatcatttgcagtgtaagatatcaaacttagtatgaaatgtaatcctcagcacgagacgtagatgtgtacattgtactaacacaatcagatgtagacgtgcacattacagtacgactgtgtacatataccatcctaatcctcaacatgagaaatacgtgtgtatatatagtactatgtatagttctataaatcctcctactacttgtcacgaggaaatcgggatcagaggatccataacatgtctagtgccttgacaacgctaagaactccaacaaaccccgctagcacagatccaacatgatataaagggcattaagtggaaatcctctatgtttaactttgaaatcaactagttcttgagaggatttacaacatgtagttgaataaatttggaattcttataatgaaaagggttctagtattgacaaatgcgttggagaatgcaaatgataggaaaaaggctaaaaggatagaacatgaactgagatggtgaatacaaatggaaaaaaaggtggcaaatgaagtattcatatcaagattcggatagagatgagccaagagaagtttggagtggagggactgaagtttttgtgtgctcctctttttggcctgatgccgatggatgcaggttttctgccctagcttatttgtagtttttttggtagtcgatttggtcacacctgaaccaacgagaattaggccaacaccttttattttctttcttgaacttaatttctcttaatacaatgatgcataattctttgccgtattccctgaaaatactttcactgaactaaagtatataagaaggagaaatagtgatcaagctaataaatgaaacatggtgtaataaaaaaaaccataaacaaacatgtgagattgtgataaaaagcaattgtaactatatagcagctcatccctcatgcggagagagagataatggggagaggggtgtttataataaggatgagtatgcattcatgataatcttaacaacactaaacaaccttgactaacctggccaacagttcttgtgtgcacaatccagaggaaggcactaaatcactacatgccaatcgatagaagagacaaatacttggatgagcccctacaatatgtccacaggcaaaaaaagttgacagacttgcttaggagcacaccaaaagccagatcaagtaaatacaatcaccaaacatctattttgttttgtattttttatacaaccccctaatgggaataaactaagcatgttcttattgatttagttgattgacatggatgagccattgaaatatttgttaaatataaattactttccattaaaatataataacaaaaacaaggaagaaggtttccgcatgtaaaagtactaaaaagataattcaatatgtattcaaactttagtagtacctcaagaaacatttcatcgagcagttcttgagcaccaaaaacctctaatgcgttcctcctcttccttgttctctttgtatccttctattctctagccatggcagcagtacacggcatcacatacatcatgaggtcagcacagagcagaagcaaatcaacaacaaatcaaaaagagcaatgcggaggcagtaacataatagcagcagcaacaacaacaacaaggatacaaagagaacaaggaagaggaggaacgcattagtggtttttggtgctgcagcggaacagcaaatcgtccctaccaagcaaagcaagagcattgaactcattttttttagcagacggtaggagcaaccgcataggagttggcaagggatgtgaagacctgaaaaaatttcaaagccttggtaaatcagttacttacaacaactgtcaggcgactcaagctcgtgctgccaaccgttgttgctaccatctctccccctttgtccgcaggaaaccgccactattgccgctaccatctctcccctttgtccacaagaaaccatcgctatccccatcctttgcatctgtagtgatacatggatggggataaacggaagacaatggatcattttataagatttcatctcttcctcctcttatggtgacgacgttgcggcctgctacctagtcccgctttgctcgccctagggtcacactcggccctcaacccatgctcactgcgttccttatggcgaagatgcggagtcgaggacgacgacagatcgacagcaccgacagcggtgggcaggcggcgatgtcgagcggagttgatgtgtagcggccacagcgcactgtgttgaggggaggtggcgacatgggacaaggtgacggtgctgggctaaggcgcacggtggcaggcctgttggtgagccggcgacggcattggatgagggatggcagtggcgatgagccacatgggaaggaagaggggtggttcaaggcggcgacgaagtggaggcgtggggtgctcaaagcaaggaggttgtccattggtttcactaatcctactactaatccatctgctaatccaactcacaatgtaggtcgttagatgagaggatccaacggttaggaatgatctgggtatattttgttaattcgttttgactttttccgtagccaaacttaaccaagttttttgataacatatttgttttgtatttaaaatgctatgctaacttgattaaataaagtttgattagtcaaaacaacttataatatgaaacagagagtatatgcctactaattactaattgacttactatactagtaatatgaacgtgctaacgctacggtgatatttcataaaacaatggtgatagacagaaaaatagaatcatgttgagaatcaaacaactaattatacttgttgctcaaagtatattgatttaaaacccattgcatgatcagtttcacttgagcaatcaaagcgtaaggattctttgaaaaataaaatcaaccacatacaacagtagtgggagaccatagtttacagggtcaataatcatgttttctccttttctagcctccaaagataggaacattgattcaattgtttttaaaagagtaaaatacacggccggtccttaaacttgtagggatgtgttatctaggtcctcaaaatacaaatccaggtcctagaacttgtcaaagtgtgtcatgtaggtcccaaatcgtcacagctcctccaggatcttacatggcactgatgtggcaatgacacacagacatgacatggcataatattgaatgacaaatgagacccacttaaaaaattttcatttcccttttttattctcttttttttcctttcttctccttttcttgctctcactgcagctataggccaccgctacacgggttgctcaggtcacagagaaaagagaagagaataaaagaaaaaaaaagagaagaagaaaagaaaaaaaaggaaaaggaaaatttttaaatgccacgtcacgttcgtgtggcacgccacatcagcgccacgtaggattttggaggagttgttgcgatttgggacctatatggcacactttgacaagttctgggagttggatctacattttgagagtttagggacttagatgacacacctctacaagtttaaggaccgcctgtgcactttactctttttctaaactcccaagttactttagaaaggttgattttgaagatcatctgatttctaaccaacattttttaagatgttggagaggtggttgaaaaccaaagacataaaaattacatgatttggtacaagacaatcacttgttaagcatccaaactacccttcatcatgctcagaagtaaaagagagctgaaactcacagattcagaagtttggatcactgaaggctgcaacatggactgttcacttcagaaaagagtcgacacttcaaatttatctacactgatcacacaacctaatagattcaccagacaccaatctaatgacatatattttgacaaaatatgtagcagagaaagtactaatcattcataaattacaccatgaacgttgcttaccacgtagagcaacaatcgacagaaagccaagcttgcactgttgtttccagcttcctatagattttcctgcaaaactataaaactggtgaatttcaacaccaaacatggccaatgatatttaatcatgaaaaatcggtataaatctaacggcctcatcttttcgcttatgcttattagccagaatttaaattttcaaccttaaatttggagttgattttgggttttttttcaccgtagtttattttttagcctttgcttttagatcgttaagaacacgtacataaaattttattcacaaattatttttcgtttgcaaataagccatttggcttattcctcaaataagccaaacaatggggtcgtaaaaggctaacctcaataaatggaaatcttcattgatcatgatgaataaaaaacatgaccagagctactactatacataaattaaaaacaatattttttttataaaaaaacactactaattggtgcatccaactcacattaatagataactcagtacaaaaataggaacattgattcaatagaataagatgctaatagctctcccatccctaatctcccaagttactttaggaaggttgactttgaagatcgtctgatttctaaccaacatcttttaaggtgttggagaggttgttgtaaaacattaaaaattacatgatttagtataatacattcaattgttaagcatcctgtcacgaaccagggggctgctggaacaacagagtcagcttctgctcctaatctcataccatttgtcgtgatctatgaagtaaaaattgtcattcagataattaatatgaagagaggaaaccttataataccttctagtggcaggccacacagttctaatagccttcacctccacttttgcagcaaggtggaagtaattttacaaaaaattaactaggttagtagagcgcagatgttcagtgcaaaattactcaccagttgtcttcccataaaacagaaaaagtagttgagccttataaaataaaaactttgatgcagggtgttcagcattattggtgattaggaaatagttccagttctaaaccagagatctaccgctgtttacaaactgaccagaatcaaatctatgnnnnnnnnnnnnnnnnnnnnnnnntgcatatgttttacacactttttcaagaacacacgaatgtactgcatgcccttcatacaaagaggaagatagggttagacatatcgtattactatatctgaataataagaggatgatatagttaaagcccttcatcatgctcagaagtaaaagagagctgaaactcactgattcagaagtttggatcactgaaggctgcaacatggactgttcacttcagaaaagattcgacacttcaaatttatctacactgatcacacaaccttatttcgctggacaccaatctaatgacatatattttgacaaaatatgtagcagagaaagtactaatcattcataaattacatcatgacctataaaaacaccatgaacgttgcttaccacatagagcaacaatcgacagaaaaccaggcttgcactgttgtttccagcttcctacagattttcctgcaaaactatgaaactggtgaattttcaacaccaaacatggccaatgatatgtaatcatgaaaaatcggtataaatctaaaaggctaacctcaataaatgaaaatcttcattgatcatgatggataaaaaaacatgatcagagctactactatacataaattaaaaacaatactttttgattaaaaaaacagtactaattggtgcatccaactaacattaataggtaactcagtacaattagcccagcagccatttttcctagccacaacctttaccacaatgcattttctacaattggcctcatttttgttttgaaagcaataatgaggacagaaaacattgggagcacaatttaattttatgtctggaacaaattacgacctggaaaaatcagaaatgcatttgccgataaaaaaaagccagtgaagttgcagccaggtatttgccatgccgctgccatagcctagcactctataagtatatggccaacagaaattgtaaagatagcctagcactctgtaagtatatggccaacagaaattgtaaatatcaattaattcaacaagtatatgacagtcaatacttccattgtagcctaaaaacaaacatataagaaaagaatgcatcgacgattatattctctagcgtgttcagactttcgatatacatattgacaaggcctcacataaatttgaaagtgagtattaaactaagttcataagtgatcttaaaacaagtaaaagaagaccatttggagtgcgtcttctggaacccctgattgccaagctttgtagcatgattcttcaaaggagcaatcaacttcaaatgtctggtccaaaatttcccctcctgatattcataatacatagaacttgtgttcatcaagggataaacctagtgaattactgttgaaacacaggaaacaaattatctccagagcataaggccaatctcacagatagaggtacaaaaccttgattaagtctaacattctacagtgcggactcgatatgcacacatgacagtccatttctattttagagagaaatcaaacttcatgtaaattttcattgatgttgaaaatgaaaaataagcaccagtttacaataatgcacatagaatctatgttggcaagaaataaatcattgcaacggagaagaaaccaagcatcattattatttccatacaaaaaaagagttagagaaacatcagaaattcattgagtaggaccacatcaatatctttatatttgatgaataatatctttacattgttaatgaaagtacatcatatatattgtggtaaaagcagttctcaaatgatttctaaaaaaagaaaaagaaaagaaaagaaaagcatatagcaccctcaaactatcaccaacatgacacacttccgatgttcatggaagtataggcaaattatcatggggtgtgcaatataccagcaccctgaagcaccatacatagcccttgcacactctggaaacaattgatcccaataaatcccaaaaggatatgggtgaagtgattccacactaattaacagagttgtattgtataaaaaacaaacaataatcaatattgatgcagaagtacttaatagcaccaattgtggtatacatggttttgagatctgcagttaaattacagcagttacaccaattgagtttcacaaatgaaaacaacagacctagctacagtagtacagtgtacatctagtgtaaactaaaatgcaatcttaaaataaaatcatgtttaccttcaagccagggcagatggattgaaattcaatctttaagattcataaaaatattgcccctcaaataattcctagggtgacaaatacatactgtatacagaactaaaaaactggagtcattgcctcacatcttttttgagaaggttgaaccaacttaggagcaatttaagtacacaatattcattcaaactcattttcttttctgaatctatgaccaaaataaacatggtttgttgaaatttagtgatccagcaacgggaacaatatttatcatataaacgcaccttaatgaggacaaagcttgtgcctttcttatgagcttctcatatcaacctgccataccacaaaaaaattgccatacaaatgataaggccctgagcttatttattgtccaagacataagaaacaaagagtgatagctgatatgcatatatagtttagtatgaaactaaagaatgtagaacccaaaatttcctagcactggtgaggggataaatgtacaggatacttcaaattttatatcacgcatagaaaaacacaatattgataaagatactgaaaaatggcaagaacaggagaagttttatacgatctttaaatattgataaataatacatggttaattgaaagtactaagaatgaattaactcaacattctgatagtcctgatcagatttgtagccttatttagtaaattttaacttctttgctatgagcaagcattgcctggtggttaaagtcacagattgcacacccgtataaaaataaactgcaaaggagcagcttaaatacctcagttcatttggtaagtttactgtatgctatatacaagtgatctccaatatgggacctttcatgatatccaaacctaaacaattaaaaatcagaagcctcccagttagctcctagaaaccacagttcacaatagtacactgaaacaacacagaaaaagttgctctttttttcctaaagtaattatttagtaaaaacttgtaatgcttcttctttacacagtccacaataattggattgtcacatgctacagctaacaaattcaggggagtgtacatcttacaggacagagggtctacgggagcactattcattacatggtacagtcggcatgtaatataacagctgtaatgataatgaccttatgatagtaatgaaaaacagatgcatacttcaatgaaaaatcatgagcaagcaaaataatgaatagcactaagcatggttcctcaatttgtgctggccacaaatgaatatgtccataaaattcctcaatttctctctctcccacagtgaggatgataagcttcgcagcagtccctgaaagtgaattttatggcagaaaaggaaaaaaatcataatttgccctgaaagcaaatgcaaaaaagagccgatgtgtatattatcatgggtaaacatatatgactattcagctgaacccgttgtgtcctggaactagtcttgctgaaagattagctgaaagatggtagtgttggttatgggacctggcattcttcactaaaattccatttaaggttttataacagagtaagaaaactgatgttagacactatactgaaccgatcactgcatttggcaagctgtacaccgagccaaccaaatgaaattatccatgttggccatttcagttagcctttatgtacttgaacaatagcaacaagagctaatgatctactgtcacatgggatccaaaccgctaggcaattcaaccagtcttatcagaaagcttctctttatcatagattatacatgttagcaatttctgttgcatattctcaacttggacgcatgcatcacatgtcaccaacttgaaatgacgataaacaggtcttaccttcacaacagggcatatgaagaggggaatgggatcagtgcggcgtcgtgcgatctggcgcaaagaggaccaccgtggagaggcgacacgccacgtcaccgacggaggcaaacggatccagaagccagacgcctcgtcgattgcagactgccgctgcgcgcggagaaaggggagtcggcgatggaggccgccgccgcggagtggacgtagctgtgaggtgggtggcggagggaggccggcgcgaagaaggtggcggagagtcggcgaccacgggatggaggtggttgtgaggtgcgcgggggcgggagatcggcgaggcggagggacggcagcgtggctacggctcggccgcggtggaggcagcactggcggcgctttgtcgaaggagatcggcggcggcgtgtgagaaggagagaggattagggcgtggaggagagagagaggcgcggatcgggggatgcgccaagggacggaggaggcgagcgtgaggaaggcgtcacgggcggcggggttgggatcacacgcagaaaagtagccgttggattaagatgttaccgttaggtggctgagaatctgagacgtactccatattgtatactagggctgttttgcaagagaaattcccaaccccactccctcgttttctgcacacacgtttttcaaattgctaaatagtatatcttttataaaaggtttttatatgatagttgcttaaaaaattatattgatcctttttgaaaaaaaatacctaatacttaattaatcatgtgttaatggaccgctctgttttccgtaagaattgttccagttgggaactgggagcagcgaacacactcctaggccgtgtttagttcccttcaaacttccaaaaatgctgtcacatcaaatatttggacacatgcatggagcattaaatgtggatgaaaaaaacaattgcacaatttgcatgtaaattgcgagacgaatcttttgagtctaattacgccgtgatttgacaatgtggtgctatagtaaatatttgctaatgatatattaattagacttaatagattcgtctggcagtttacaggcggaatctgtaatttattttgttattagtctacgtttaatactttaaatgtgtcttcgtatgcttaaaaaaaaaattggccaaagaactaaacacgtccctagtactgcttaaccgttggcacgcttgtactccctccgtcccataaaaaaccaacctaataccggatgtgacacattctagtactatgaatctggacatacatttgtccagatttattatactagaatatgtcaaatcccgttctagattcgttttttcgggacagagggagtccttgagaaactatcatattataatgtttatttattcgcacaattatacaaagtgcatgtgtatataataaaagttattttcacccattacaaagaacaagcatctgttggttactcatccgtatctagaaaagaaaaaaccaatagaaatcatctccttttccgttggatgtttctggcctactccttcccttcttatcctcgtgcgtagagatggcaacagagaattcaccatcgggggtcacatccgtgtccccatccccgtggtgatcgaagcttatgggagaggtcaaagccatagccagtagccaacaagggagagaaacggtggggtggcagcggagatgggtctagaataggtccctagctacaggacacgcaggtcaccgcggaagacggggagtggagcaccatgcctgccccaccatccccgatggtgatgagttttgcaccattagattccccgtgaatggcaggtaccatccatccccattccttaggccttgttcggttaatccccttgagggagggattggaggggatttattccacacggactggggtgtggaattatttcccctcaatcccttccaatcattttcaatcccctccaaaccgaacaatgccttaatgtgtgatttcaccatggggaatcggtgatcgagtccccattgccatctctactcgtgcggcccatccggcatgcctccgtttcaggccgtggcctgcctcatgctgacaggtatggccaggatccacctgtcactcattccccaacatctagttgctctccctcccgagccggccacaatgcccacgtcgctgccaaacccgcgtgccctcgctacctccctcattgccacgtgctccacctcttcccccactcgtcccgcggaaaacagcatggattcgagcccccacaacctccgtgaagtctgaagcttcctcaccgccgtcgcgacggctcggcctataaaaagctccccatttccgctattgtccaccacctacggaacataaaaaaaggctggggtagagatgggacgggcagggaaggaagcagatggatagggttgggggtaggaggggaggggatagattcggttgtttttcggaaaagcccttgtgtttttcatatttacaacactacccctaagagcagaatgttctcttcttcgtgtcgcatttctgtaaaaattaggggtgttttctataaaacggaacatgatgttagtcggtgggaggacgtgcgcgctattccgtccaaacacgaggactttttttttgcataaacaccaccacgcggcatttactacgagaaaggttgtgcgtggcgtacatacaggacgagaccggcacaaccggtggaggaaacagcgaaaaaaaaatcatgtcacccaattgaggagcttctgcacctgcaaactatatgggacaactacagaggagccaaaaaaattccaaaaaaaaggagaaaaacgatagctttaggggtttaacatattaaagatttcatccaaattttgtaactaattcaaaacgattttactatatactaagcgattttggttggatggtagtagaagggtttttctaataggactaaagtaacagagataagcgattttgtttggatgaggaaaaaaaagatgtgttccatttaatcgaaatctcttaatatttttgggacggagagagtgtatgttgataaattttctcttcaaacttaacaaatcaaaaacagtgtaattgtaattttaaacaataataattggtaagaaacttttacctaattttaaaccatcagatttatttcaagatccatgcaaagttgtgaaaaatatcatagtacacaaggtgaggagatttggtctcgcagccttcactttaggaaaatagcatgttatccttggatatacaaattatattatagttacatataatttacagtataattacactatgattattttgtttacatctggtaaattttagggaaaaatttactataaaaattttatgtagctaatcttaattcaaaattcttggtgtaggtatgaaccgttctactatttctttttcttgggggtgtaatcctgtacgttgatttctatcggacggcgtagatagcatccgctggaaactttgccgctattaaccgagccgagctgcccattctcccgcggctgcgcttccggcttaaaccctagctctatggccgccgccgccgccgcctcctccatggcgaagcgcaagcaacgcaaggcggcgacggagcaggaggtagagaaccacgacgaggccactgtcgccgcggaggcggggcccgagaatgacgggcacacggcgcacgccgccgaagaggctgcggccgctgaggagggtgtcgagcgcgaaggaggaggcgagggcggcgcggagggggaggagggcccggacgctgcagccaggggaggtgaggagggcaaggaagaggaggagagggaggtgagctttgacgagcttggcttggacgagcaactgaagagggctttgaggaagaagggcttggacaaggccaccccgatccagagagaggccatcccgctcatcctggtgcgtgatttctggcatccatgctttgttttttttttgctttgttttgttgaattactggaaatattcgtcgttaatatccaattattagtgtttcaatgattgattactgcatttgtgatttaagccctctctccgttgtgagaagattaagcatggataatgtgatgccattgtgcaaattgttgtgccgtttgcatatttgggttgtctgctttgtctggtgaaccttttcgattagttttgctatatttctactgtttgtcaggggcagacatgctaagtttaagttatttagaaaaaaaactttcaaatctaattatagtataattgtaatataattctgatatagttacatttgcatgtttttttcccaaaaaacttgcgacgtttttttagcaattccagcagacattcaggttttcaataatttgtgcaactgacgaatagtgtaatactgtgatttcaggaagggaaggatgtggtcgctaaggccaagactggctccggaaagacctttgcttaccttctccctatgctgcatgagctattgaagttgtctgcagaagggcgtatccgaaaatctgctccaaatgttttcatccttgtgccaactcgcgagttatgccagcaggtatcactcatctacttgttatgagatgagatgatttttgtgggcagtttaatatttattattagctatgacgtatgagtagttcaatgatctatgtcaagttgaggattaattctgaattcataggctacataagaatggacatatgagtatatcttttaatttaatggcagaccctcatactagtcctttggtttattttttaatgtactgcattatatggtcataatccataacatctatgtgattgtttatttgaattgcttgtggtaggttcataatgaggcatcatctctccttgaattctgtacatccaaattgaaggttgtgcaagtgaatgcgagcatgtcagacaaagatattgtgagaagtctatcttattctgttgttattttctgtaaataatattcatgtttttcgtatgaatgctggcaaactaacttgtttcttactgttgtttgcagaaagttgcattgtctggcccccctaatatacttgttacaactcctgcttgtgttgcatcatgcatatcaaagggcattatccgtggatcatctatcaaagaatcactatcaatgatgattctagacgaggtgcagtttatttgccttttcatgatttattttagtttgatacatatcatcaatgggtaatttgataagattttatttccacaagggatgataattttctttatacataaaaaatatggctgtttaaactgtgtatgtttctacattttggctgtcgtgcccttcctcaagttaaacaaaatacttttgtgattattttaagtgagtatggagtttattttgtatgatcacataatgctgacattgacatgtgccgctgcaacagtgtgaaatttgctatggtgttgaaaatttcaagaacattttgacaactaatatgctgtcttactctcttagactgttgtatattcaaatttgacaccttttctgtgtaatattatactaagtttcttttgaaggaggtactaatccattaatggttagttctcaggctgacctcctcctatcctatcgttgtgaagatgacataaaagctctcgttccacatatcccaagaagctgccagtccatcctgatgtctgcaacgtcaaggtgaaatttggttccatcttccttccttttcttcaattgttcaattgttttgattttgcagttacacgatttggttgttctgagcatcaacatttcaatcaaatggatggaacctgtaatttaaataaccaaaaattgggatttttctgttttgaatttttaccatactattccagcatgtctgtcattgcatctgttgatgagattttgctagcagtcaacctggaggttgaatccccaatattgctgcccttgagttggtagaacactgttgtagtttgattgtccctccttgcccttgcttccatttagatttcatatatttggtctgatagtaacgttgacttctttttacagcgctgatattgagaaactgactaagctacttctgcacaacccttttattctgacccttacggaggttggtcatgcgaaggatgatttgatcccaaaaaatgtgcagcagttttgggcaagtactttttcctgcatttcagacaatcagcctttcagtcgtatcactgaaacatattaagatccctcttggatatccatagattcccaacaaacatttaaacaacctatggtttcatgttcctttctagtattttttctggtacaattctttagtggtgattatttttgccctgctgatttccccctaagctttcctgtagtagcttgtatatcatgtactcctattcaattttgtccacagatatcatgtgatgctaaggataagatgctttatatccttgtactcctgaagttggagcttattcagaagaaagttctcatatttgtaaactcaattgactcggcattcaaattaaggctgtttctggagaaggtaaaatggaaccactaccttacagtagtcaataattaaacacgtttgatgatttggtttcttaatttgttgtctgtaatttttttccattgttttatttcagtatgttaagtgcagtccaaaccttaattttaggccattgtctgattgctgtctgaacataaatcaaagtgaaaatgttgtgctagtctagaatacttggtacaagagtgtcgagtttttgaagactccatggtaaacagatagttatggggcagcatgtcaggatatgtttctgttgagtctgtagaatgaatctaagtgctagattattggacacttgaaaactttcacaaaatactgaatttggaacgttactttgtttaatcttaattgcatgtactggagtaagagtgtataaagtaccgtggactgaagttaaacaggccagtgccttgtctttgattgtcatattgggcatgttatggctcctcgctatgatatttgttacattatttctttgtgttgcttttttctggcagaattctttgtccaacaattttcttccttggttcttgcatcattttttaaaaataaatatgcttattgatgaataatttatccttatggtgtctatgttgtacttttacagtttgggataagatcttcagtgctaaatgctgaattaccacaaaattcacgcctccatatcattcaggtagcatatccacagtgcacgctcttattgctgctattgtgctttattattacataattgatgataattcccactgaatatatctttctctttcaaatgtttgttgaacaagtaaatctcttacctatgtttccatagtttttcatcttattttggattatcataatctttagggaaactgaatctggttcagttatatttagtttttaagcttaccaacatgtccacatcaaagaatttccagaacaaaaagtgagtgggctccaggaaatgtttaggctctagtgttctaaagaagtctgaaagaatatcttcttgcgttgtcctaccgatttaaactattatctttcttttaggcattcaatgctaggctatttgattatctgatagcaacggatgacaataagtctaaagaggagaggcaagccaataagggaaacaaaaaggattctagggtgtcacgcaagcagttgcagcaaactttagatgctgaattcggtgttgtcagaggaattgacttcaaaaatgtattcacggtaagttaatatattgatatatgcaagcatgccaccagatctcattgtggccagagggtaacttgagcatacaactgtttgacatactttgctatcattttgttttaaaatagtattttatcttgagcctgatggtaaattatttgttatttttatagttcccattcgaccttttgtttctgaaacaggtattcaggttgcaggattgatattcttttatatttggccttttctttaggtagttaattatgacatgcctccagatcctgctgggtatgttcacagagtaggaaggacagggagagcaaataaaactggtgcatccatatcgcttgtaagttcaccattttatgtggctcaataaaaaaaaatcatcgcagagatagctaacttgttttatagatcctatctggtatttatttattcctttggtttggtgttggaccttttcaggtttcaccaaaggagaatggcatttttgaagatattgaaaatatgttgaaagatgttgaaaatagagacaccagttgcatttcacctttcccattacttacaaaaaatgccgttgagtctttacgctatagagctcaagtatggagcatattacaatggataatctattcttttgtattaaaatatgttttcaattggtatttttgcctctattcaatatggtgttagaattgagcattagcattaaaagagaagttaggcatggagaatctctttgtttagtagtactagtatgagtggtaaactggtattccagccagaactccctattttcagagcggtttcttgctagtagatatattgttagttgtcaaaacataaacttttgaaaccaaagactggtccactttctgaaactctggctaggcattggtcgagatatattctatagtcaccactgactagtaaaaggacgaaagctcatctggtactatgtcacctctatccaactgtaggcagcaatggttttattttccatatatggctactgttatctatttatcgccaattccatgcgtcacaatgccccattttatgctttctcggttatttttaccaaattctcctctctttttggcctaatcctgttagtaaacatttaggtgttgtgcacgaatctctcttagcatcgtcgtgagactcttgttgtacagggtcactcccatctaacatgaaatatagccaaagatatttctacttttttttagtcttgggccctcatataccttgtgagggtgtcatctgttttctgtaatacaatgcatgatgtgccttttagcttaagagggttttcatgacctaagctgttgggctaatagtaatctggccatgttttaaccatattattgctcctggagtgcaacattatgttggctactgttcattttgcaactcatatgtttattgagtttatttgttcatgaatcttgataaatcgtactacttggtagctattttttgttctttcttttgttagaacatgcaagagcctcccatttcatcaagacatctggtagctaatgccaattgacacatttacaggatgttgccaggagtgtgacaacccgtgatataaaagaagcacgtcgccaagacataaagaatgaaatcctcaactctgagaagtaagaaagtggttgatcattaagcaaatgcacatgtcatggggataactgaatctcatgcaaaaaaaaaagggaacatgaatatagccttgcttgtttaatgtttagagcttcttagcaactttcttctacactatgggtgccatgtcatcttttccaaaaaaaaatcaaaacaaacatttctttttttacatagaaggaaacacacaagacatcaattgtttatttacttttcatacatttactagtcattttctgcctcatgcttttcttctaatagtgaagctatctcttgtcatcttaggttgaaggctcattttgatgagaatccgagagaccttggttagattcattttgttgagaacttttctactattgaacttgcctaaattaatgtgtgtactgaatctatttcttctttccagatttgctcaaacatgataagttattgagcaacaaggaaatccctgcacacctacgtgatgtccctgagtaccttattgatcccacaacaaaagaagcaagcaatgtagtcaaactttcaagggctgctatggatatcgataagccacggaggaggaaaagaatgggattcaagggaggatctggcagaagtagtgatccccttaagactttctctgctgaggtacatccattcattcaataactaagcaaaaattaggttgaaaagatattgcaagtttgcagcttacaaggtcatagaataatcatacttttatttaactgttacgaaccttttagctctactttatcggtggtgagatattgatgccatggatactagattctgtcacaatttgagagtgcagttaattacgaaaagtcacggttgaactgatttaagatattgtttgtttagctatcttttttcttaatatagttgcaaatgtgtttaaaaatatagttgcaaatggatgcatttttccagctacatatgaggtgaaatgtggtatgacaactctggaaaattaatgagcaaaatttcaaaaacacattgcatttggccaaagtaccacaaaaccttaatttcaagccacagctttagagacttcacataactattttaagcattgtcgtcacatccaaggggcaggtccaataaatcattccacaagcctgtttctttttgttgtgctattttgaaatttcatcatgactagcaagagatagggtgaaacgctttgaatacagtatgaggcggaaatgtgtataatcactcttccattcagtcactctaccacctagtcatgctggtgtttcgatttgtctgtcatggtaattatcctctatgtaaacaaacaaaaatgggataatcttgtgatgtcaggtgtgtgggtctgggcttcaggtcctatggaaacatggcagtgcttaaatgcagtggtttagtgaaatatgcaaatggaagtgctgttcgttgttccttgaaagcgtactatttgtggtaataaaatatttacaaaagtagcatgaattttttagatttactttggatatatttacataaattccatctcttttccatgacaattttaaaaagacgcacaacatagcagcctcaaattgaaccactatactttggatctatgaagcatcaaatatttctaagttcaaatgagcttttgttgattagagatatttgcaatcaatctattatatgtgattactgatcagttattccgtctggctgcaacatgatgcttccacgctattgactcttgttattctgatctcctgtttgcttctaggggaaatcacggaggcgagggaggaaggaaagagacggagaacaggatagaagaaagaggaagaaggtggaaagctaatcttttgtgaagcgttcactgccaagtgcgcacagttttgtaggtttctggtatctcgtcctgtaactttgtagcatctccagatatagggggataacaatgtcaagctttactgaatgctgcgtgtgctatgctatgcacaccattatatagacagacgagtagagagtttgtttagtttcagttcttctagaggacgtgcatattgccattcctctatttattcgaggaatatcagcagaaaactatgtttcaagatttttgttgtataaaaaattgcataaaaaggtgatgttttcaggttaagacggctcaagtaaactctagagagaacactgaagctctagaagaagaaaaccgctgtatagaactctattcagggctataattatattcaaattggaaaagaaaaacaaaataacgaccataggtgagttcatatacagttgactgcagattaatgaaggtcagttgccacttggtaacatactggcatgatcattcgaaggcgattaggagactagacgaggaaagccgttgacaaagcatgattaatatcttaacatcaacttttttgaatggataacatcaacttcttgctcttatttgagatagtactattctattccatttccgaaatgaaatcaagatcctatattgacgtcaacctgtgaccatcaattcagtgaaagtcaacccttgtttacggtcgatcaaatgtaaggtaatgtcgttctctagttcctacgaggatgaacctattcagacagattcaaaccatattcaggccgattcactcataaccgcagattcccatgatgaacatgatcaaacatattcaaacttatattcaggctaattcacactatcttcagtcttcacacataaccgcagattcccattcattggtagctgcaagttctcattccaaatagtgcgcaaatcatgaactttcgacagattcaattccttgaaaatttgtaccaaaagtccatcctactcgtttgcatgcttaagcccatcaatacttggtcccaatcttggagctcatgaacaatacaaggtttcccaatttccacaatctaaaatacagtagcgatttacagtggaatcagctattttgagctccaactgtacaaaatcttcagatgccacatgaaaaccatacactatggggagccaagatatggaaacaggcaacggcaacgaatggttagggggcctccatctatacaaaaattgatactgcgagcgctttatgattcaccaagcaaccgtgcaagctataccagctgctcatttttcaatcttcatggaacctgaagtgtgcaaaaaggaggaacatttccatgagtttgatatatcactagtactaaacataatttttgacaaattttggatcatatataccagaattgttggtgctgccctctgccattgcgccaccagggttgtagttcaagtgaggaatgttctgaagtccttcccacatggcaggtatctagattcaaggttcacatcaacccattgctatgattttgtttattcatgtgtgattttgttatcttaatatgtgacctgaagttacctggttaactgtggagatgtcctgaattgttgtcccctgcaaaacatctgcaggattggaaacattacacagcatttctggctgcatgattccttggttaaaatgagcaacgagggcacttgatcctgggtcgactccgtagaaagcaagatgtctatcttgtgaaagcatcatctgaaaataataatttctgtgaacaaaatttatctataacaaattcttaaaaatcagaatgatctgcagttgtcattacttgtttcgatagaatctgctcaatatcaaagctaagctcagggttgacagttgcgagtttcatcgacaaaaactgcaagttcagattgtgttagattacagagtgatattccaactgtccaagaaataactgaaccaccaccctaatagtacctcaacttgacgttgtagtgactgtacataattgattatctcatcaagcatgactgccttaccagtgatctgtgaggggacaacagtaagttgcacagcacaagatagtctcgaagattttcttgcagataaaagaagaaatttaccttactgcagcctgggacaagatcttgaagcagcttcatcctctcgcttatcttttttctcctcagctgaaaagagttccatcaactcaagaataagtaaaggaagatcacaaagcaaaactgaaccaggagcaagagtcaagagtactactcagaagcttactctttctgcaaggctgtggctattagtggcttggcctcgctttgcccggacatgaacataatcttctttagtaccatcaccatcagaagaatcttccttgctttgcattttggagcaactcttttggttgtcctcctccattgatatcctctcttgctgagatgaaacctctgtctgttgatcaccaacattctaaaccaacaatataatgcatttagctattgacataagagaagaaaccatccacatataattccacacacagattatataacaaagcccagaaagaaagcatacttgtatcctgctacttgctgatgggttcaacaaggcaatgtgatcatctattcctttccttctctttgcaccactgctatgatcatcactcagttggatattttgacagaatgtgcctgtgagagattatcgtcactattaggatttatctacaaaatcattaccttcaaaaacatctcaacaactgcacaatactaagttaagagctactaatacctcatcaactgcataatactaagctaagaactactaaccgttgggtgatctatagagtccctctctatcctctaacaccatggggtaagcttgaaatccaaatgcgccactgttataccccatcttctgatgcagtgcaacagaatcccagttcacctccaagaattctttgccactatttggaccaggacactgatcagattgctggcctgaatacatctccaactgttcaggaaacacctatctttccctgttccctgttcagcagtgcaaaatagagaagacatatgagaaattcagaactgcaacaagattgccccaacagaacatagaaagctaaagaacaccttgaaactaaacatagaaaactttgatcaagcctggaaaacccttccattcaaatgaacagctcaactagtaatcctcacacagtggtgaaatttaaaagcaaaccagtcccttcaagaaccactacatatcccctatctaaagataaaaagaaggccaaaagaaggatcaccatccaggaaaagttctgctgtaacagctggagatatgcttcagagccttaaggaacaaaccaaatctgccaccaaagaagaacacacagtccagaaagtgaaactttaaaccccagagcacacaaagggatgagagacacaggagaaatgaactccatcattaagcaaacagcacccactaacttattcttttggagcaaagtgatgagactggaggagagcctctgcgcttcctaaaagactcaaaatcaccaaagctaattggaaacagcaaaagcctaccaaatcttcaagaaataggcacgtaccacattaccaccgttgtaacttgaagaaaaagagtgtttgtttcactggatgtagagcttccagacaagttaagaaccaaccaagaagtgcgtctccttttggatatggctaggcagctagtcccaagaagctcaaaagagcacctaaaactgccccaaaattgaactaaaagaacctatttggatgatgaaatcatcaagatatcacactcaggggcacacagaaagatgaacgccccctcatggcctcacagaggatttgatcaccctataaaatctcaccattacctaggaaaatcacaaatgtgaagctaaagaaagaacactagtactgcatcagcaaagcttataaaaggaagcagagtgggcaagctactagttcagactgaacttggcgagggcgtgaggccatttgaatgcacagatagctggactaggatctgtgagacattactagggcgttgaagctttccgagagcagaaggaaggaaagcaacaacctttgactactccaccgtggtataaagatcttgaaaggaacagaagcaaaaatgttcaagacaataactgttcgaaaattacctgaccgcgagatcacatgaacccctgcaagagcccaccaccaatttcacctgcaaatggagacatgtgtatactgaaacaattcaagaacgcaaaaaaggaaaaaaaaaaaacagcagcttgatgatctcctccctttcaaaattctctctttttttaatctttctccgcagcatcttacctagtgctagtgcgcatttggacacagctcagttgtcttcttggccgcaatttgaccgcaggggagaatgaatggtgcggtgaaagattatatggacaagaagagggagcaaaagggcaagaagagagctgcaggctaatgtggtgtttgttacctgccactgaggtgaaatgattccttcttgccctctggcaaagggttgttaaccactgcaactgcccccctcctctctctctctctctctctctctctctctctcatctctctaatatttccaaaaccttagcgtaagctaacacctaatcaaaagttacaacagactagtgtaccagtagtagtagtttactgcttgctctactttagtacaaaaagaatagctgtagcaaggagaaaaataaagtagggagtgaaaaaaaaatagtagcatacagttctcacctgcccaacctttgcataccctcaatgtccagtgggccccagcttgggctgaagtagaatgtagataagtattgatgaagaggtgccctactgtgattttctttcacagtgttgtttataatattggctctgtagcagtagaaacactagtgcacaactgcaaagtttgaaataagagggaaattttgaccaagtagcaatagtagtaggttaggtgatcacataaactatatcagacagcaatgcttctactatgttccagtcaagaagattttacacaatgtttagtataccattttgcggccagatacaaatagctcctcaacagctcaaccatttttgcgctcaacttctaatgtcccagcaattgtttccatatgcactatgtttcttattctagactagatataatcttcagtccaattttaccctttattagtaacatgctcatgcattacaatggattcatatgaagttgcagtgcgcaggcctataagttgggatgggatctagcatattttatttttaaccaatagcttagtttttatttgtttcctctttgactgtcgtttgtttttcttttctcgccgacaagatatggttgtgtgtgcaatatgagcgggagggaggttgcaattgtagagatatttgttgttgtagcagcattatattaacccctttgcagtagcataaggtcttttggagagcttgagattccaagtaatagccgataaaaaaagttgattttcctagctttttattaggcttgtagtggattctgtggttactaattcttaaaacttggtgaaaacctggattgtttggggaagttagagaaattgtagctgccacaaactccctaaatagggcctaagatactaagaagtggctgacgagaatgtgaaaagcataaagttttccaacttctaaattctattttattttctaggttctattactacatattcttatattctactatgtgagaattaatgtgagaatttaggttgtttacaggagctgttagaagaagctgccgatgctgtaaactttctagataggaccatgtaatagtcttttagattaaactacggtggctttgtttataaggtgggggagggaaggtgcttctcttccacaccaagctgcaagctttgaatggaggggagatctctttctaactgaaaaattttagttcccacgcaaaaattttatatcatgtcacatcaaacgtttaaacacctacatgaagtattaaatactccctccgtcccaaaaaaaggcaaaccctggatttccgtgtccaactttgactgtccgtcttatatgaaatttttttataattcgtatttttatttttgttagatgataaaacatgattaatattttatgcgtgacttatctttttaatttttttcataattttttttaaataagacggacggtcaaacattgggcacggaaaccagggtttatcttttttaggacggagggagtatagactaaaaaaataactaattacaaagattgcgactaatttacgagacggatcttttaagcctaattgctcaatgatttgacaatgtggtgctatagtaaatatttactaatgacggattaattaggcttaataaattcatctcgcagtttacggacggatcctgtaattagtttttttattagtgtccgaacaccctatacgacaccctatataatacccgatgtgacacgctaaaactttacacccctaaatctatacagcccttgacatactgctatctatttctacacttggtcttttctctccttgccagcctaccttcagcttctctctctctctagttctacgccaggggtgagagggataggaaggaaaaacataaggaatcttgtaatcttttcaccttcttgtcctctacagtctgaaatgcaaggactggctggatatgggggatatggtcaaagaaaacactgtaaggcatcctgctgcttgcttgcttgctgaggtgtctccatctccacaagatctttcttttccctgctttctttatggatacaactagagcccccgaatttgacaaggagattgatgaatgacttcagcagcaacaaatcagcacagctctacaggaaaatgtttaatcagctaataaatcagcacagctctacagaaaaatgtttaatcagctagggcagtagcagcagatgggagagactcactgtcatgagttggggatgacttgggagtacagtatattaccctcacctagacacctaatttgcatcccaataagagaatctggggcttgtattagagcaggtacaatagcaggctattaaccagctgtaaacatattttaatacgataaacgatgagagagaaaagcagcgggctacatatctgtagccagctgcagcacgaacttcaagacgcaatgtgtatataacatgtgggaccatatattaatagtatagtaaacaattattgtataaattggctattgcattggctatagatgatttggagctaatagtgagctatactattaaacttgctcttatgtgtcggtgtgattggctgtttacatgcttgcagtaatctaagcaaagtatatacttaactacggttctgtacagattgactgtttttaatactggaagcattagctgttcctgatcgcctgttccattgatgttcttgcaaagcgatgagagtgaaagaatcatggttagaactactacaattgatttaataatggtttattatgggtgtattttgacgtgacactgagaatcgatcactccgtgccaaatccacagcacaacttttctgaagatttgagagctggaatggaacgactagtcattgtctagttttcacggttaccaagtgagctactagtgcactaggccttgtgacatcacgcttgtactgggtagagctcacaagttttgttgtttaatcgtttctcctgtacccaaggcgtaccgtccctctaacaaaatctctttctttttagagcagaatgcacacggaacagaggagtttagattagtcgctcgacttgattagataaatggaacttgtcacaatagagagtgcgaataagatggcaattggttttgttcggattgagataaggtgcaattggtactgcacctgcacaatgaagactatggcactatttagtttgcaccaaacttctttctaactcctaactttccatcgcatcacatcactttcaaaactttcctacacacataaactctcaactttttttcaaactaccaacttttcccaaatttctttccaatttcagaaagtaatttgagccgtccatattttaatctaacggttcacgttcgctgctatgggatgtacaaaacaatacttttcgctagagttaaatggtattatatcagtgtatagtgtattgatctggctgctttctcatcacggtggtgctaggacaactgcttaattaagttgtagttagactagtaactataccggatcctgactcttgagtaaaaaagcatccaatttttcaattgaaggcccagatcaaatgctacaatagttctatagtgaacaccatggatgaacaattacccatctaatttgactcttggatttgcatctaaaaccctaaggccttgttcggttaatctcttagaggggatttattccacatctattgtggtgtgaaattattcctacttaatcccctccaattctcttcaatcccctctaaaccaaacgaggcctaatgtgatctctcaataagttagtacaatcacactagaaactgcatggaaattagatccgcatcttaatactgctctattagtgcacttctgtccaatcatgcttaatgctaagtctagtgacgctgacctcccatgatttagtaaattctagtcaccttaggccgaaacgccagcgctaatatatattgcaccgatcagctagattgagatcaaatacggttccgtaaggactgcacgtgattttgatcggttcagatttaacgctatcagtatccaagctatggtaaaaagtgcagaattttttcggctgaataatatcttggatgatctaactgttggattttcatcggatggtcctagactgcaggtgaaccgaatcccctaaagctttataccttagcgtcgttgtggttaattagcgccgagttaactgtctacttctgcaattagtagttcttagcacaattcattctcggttttgtaagatcatcatttcgtcaaaatttctctacaacttacgaagtattaccgtaagagataatccggctataatcataaaagaatgggccggccaggtagctgtttgagctgaattagcatccaactcgaaggctccaagctcctcttggattacaaatcgatgaactgaatcagccagccactgaaaccacactctcctaattaagcacgcccagttaattacagggccgcatgtatacggtgaattgtatgatacggcaaggcacgcgtacagggcgcgtaatgatcatatcgtcgcctcccccgatcgatcgatcgcccggtgtgcgctcgctaatcaagtgtgcgcgcgatcgccgcgtcgagagctcgcgtgcatcaatgcctcccatgatggagacctcaccatgcaatggacgagaggatggagaccggccggccattttaattttgcatcagatcgattagtttagttaattaattcccgtggacaatcataatcatccggtcggctttattagcgcgcgaacaacagcacaaattaaagccaaggtttatgttggcgcaaaagttgattaatttattctgatctctgaattctgaatttggattttggaattcagaatgatttggtgttgggcacgaaaatgtacgattacttaggatcctggagagtggagagaccgattcctacggaggaaattaattatttaatgaacaacaaaccaggttaacagtagtaccgattaggcagtacaacaaacaccaaaaattaaccaagaccaaagtgcctcccctgctttaatactactactatatgggttacgtaaagttaacgaagagatcaatgtggtgtgcaggcaacagctagatctgctcgacattattaccactcctaagctacagtagtaagtactttcagaaagaggagtttgcatgcatgcccggacagatttctttggcagagaggatcacaaataaaagcacttcttgcaagttgcaaagtgtacattctgtactagttcattgtacaagcaggcagcagcttctgaaactgtgaaatccaacatctcaggttgctcacacaaggctcctctttttctttgagaggacagaggacactgccggatggtagcaatggtagcggcccaatgaatgttttgggccaaagagaaatatcctgagcaggccattaaatcgagctcgtactcagcctcaaagcccaatcagcccaaaattgtgcagcaagcccatgaaatcgagttcgttctcagcctgaaagcccaattagttcagtctccaggctcaatattgttcagaactagacccaatattgttcagtctccaggctcgccttgcacaagacttaaaaatgctttgggcctgcttgaaacaaagtattcacccagatatagaacaagtagttacacaaagtattttcagaacgtacgtacactcatctctgtaaacatgtataagtctaccctacttttataagcacctcctaaagatacaggtgccttattatcgacaggtacatcgtctataattgaaagaaataattaaccacaaacgcaaacactcatgtaaaatctaagactaaaactcgctcataaaatgtaattttgaatgcgtggtgtaaataatcagcgataataattcagtaaagtagccgaaaagaacaatataagatcttcaaatgcaaaattcgtagaggttagtaagtactagtaatacgtatgatttatgttgttatatacacatacgcgtcgaagcataaacagagtaatcgccctctagctacttgttcgcccactaaagcctactcgcgccgccatggatggagagatcgatcgaggcctcgaggggcgccttagatgccgccgcggaagaatggcgcgccgaggaagtcgctggagtaggtgccgccgccgttggggaagagcgtgaggaggcagacgacggcgagcacgagcccccacgcgtagcgctcgctccccagcggcgtgatctcgtcctgcgccgggatctcctcgccgccgcggacgaacgtcgcgaacagcccccacgccaggcacagcacgctcccgccgatgatggcgcccgcgccgagcgccaccgacgtcgcgaacgacagcaccgccgccgcgccgcgcccgaacagcgcctgcgcgatccgcccgccctccagcctcccgcacggcagcaggttcagcgacgtcaccacgatcccgagcagccccgcgaacgccagcgggtccaccggcacgccgacgccctccaccgcgttcggcagcacgttcccgagctcgtcggcgtacggcccgatcaccgcctgcacgaacgacagcagcgggttgttgtagaagaactccggccggacgaacagcgcgttcttgccgccgttcaggctgccgtcggagacgaacgcggagacggcgagcgccaccgaggtgaggtacgcgctcgccgcgcgcgccaccgggatgtcgaacagggccttcttgttcggcagcagcgactcgtagttgttcatcacgccgaggcaccccgtccagttggacggcaccaggaaagacgggctcagcttcacgccgtacctcgccgccgtcagcctcgtcgcgatctgccatggatcatcggccggattggtccaagaacacgccgagatcagcagcataagtgagcagagctcagcggcagatctttacctcggatacgccgaggatggagaggaagccggcgaagagagggagcacgtcggagacgtagtcgtcgaacgtcgcgccgggcttgaggaagaagccgctcatgatggcgatcgtcccgaacgtcgtgacggccagcgccacggcgctcaggtatccccacggcgtgctcagcttggtgatctccagctgcaggtcgatctctgccttcggctggaccatgcagacctgatcaatccaatcacaagaacacgccaagataaattgctttcaagtttcgacgatccataaatcaaagccacaacaacatcaatcacgagtgatcaaatgcaatcgataacattatgccacaagattataagttggtacctgttttgtgatgtcgtcgttcttctcctccatgaaccagagggtgacgtctgtgccggccgcctcggcgatcttcttctccagcttcggcctcacctcctccacgggcttcctcaggttgccgatgaagatgccgccgtcgccgaacctccggacgtccacggcgaagaacgtgtcgtagccgaagcagctcttgagctgcacacaccaatcgaccaaacgatcaaatcatatatttttttccctcatctactcatcttagcccaattgggaagaccgaagacgtacgtcaagacgccattgatataccttgttgaggtcaagcgccttgaaggtgttctcggcgagctcgagcctctccttctcgcgggcgagctggcccctagcgaggccgcggaggaggccggcgagcgggttggcgtcgggctcgcggtcgagctcgcggagcttccggtcggcgcgcttcttctccagcttgatggcggcctcgatggacgggttccccatgaacctcttgaactcctcgtccgacctccagtccacctcctgctgctcctcctcctccaactcctccttgctcttcttcacgccgccgccgtcggcgtctgcgacaccgttctctccttccacggcgtggtgcgacgccgtggcggcgtcgtcctgtccgccgccggcgtggtgcgactccgccgccggcgccgccttctcctcctgctgctgttgcaaggagcacctgacgaggaggcggctactgcttcgcctgagaggcctaggcttgcagtactggttcttggagaaaagactgaagcttcttcttgagcttgtactagttgcagtgttactgctgctgctactgctgaacaagagagaggtgacgagggaggacgacgccattggcgacgatcgagctagctagcttggtgtgtgtatgcttgcaagtgattgttctagctgttctttcttgcagatctgagaatggaagctcgtaggggagcttaaaaaggttcggaaatggagaggaggaggagggagagttctagaacgtcgagaaggcgcggggaggagtcgtgaagactgcgacggtgaggaggctgagctgctgatcgagtagcggcggaaggcgacgaaggagttgaggcctcggcttatccaactggcaagctgaactgcacggcacctgcacacttggcggcagcagctcgcttgctcgtgtagtagtcgtgtggcccctacattgacggactacttgccacgtttccattgtgggcttaaaaagagttgttctgaagttggctcccgcagtcctgctcgtcctgggaaattagaaaatatgtggtgaaaaatctaaaaactaccgttaaattaaaaaataaacgtataggattcattcacgtgatcacgagtttacttgtaacaaaattttactcgtgatgatgtgaacgaatcttgaacatttatttttcaatccaatgataatttttaagttttcaccacatatttttgctgctcgtcctagctccagcacaaaatatggagtataccaatttgagttcagtactatctccatttttagtactactacttgtcagtgttgagctcaatatgatactaaggccctgtttagatcccactccaaaattttacaccttatcacatcgaacgtttgaacacctgtatgaaatattaaatataggctaaaaaataactaattacacagattacgattaatttgcaagacgaatcttttgagcctaattactccatgattgacaatgtggtgctacaataaacaattgctaatgacggattaattaggcttaataaattcgtctcgcggtttactgatggattctgtaattagtttttttattagtgcccgaacaccccacgcaacaccatatataatattcgatgtgacacgccaaaactttacacccatgaatctaaacatcccctaagggctatattagaggtgcaggaaagtttacaaaatttcatcagaattagttcaattcccacgaaaatcccttgaaatttcacaattccatttctaaatacttatcagtattaaccgatactatttcaaacttaactataataacttttcattggattataatgaacaaaagttgtgtagttcttattttgagagggtaaaattccatcatactttggtaatatgatatattttaaatatttgtgaatttgttaatgaaaagagtggtaatggattgaactaaatagtgtccattgaatagttaactagtgagtagtgaccagtgaaacggggataaaaagaagtaccaacaatctggtacagtgtagaaaaagcgtgtgatgggtgaaatactggcaatcaaattcagtggctctaaggtgattttcctctccttttttttaaaaaaaatattgtaacgtggcaagaggcagagtttattacgagtagtaatcaaaatgattgggccatgctacacaagaaagagatgtcagtgatggatttagtagtacatcttcaagattaacatatgtaacagccttgtgccatcttgttacagaaagcgattatggatgtgcttccaactatgatctagccttctcatcttccctccaaaattgtacttacacgatagaaattagaacctagtgttggatggcaatcatcacctttacacaatatcagatatcaccaccttcgcaccagtgatgtgagcaactgtcaaaacaatagaagcagttagcgcttcttgcaagcagtttcttgagtaaacaattatcagtaagaatgcaaggaaaaaatggctttcgacagaaaccaagaaaccttatcacatgatcactttcagatttttttttaaaaaaaatgcaacagttcagctctcaccattttattaacttacgaattctggctacctcaatgagctcctccagtcatgcatgatgagtttggagccatgatgttacaacttacaaattgattacagtgagatatattcagaaagcaaactcccaagatatattcaggcaagtagccaacttatgaccaaagcaaactcccaatatatataaagaaacataagatccatgctcattgaaaaatttcaaataattgtttgatttcatcatttttgcagttatactgatgtgtgaggattgatagtattgttcggtggctgttagatgacactctatagggttagtcaataaaatgtagagtttctaatcatcgtgagtagcatggtatcatcaggtaataaggcgcaaaagtttaaatggttagatgtggttgtatgcattctttactagttgctccaaatggaaccatttacgtgacaacaaaagtataggcctagaacatcactcttcagcaaactagttgcaggtgtaaaaaaatatgccaataatttgaagaactttcttaacctcaaaaagctcaaaaggacttccccgcctgtagacatcatcttgctggctctgtccagtggaaaatagtagagaaaccagggcacgccatccagtcaacaaaacccaagtacttcccatggctaccaggataaaaggagttggtggaatatgaccagatgacagtgctcgaatggcgaggcccaactaaagaggagagagagaaaacagaataaacataagctatgaaacaccagaaaaaacattaacattaacattaactacatactcatagtcaataaactttagcaaacaatcacacgataaggcagatggacagctgttgtagagttcagaatagaaatagatccagatgctgaaaatactgtccaagatataatagaggaatatatcatcatttatgaagatataatagaggaatatatcatcatttatgaagatattatatactacgttacattcaagagagtatatcttggtagaacaccccaccctcgcacaagcacacatgtacacacagaagacattgtctgtattagtgtacgtaaaagtaggtgtcatgtagtttgcacgacaatctacgagcctatgatgtagcacatggaggatagaacggaaatggtttgggtactggtacaaggtggcatcagtcaattgtcaagcaaacagcatacagcttcattgtaacaaaagaatgggttccattagtccaagttataagtgaagacactcaaagataaaagttcgcaattcccacattatacagtttacttatgtgttgacccatgatagcaaaataacatcacaaattatatgtagatacaaacacattccaattagcagtcacatttgaatttcgaaacagaactgataattaccggtatcccaacagcccaggatttggccgcaacaactacagcgttccccacgccattgcgacctttcgcatcatccccgaatccgccaaggagataggcactgagcaaccatcctgcacaacaccccattctgtaagcaatccttcctccaaaaaatgataagcagggggagaaggctgtcacattttcctgaccagcaatgaagggatcggccgtcttgaacgtctccgcgtcaagaacaggcagcccatggctgaaccttcctatcgcggagaagacgaggaggcagagcacatcgccgctggccagaagccccagcttcctgcggaacgcaagtgcaccgctcagcgaaaccgaatcaaatcagcgagcacgaggaatggatcgaggtgcatcgggggagttattacgtacgcgtaggagacgagcttggactcggcggcggcgtcgccgggcttatcgaactggatgacgccctcgagggggacgccctcgtccgtaacgccgacgaggacggggtcctcggtggcggtggtggtggcgggggatccggaggggccctcccccgcggcggcgagggccccccgccgcgcgtcggcgccggagagcgcgaggcggcggcggcggcggtgcggaagaaggcgcgtggtggcgaagagcgggtacgggttggggacgctgctgctgccgctaccgccgtggcggccgggctgcttggagggcagccgccgcgcggagacggaaccattggcggcctggctcaccagcaacatctctccggtgggcggtggcggtgtcgccggaggcggcggcgggtggagatttttttgggggtggtggaatggaatggaattgggatggcggaggaggaaaggatttgggtgggtggtctaaaaatttgcatttcgcggtggtggtctaaaatggaaggaaacgaaagcgtggatggcgtcagcggtgtggacgagaagcggggggccccgatcgttggatgcggacttgccggtaacaactcacacaagtcacaacacaacacaactcacgagaccgtctacgtcggctcagctcctggcgtgggatgagctccgtccatttgtaagccgtgcgtccgttcattcgtgtccttgatatttaattaactagatgatgagaccccgcacattgctacagaaatttagtatgataacaataaaaaaataacgtataagatagctagataacatcagattaagtaaattaatatggtttatgataatttaaatttaaatagtatgtagaatggtgattcaaacgtaaaaagtaaggtggtatgactttatgaaagaagagaagtagggagatagtttggaccgtggattaatcatctaaagactaaaagcaattgatgtgatatgacttaattagaggaaaaaaggagaaagataatttagaccatagattaatcatttaagcactaactaagtgaggatgaactatataagtatatatgatatcataaaacataataaagatatacattgaaacattatgtgaattatgttggatgataatttaacaagtttgtatttgaaaagctcttaaattataaaaactctaaagatatagcatgtttgcatgatatttaaatgtgatgattgttagtggatgatgatgtggcatcttgttaattagtggatgatgatgtgatatcttcttagtggacgatgatgtggcatctttacatgttaagcttaaggagttagtaggggataactttatagtaagataggattcttgaaaaatgttagccttagagtgctctttggccgttggatcaggggtgtcttcaagctcaagacgaggagagcgttggattaggggtgtcttcaagctcaagacgaggagagtgaggaagcggggtacttaactacgatggcgactttccaataatggcggtaacaacggtgaactactcttcacaacggtgatggttggttgtgatggtaagttatagattagattttaggatgggaagggaagttaggaagagggggggagcttttccgggtttagagagatggtcatgtgagtggttggatcgacagtgagctatagcaacgggtgggtagtgaggcggcggggtggtgttggagttgtggtgatggaggataacaatgagggggctgtcagcggggcagagtggggtggcacaaaaggtcttgctttggaaaggtgagagtggggaggcagggaggagcccaatctaataggcttcgtcggcgccgtttatgccttccatccaacaaatgaggtcagaagtggagtggttgggtgagggaggtggcgtcgaacactcgaacgagtggacacagcacacggaagaaggtgagggaagaggttactcaacactatcttagctataaaaacaattgactgaatttttttatatatttttaggtgactgaactagacaattccttatttcttgttggacttcagaatcaattgtgaaggattagatattgtacaaatcgagaagaagaaatttaaccattcaaatttagaaaggagtcgtgcaagtgcacgacataattttaagatgcggtatagtttgtgtgctaattgacatcaacatgaaacctaggtatcaaaacctatatgtactagaccaaatcctgtattgtagcgatatcacacttagtacgtatcctttgtgtcaacatcagcatataaaagtatactacatattcaatgtatcacgtttcataggttttttttcccattttgaaagcatatcactaactaagcaccattgtcgaatcgtactcggcaattgaaagcaacatagtagatgttacagttgtaggtaactttgaatttatccggctagcagtgggtctgttcggaagaactggctgcagtagcagcagctacagtgccaatagtagccagccagcccgaatgtctacagaacaatgcaaactgctgcagccgaacggctaagctacgcagcgcagcatagacagctgcgaaaacgggctaccaaacaggcccagtaaatactagtccctctgtcccaaaatataagtatttttaatgtagtgacaagttaaatattttaaactttgactattaatagcaaaaaaagaaaaagattaatcatgtaaaattgatgttactatatttactattaaaccaactatcatgctccctccgtttctaaatatttgacgccgttgactttttaaaatatgtttgaccgtttatcttattcaaaaaatttaaataattattaattcttttcctattatttgattcattgttaaatatacttatatgtatgcatatagttttacatatttcacaaaagtttttgaataagacgaacggtcaaatatatgctaaaaatcaacagtgtcaaatatctagaaacggatgaagtaatatgcaacactttttatttaaaatatcttatttttataaatattatttgtccaaatagcatctcggagaacgtgtgagagtctaaaaatgcttatattttgagccggatggagtattagtaaatgcacatagagtggattggtttctgaggccaacaagagtttgtttcggtgaactgttttactggttaaaatatcccaatgttattcacatgggctgcatgttcatggcagtttcttattctcctggaagcaccaaacttgcatttggatgggtgggtggtagcctaaggatttgaccatctgagctccaatgcagttgttgcatcaaaccacccctattagtttttccccttgcgttcaaacatgacgtataccagatgtcatactttggaatttggatatctgaagcactcctcaagaaatataatttaccagctcgtaatctgcgcgttatcgcgggaaaaaaataattcaaataatatagtactacacaaacttaaaggttttgtatcatattgttcaacttataattttgtagaacaaattagaagttaggggcaagaaacataaacatgataccaacccactctaagtcgtactccgtataggcctagcattgcataaaagaatactccactaggctgaaacatagtcaatattgatacttgatagtaatagaaaatcgtaaggatgaataaaatattaatagaaacggatgtttggtttgcaattaaaataatttatgggacacacgtgaatcatacttgatatggatcgtgatttgatgatttaattgtaacaagcccgatacattaaacggatttcagaacagaattactaattagaaaatatggtcattttaaaacatgcaaatcaaaactaaagagtcaaagaccacacgagcccagcgcgggtaaagttcaggtatgctgtgaaggagccgtacttcaccagctttaatactacttannnnnnnnnnnnnnnnnnnnnnnnnnnnacacaaacttattgtacagtgtaagattctcttctataattagtacatttctatgaggaaaaggaaaagaactgctgagcttatggcatgagaaagtcctttggtctgcctacatccctcaagttttcaactgatatattacatatcaacagcatggtagatcagacgtacagacaaagagatactatccttgcagaagccagccttccaaaatcaagagatgcttttctgcatacaactttgggacacgaacagaacctgcacaaaggaaagcatagaacaccacgtgcagcttgttaacagagaaaagagcatgctgatggtaaatgagaattgacgatgaaagtactaagcatggcataacaacggaagtatattctaactttcttttatcgtccttttttgtgaacaggccaccaagttaacacgaagatgaaatttctattttgcaaaagaaaactcaagctactttatatactaagatgcaaaagaaaatgttcgggagaaaaaaaagatgcaaaaggaaagtctgtcctaccaggctatgaaaattctcatgggacattgattacacaatatcatgccgcaggggctttacaacagatgttgaggacatcatccagaggtgcatgatcaccagtgccctcatctttccttgcatatattaattctttccctctgaacacaaacattccaccctagcacacacaagtaatgtaagcatcaaagattcttcctaaaatcctaaagataagttcagatgatggtgaagaagcacagatgtgtgggcatatgatccaacctgttgtagaacactagccctatcatctggggtggcttcaattgtatagttcttcactgcctccttgagggagtcaaatcgtgaaaacacacttgccttcaaggaaatatgtaacatttttcatgacaagacagctatgcaagtgaaatcacaaaatttaatgatgcttacactggctggattgaagaatgtgcgaccaataccaaaatacaaacccaagagatcataggcctgaaggtgaaaaggctcaatgtaagttgtgcaatcagtaacagaagaattaaaatgttttttttatcaacaacaaaatgtccaatgcaaagataattgaacttcatgtgtattatgtccaaactgatgatgcttctgtctaattcagatatcaacatctatgtctggacagggaagaacaataaatacatcatatactgttcaggagaatttcagtatctgaagaccccaattgtaattgaatgcttacttatggaacaaatttgcatactattagtgcacttattatagttgaaaaaatattttaaaaaattaagagaaaaaaagagaggtttagaagatagaaaccactttctacagctgtagaaaccttccatttgtgaatgcaatctaacaccaaaagttttcctgctgtcagttgacatgaatactgcatctatgtgttctgatttcatccaatcaggcgcaacagagacaaaaatttaaaatattttctccaaagtagtaactacacattttatgggacaggtcctgttagtgcagttcaaacaatagaaaggcaaggacactttgcacatggggtactcttaagtaagaaagtgtgacctgtgaagatataaaacagattcataaataggtgggcacaagaatatgcaccttgcgctcaggatctgcgtagaggtagtccaatggaaatggtaactgcaatcagcattttttttggaaaaatgtcatttgggatggaaaaattttacgggcacaataaacaatgtcaaaaattgctttgctctgcaaatccattgtccagcaagttgtgagattagaggggcaaactagacaatcgacatgattgaccagcagctgtaatgatctattgcaataattcatagccaatttttttttcatattataacagataggaggttcaaaaggtcaaattccatagtttgaactagtaaatcaaggtttttcattatgaaagaactgttcatgatgtgtgtgttaaaagctgaagtataaattgaagaacactgcgtacacgctcagcaagaatacgggctttatctggagtgccaacaccaacggctattagcttgacaccagctgaatcaaatctctcttttgtatccctcaacacagaggccaactcccaactacaggaagcacaaataatgtccatgattagcacagaaaagaaattaaacaagtcagcaacaaattcttatgaatgaggtcataaatccgggaaacagatatccacgagaggagcaaatctttctcaccagcaagggcacccaaaatgccttagcagggcaacaacagccattccctgcacaacagagaagttctccagtttatttatgtactacatcgtgttcatacaaaactcctcatagtgaaataacaatgctccaatgttcagatagttttccagtcttcaaaaggactctaaatttgctcaagcagcaacccatcacatcttatattgtcaaaaatcatgtgtgcaaaattttgatcattcatgaaggaaaaatttcctagctcagatctccttgcagtttactagaaagtagatcgagctaattagggggagaccgacgagcatctctacctcgttctggtcccacaggtccctgaacagcacgggctcgccggtggccgcggagtagatggcgacgccaccgagggcatccccgatgcccgacccagcctccggggaagaggaaggcacggaaggggagcccgaggcggcggcggccggtgccgctggtgagccgcggagacggaagcacccacggcgaccggggatgaggagaccgtgccggggagcggcggctgggcgagcggacggcgggagggagacgcgcgggacggggagcgaggtggacgcggccgccgcggccatggctgcgtgagacgtggcgaaaccctagacgcgggagggagacggaggcgagcgagtggaccgttgcggtgtggaggtcgttgcggatggcggggggtgtaaccacgagtttccaggcgtatttctaaaatgggatatgagagatgagactgggatatggaaatggatgaatgactaggattaaatcagttatgaagaatagatgtgtatgatacaatattgtcttttgaagggtgggatattattttccaatcccatttgccaaacaaagatttagagaacacgcaatcagaacacaacaatttgcctttccttcctatagttcgggataacgtatcattaaatattagttaaaaattaaaaataaattaatatatattagtttttaaaacaaattttctgttgaacttaaaataaaaacgtacttgtgaaaagtagagaagtagaagttaagaacatgtagagcataccagttcttcgttaaattgtaagatagatacgtgcgatttttttcttcaagttcttttaacatgtactagtaacaagtacatgctctatgacccatattaaaagggattagttaaagatactccctccgtcccataatataaaggattttgagtttttatttgtactgtttgaccattcgtcttatttaaagaattttagaattattatttattttctttgtgacttactttattatccaaagtattttaagcacaactttttattttttatatttacacaaattttctgaataagacgagtggtcaaacattgcaatcaaaaactcaaaatcccttatattataggacggagggagtattagggataaaacattggatctcgtctttatctacgtattttacacgtgcgagcctgatacgtgtggtagaaggaggggatggaaggaacgcgactctgtttttaattgagtagagatatctaattgattaggtgtaactgtaccttatacatcagaagttcagagttcagactgtagtgtcatgtccattgggtagctaatccaatatcatgctaagtacataagcaaaccaacaatgcataattaatcgaacatctagtactgttgagtctaattgctctctgtttggcatgctgagcatttcatatatttacatacacatcttccgactgctagagacctcaagaagttcgattgcagcaagcgttgaggacatcatccagaggagcatgatcacccgtgcctttgtctttccatgagtacagcaactctttccctctgaacacaagcataccaccctgaacagaaaccagagtacgatgagcagcgaacgacagatcagaaccaagatgcaagagaaactctgaacttcaatacagagccacaaaggatttgtacatgcaaagcacagagttcaacaacctgctgcaagatacccgtcaggtctgctggtgtgcccttgagcgtgtagttcttggttaccttcttgatggaattaagccccgagtacatcttcgccttcatggacgtacatcacatgtttaatacttcaatgccactcgtgcaaatgttcagaattgcattgccacaagcttacagaattacactactagtactgaattttgatgcttacaggactgattaatgtccgacccagaccatggtaaagccccaatacgtcgtaagcctgaaaagatgagtatccatagtaaatacgtgcataagcataatacatcgtcaaaatccaatgcccgttagatttctcttcacgtaccttgcgctcggggtcagcgtacaagctatcaacagggaacggcagctgcagtgcgcaaaatctcagagaaagtcagtgaacagagtgaattgatcatgctaaatgccgtaataacagtaacaatgagcacgctggtacgctctctaaatctcaatttgatgttagagtcatatttgtattgtgttcggtttccctaattctcccccgattttatttctataagtcggttatagaaataaggatgtatcgtccctgtgtgtactcttgcttgggatcaatctattaccgcgttgactccaatacgctttcatttcaaagcaagcgtaaacgcttaccccatcggcgagaatgcgagctttgtcaggagtcccgacgccgatggcgatcagcttggccccggcagcgtcgaatttcgccatggattccttcagaacagaggccagctcccagcttcataaatcataatccatttgattgaccatggacaaaaatgttagtaattaacagccgagaaacacaagaaacggagcgaacatggaagcgtcggctccatctcctcaccagcagaagcacccgaagtgccggagcagcgccaccacggccaccccctacgcgcaacaacgacacaggactccgaaaactatcaccgattcttcgtgtttgagtgcgtgattccgagaaaaacagagatgaagatgacaactacctcggtggggtcccacaggtccctgagctgaacggcttcgccggtgccggcggcgagcacggacacgccgccgagagcgtcccacacgccgggggagccgccatcggggctaggcgacggggagacgggaggggaagcccctgccgccgcggagacggccgtcagcgagcgtcggcagcaaaggcgtcccccgcgcggccgggacgccgcagggaccacggccctgttcacgggcgacgctgtcgcgcgtgtagcggcgggcgcgccggcgagcgcggcgcgcgagagcgaggcgaccgtctccataggtacgacgaggccaaactctgagacgcgtactgatcgagggcgaggtgcagccgccggtgccaacgtgtggccttgagcgcgtggcgcggcgtcaagtggcagcggacgcgtgggttttcgtctaactgagtaactgggccgttcgttgggctggcggtgagttttcagtcgatttctccgtgaaaaggaataagttcactttaggtccctgcaccgcaacaccggatacaacgcacccccaatttacaaaaccgtgcaaaagagatcccttggcagttttagctaatgtgacatctacgtggctcctttgactaggtatttttttctacgaggcattaacgtggcgcttatgtggtagttcgatccaaaaaaaataacaaacactatgagacccacatgtcagttacacacacgaaataataaaaaatggtaggcctatgtggcccaatatgtcatcgtcactcatcacatcttctctctcctttctctctctccttcctcgcccggggataacaagggagacgagggtgtcgcagcctcctaaagagaggagaggggagagagatgaagaggggagatggggaaagagaaggaagaagatgggggtgagagttacattttttaatttagggcatgttcagattatatctaaaataaaccttaacaagttttggcaagatggcaatattgctaaaattttggtagaattttttttgtatttaccaattttggcaacaaactaaacgtagacattttttgacaacttcacaaaaagaatggaatggttgaaaatagcagtaatctgaacagctccttaattattcgatgaagttgatatgtggacccacaatttttatttttttccaaatcaaatttcacataagcgccacgttatatgaagacatagtcaaattagatatgtaggcgtcacgtcagctgaaaccgtcgtccaaatcatcttgggacttattttttaatggttttgactgttgagggacccgctgtatatggtttttcggttgaagaaagaaaatcgaattcgtagacaagttcagggacatcagatgaacttattccccatgaaaaccgcacgtaatcggcctttttttttctcacgtgaaaccgggccaatagcccacgtccacgctaacgccgaaacggccggattcgttgacgcgatagcacgttgcttcaaaaaaaaaaaaaaaaacactggaacttgcgagttgcgagtgctggaagcttgtcggttaatgcccttttgcccaccacattgttattaggggctactctctccgtttcaaaatgtttgacaccgttgactttttagcacatgtttgaccgttcgacttattaaaaaaatttataaaatatgtaaaactatatatgtacatgaaagtatatttaacaatgaatcaaatgatatgaaaagaataaataattacttaaattttttgaataagacgaatgatcatacacgtacttaaaaagtcaacggtgtcaaatattttaaaacggagggagtactaattagttagggttaatttagtattgcgttctcaaggtaggcgatggcgtaaactagtccatattgcgtgcgtggagaggctcgaaggtacattgagagatgttttgcgtgatggtgttacctaggaagatgtctccctaccccatcggtctatggctaattttgcttagccacggtaaccgtgctacactaccactaacacaaaatatttttataaatctgcctttgaggatcctagggctccctccaggttatatatgtgaaagggaaaggcaagttccaaacctgcacaatatactcctactccattcgtctctctcatcatctcatgcgttgcgtacgtgcatggccgtcagattggaagccaacggcagagatctccctagcaccgaccattccccttttgtacaagctgtaataagctgaccatcaaatcgctcttataactggcaatgctacggcatcagtaactccgtagtactaataatcacccaaggaatgtgaattgaattgccatcagctggcctggatggatgattaaccggagtagtacaggcaaagttttctccatcaacagtaggagcagtgcagtacacggtggggtcaattttataattggccacgcactcatggaagggtgtagtcaatttcactttggcacggtcacacaaatcccaaccaccgtggggaccatgcagcaggggaaggaggaagagaagaggaggaggaggagggtgtgtgtttgcacgcggccccatgtaaaaacaaaccaagattcccatcccctccctctcccatgtgagccaagccaaggcatgcatcatccctcggttaacgagaaaacggcctcccaaagtagggttagaaaggggttagttggagtaccacacggaggcacagatgagtataatcatctcctaattctagggtttgcgtggagctagctgatccaaaaggctggccaactgttgtgctgtgttttggtggagccgtttaatttgtgttgtggcactctggtttctgactcgcaatatttgttcacaaaggcaaatgtacaatgagcgaggagagaggtactgtgtaattctgtgaaacgtatagattagattcgagtcgaattttgcattgatccatacaggaaatatgaatggagaaaaagaaacatgtcataaatgtggcttgaatgaaattaagaaagttgatgcaaaaattagttcacacactataaatgcatattaaagaaactcaaacctttttttttactagagtgagccaagatcacatttggttactttgaaggacaaattagtactcctacatcataataaatcaaaaaattactccctccattccaaattgacctacatatttcataggtacaccaagaccaagaaaaactaatactatatttcctagaaaaaactcaatgcatgcaccatccccactatttcctagccaatagcaaataaagatattgcatgtgggttataagagtaagtttaatagtatagccaaccgccggctccaaattatctatagtcaacttaagagccaattcatacaatagttacctataaacatatactacataattaatagccggtcccacctaccatacacatgtaccttggagtctgtgctacagttagctacaaatctgtagcccgctgcccttctctctcatcttttatctcctcgaaatgtgtttatagctggcttatagcctgctattgtacctgctctaaatacatgtgtgcatggatgcatgcatcaatgttcatttactccaatgcacaaataacgaatagacctaataaatgagcacaaatatgtagatcatttaggaataaccttaaaaaaactatatgtagatcaatttggaatggaggaagtatctactagtagcatacaggagtacatagaattaagactgcatataatgaatgtactgctgatattaattttctgttttttaattacattgtatttgcagttctactgcgtcctggcagtttcactgtccaccataatgttgtgcatacagtactgtacaccacattttgagcatcctgggtttcctcagtatctatccccggtgggaaaaaaaattgattctggtcgtcctgtaagaaattctttacactgctgcttcatgcaaagatagctcaaagctagtagatatcttggaattcttccctcgcctagagtaaattaaggccgatatatcatgtactctgatgttattatccctgtagattaagatcggattagttgtggttggcatcttgatgtcttcctcggatggagtaaacaataagcccggcagcatccgttgggttccacccaatctcgctcgcaggacttctcttttgttatcttcttctcaagtcttgtcatatgcatcctagctcatttgtcattcctgtaaatatattctagtactattcgtgttaagatgatcggtggtattaatttggtgtaaagtatgtttcgcgtgaaacctctcaaaaactaaactaaccctaaagtatcaaaagaatcaacctgctggtaaattaaccgtctacacttactcgagatctgcagaattgtactatatggagatgtcctgtgcccaatagaggccaaggtggcccttcatgatagtgtataatttgtaaggttggtgcttgatcacgattggagagctgtaaaatgtttgagtgtaatgtcattttgtgttgatttagtcaaaccatactgtgactaaagcatgtcaagctagctgcgatgcacgtacttaagttgagccttggcacacaacacaaacttgggatttctcttcggatgcaattagtcgtcggatgtttagttttgtacagaaaacgctcccgttttaattaaaaatatacagttaactagtcgccaacctgtgtatttgcacgagctatatattgctgttgatattaattttaagtataaataaaaattaatcacgtgctaaaattgatcattgttttaaaattgtagtgccttaaattaaaagagagtccactacaattacaattcacaaattattatttttaatttaaatttgagttaaattaatacttcttcagtcccatataaatgcaacctaatacatatatgatatatcataggactataaatctgagtagtcagctatccaaatttatagtattataatatgttatatatgtactacgttacacttatattgagacatactagagtatttatgatgccacatctaatctttaccttaccacaaaatgtacagtgtattatgctatttctagcactaccattcgaattcgttgattaccaatagggttgcagtagtactagaatgttttgcttaaggctgagttcttttgttaaagtttctaactcaactcccttattttttacgagaatatttttcaaactaataaatggtgtgtgtttttttttcaaaaaaattctatacgatagttgctttaaaaaattatattaatctatttaaaaaactaatattaatcatgcgctaatgaatcacttcattctatgtataaaggacgagttcctaaccgcaaacaaagaactcagggtgtgtttagttttgggtacagtgtaaagtttttgaagtatacaaatacacatttgaagtattaaaagtagactaataacaaaataaattacagattctgcctgtaaactgcaagacgaatttattaagcctaaataatccatcattagcaaatatttactgtagcatcacattgtcaaatcatggtgtaattaggtttaaaagattcggctcgcaatttacgtgcaaactgtgtaattggtttttttccccatatttaatgcttttatgcatgtgttaaatatttgatgcgatgtttttgctaaaattttttggtatctaaaccatgcctcaatatgaaagacctgggagacacatcggtttaacagcacagaaaacaccaagctgccatttaattaagcctgatgctgctactcccaagctccaacagatgccagagcctgcccgctgcagctgccgctagcttctcttggaaatcttccctggcgtttctcgccgggcagctagctgctccatatagctcctgcatgcccagagctaagctgatcagtctttcgtcacgactgaaagcgtcgccagtcgttgtccgcgccttcgtagtactgcgtacgcacacatcaggttcaggggttcaggagcatgcatcgatagcatgcatgcacgatgcatccaattccatggctgccatggctggccatatcatctgccgctttgggtcttaattgcagccgcgcgcgcgttggcctctgtctcgccgactagcgtacgtaaccgtgcgtgcaaacaaacacaagaaaccaacgacatactagcagtacgtacgagtaccagttttcgccgtgcgtaacgtgcgatcgagacgacgacgcgatatcggcgtacgtcctcacaccggctatcgcgcgtataccgctactagtgctacggcggctggggccatcgtcgtgccagggtcgcagctggggagagcacggggcggacaaaaggcacgaacatgtgcatggggccgcgcgtgtgcgtcggaatgatggaaggcgagcggatcggggggattttttggcgcgggtaggcgtaagcctggccggccaggggggtcgcgggtgcgtccaaaccacacgcccagcccccaaggcgtaacgtacgtacgtccgcgacggtggcgccggccggccggcgcggtgcatggggagtggtctcgtcaccggatcagggtggattgcgtctaagccacgacggcgccgcggaaacccaggtaggagtaggtggctacgagtagcctcctggtacaaggctcgacatcgcacggtctttcacaaggctagctcatcccgtgtcctcttgcacgtatgcagcgcagggttaagttcaccttatcaattgagcgtcagatcctgatcctcggtggtacgatggttttcttcaaatttcaatagattttggtcaaaattattactccctccgtactttaatgtataatattgttgactttttaataaacgtttgaccttttgtcttattcaataaaattatgtaattatcatttattttattgtgacttaatttataatcaaatgttctttaagcatgacataagtatttttgtatttacataaaaaatttgaataagacgaatggttaaacgttggttaaaaagtcaacggtgtcatacattaaaatacggagggagtacttcctaatatgagttctcgaagaccttcaaaaacttcgtcaccggcatatgtactttcgtcgaactaaaattgacatttttcgctggctaagttctttagttgaggtttctcaattcacatctttcgttttcttcacacaagtttccaaaatgctaaacaatactttttttaaaagttataccctaaagttactttcaacagtcatattaatctatttctgatagaaaaagatagtacttaattaattacgctaataaattatttcgttttacgtgtgcgagggataaaaaaggcaatcacagccaaaaatgggaaactaggcactttggcggcgtgtaaaattgtcgcctattactacgtgtgtgaaactgtgaaatggaggaggagatgcaaagaggacccatgttgttgtaggggtactactaattaattttctgaaaacgactggagtcgctggtccgggttggcgagagcatggggacatccatcggccttacgccaagcatattttattccagtcgtaagcgcagatttgaccacgtcccagatcgatgtgaggtgaaggtatggtggtcgcttcaacaccacgctgctggcggatgcgtttgaataggaaacatccactccgtctgtacgtactactgtactccatctacttcggcatctgggaattctcctgttggaacgaaccgatcgaccgccacggagagagagttgaatcatcacgtggtgatcagtactccccgttcataaaaaatcaatatagaattaaagaggttatatcatttttaattctaagttaatttttatggaaccagaagagtagtggtataccttatcaaatccatctcacaattaaaagtcagtggtagaagtagcagcaagctagcaactgtgtacctactggatcgactgaccgagtatgcatatatacattatcaaaaagatgaattaaatttgaaatatattgttttattttcttagaaatatttgggattcaatttttttagcacagatatagatatcgcataatagatgcacgaaaataacgtgggctgacgacgacaacagtatcacatggtaacgatgcgtctcgcataaccaaactacgagaccgcgcggtcttgcatggccaaacatcaacaccgttttgaaaaatgattaattatcatgattaacgagaccgcttgtgacgtcacatccacatcattctcgcgtaatgtttgagcgaaattatattcgtgccaaataatttgaatctcaaatatgtttgagaaaaaaataaactaacattatattttcaaatttaattcgagcgtgccgggccggaaggagttgacaacttgacctcgctttcatacacgcgacagtcgcatactcctactcgcatacatacaaaatcaaaggtttttcaagggtacgcatgtagtcgtctcttgctcctagtattgaccttttctacgacaatgttctgttgagggagagggagaggtcgagatatatagggtcccgtacgtaacgtaacgcaaaggggtcagaagttggcaacccaagcagccgtaccataatgcgcaccgcccacattgatatgatgaccgagaagtggacaagtgaaggagggccgggtgacacgtacatcaccggtttcctacccacgcccatcgcattggaactcgcccgtctttataacacccatgcatcctactatgcatacggcaagggcaacgcaaggctaccgattcatcatgcccaaatcaagcttttacgaacgcaaaaaaaaaaaatcaatacacgggaaattcaatacagtagtactccactacacactactagtgctagtgtgctactactactattttccgtgtattgatattcaccggtaaagtcgcaagggaagagagaggcaagaggggcccggagtgccggacccggagaaagcatgaccagaaagcgacggagggggcaaaactgccatcctgtgctactgtaaaaatactcgtagtactcctcctacttctactagtcagatactaccttttgagtttttcttatattgtttgaccactcgtcttatttaaaaaatttgtgcaaatataaaaaagaaaaattatgcttaaaatactttaaataataaagcaagtcaaaaaaataaataataattctaaatttttttaaataaaacgagtgatcaaatagtacaaacaaaaaatcaaaattccttatattatgtggggagggagtactactactggagaagtagatcgctgatgccaatccagtactagtaactggtccatcacactccatccaactcgcggctggttgcgacgatgcggcggctggttgtgacgatgcggtggagtgtgcgggcagtagtagagatggggtgtccgcggatgggacgggacgccgcgcggcagcggcgagaggcgacgcgatggcgggcaggtgggcgcgctttatccatgtcggccacgaggaagccgaccccgtctccgtcacatctcatatctcttgtcaatgcatatgtaatccatcctttcataatgttttctggagtggggaaatttcattaatgttttctgggacggggaaaattcgccatgcttggaccgtactagctatacatgcagcctaaaatcattagactatgctagcgctatagtagtgcgtgttatccggcgtagataaaacaaactgcgtccgctctttacagcagtagtatgaatcgtgaatttgtgattaggcgtaaaaattttaaagtatacatacgtatatttaacgtattaaacataaactaataataaaacaaattacatatttagcctgtaaactgcgagacgaatctattaagcctaattaatttgtcattagtaaatatttactgtaacaccacattgttaaatcatggcgtaattaggcttaaaagattcatctcgcaatttagatgcaaactgtacaattggtattttttcacatttaatgattcatgtatgtgtccaagcatttgatatgatggaatttttggaagtttgaaggaaactaaacatagccttagagtcgtcttttaggtgcaactcatactttgacttgtgatcagatcgactggttccattaatggaatattgttcatattcctgctagtttgatgggaggagttgttacttcaagaagaaaaaagaagatagtagtagttagttttcgtgtttgatgggagcttacaattggatttcataaagaaaacagtgcattgtgataatctattttgctttcctactttcttagactactacagtataatactccgcactacttttgtgatttaaatcacacccataaatgttaatggacaataaaactagacgtatggtactcgatacgagagaaataaatgaaagctcgtaatgtttaagttgatcaaagatgtaacacattaccaacgccctaaaacattttttttaaaaaaataaacaaacaaaccaataaccgacaacaccaaaaaaaaccttaatcagacaacactacattcaacattcgcacatgaaccaatggaacacctaaagataaacattcaaacaacatcgtgtatgacattgtaaaagatctattacaacacaaaaacacatgcattataacatctagcgataggaggcccccgcctntttgcctccccccccccccccgcccccgcccaacaggtcctcctcgctccttcctcatcaccgttgcatgcacgattctcgcccgacgcgcacatcatcatacgcattactgcactgcagctcatcacatttttaacagttgacctgatccatagcttcactataatagaccaaaaaggatgagggggagggaagatgtggaggagagagaacaaacaaaagggatggaatggaagggttcgtgtgtgcgtaaatgaacatgttgctcgtgagttcatgtgagggaattataacatctgattatttatcgtatgttggacatccaattataagtgttatcaatttatcattaataaatactaccttcgttatagaataattacatttctaggagattagaaacacgttagcagcaatacaaataacgacaataaccatgtttaatgaccacactgcatacacattctatatgtaaacttgattaaaaaggaaggttaggagatgaggatggaaagatggggagctaggaaacaatatatctttatctaataatctgttggatttcatacccttttagaaatgtaggggttgctcagattgatgccatttttaaccatattatttttcagtaaagttgttaaaaagtgtttatgtttagtttgttaccaaatttgataaatacataagaaatcctgccaaaatttggtaagttttattttggctactccctttgtcccataatataagggattttgagtttttgcttgcattgtttgatcgtccgtcttattaaaaaaattgtgcaaatataaaaaacaactttaagttgtgcttaaagtactttggataataaaataagtcacaaaaaataaataataattctaaatttttttgaataagacgagtggccaaacagtaaaaaaaactcaaaatcccttatattatgggacggagggagtacaatctgaacaggcccataatcgttttggataaaatttaaattatagagatacaattaatctagaagatgtatatcagttcatgcatgagtactgtacaacaaatagcgtgtactacttcgtatttgtaactgtcataaataacatagccgtctcaaaataagttttttacccatccaatacatactaataataaaaaatctagaacctctactttatcaaatctaaatgtaattgtttttaaaattattttatagtttcacaaactccaatacaattattactttaaaagtaaatttattttcagaaatgaaagaagcaaaaatgaattaattaccccacagaggaagtaatagaaagttagagtaggagttcctacgaaagtttgagaaaaataaatgttgaaaatcagcccccgaagggattgacgtggtatgttctgccgcatccatgtctcgtacagtatactctcgttgtagcggacatcaaatcaaggatacaaagatttgccctcgtgttcgtcctacgcttttttttttctttccaagaatctcccgatccatttaaattttcgcgtcacgtccatgcactgatgcgttggcggtggaagggagtttaaaatagggaagcatgcatccttatccggccgagaagaaaaggttttgatgatcgatcgatgatggatcgatgccacctgtacgactgtacgtgctcacgttcgtgttccctatcttttctacgcctggaagccggaatggccccgattccgcgatgctacgccgacacgacgccaatcatcgctgcgtgcgtccgtgacccttcccggcggcattgtagtccggatagcacgatatgtgcccgcgccgctctcacttttcgatcggcgtcggtaaaatatactaccccctcgtaccacagtataatagattttaaatttttatttaaactgtttgaccactcgtcttattaaaaaaatttttagaattattatttattttttaacttactttattatctagagtactttaagcacaactttttgttttaaatatttgcataaattttttgaataagacgagtggtcaaacaattcaaccaataacttaaaattctttatattatgagacggagggagtataaaacaagtctcgatcctcggtagacggttagatgtgttacgtgaggtactacctccgtccaaaaaaattacatttctagctccaaggctttgtcccataaaaattgtatttctagccatgtggggcctagcaaaattgattcatctagataaatttccttaagttctcttagccttccatcccacgatatatggttgtaatttaagtatgctaattatatgggttaattctctcaaacttccttttaatcatttgtatatatggaatatgtgcatgcagtggttcattaaataaggtcattgtggtcatttttcaatactactgttttgtcctaaattagctagaaatataatttttatgggaggagggagtatacatcaacgtacggtgagccagattgatcccgcacaccacacaatcttttggtcaagttaaaagaaattacaaagtaaatttaaattttcaacaaaatttgaataattttggtggagagtcaacgggttttaaatatttttttctcaaaaaccacatacctcggtttttagctccgaaatagtttaggtgtatttggttggtgggatataccggataagactaatcagtcattttgttgtagggatgtctggttgatgagcaaaaataggatatggctaccagatagagaatattctatgtagatgctggatatctagctctgggcaaattggcgggatcacgcggtctagaagtgggacgagtcgcgcgactgggtatgagtgcattttccctgccatctgttttatcacggcattttggccaccatctctttcttccattcttgcggcagcacaaggagcaactctcgagggcgccccgcggcacggggcgacacttgataacgctcagtggagcgctgcggtgtaaggggatatgttactatttatggtgagtgacatgtaaaccccaccactctcgagcccatatgttagccaccaagtcagtggaaagttatatcagataatctcgctctgggcatagcacagatagtgtaaagggtgtcgcaggggcggcgtccgagtgtccaacagtttggcggtgaggtagtgatgtcctgctacatcaacattgatttagatatattcgtgtgttcttgctttttttctgtattcgttcaaatctgacgaccgacgaggtagtgacagccgactgcacccctctggactatactctcaaattcttagcatgcatgtgttgttatttttgatgtattagttcagatatgatgttccttacccattgtatggcttttgatttgggtgtctgcaaggtggcatttgtgttcttatcatttgtaaataaatagtggataaaattaatttacacctggagaaatattactcacaaaacatgcaagtcaaggtgagagatagtttatcgactggggtatcaatgcagatcatccatcctagcaaacaaaaaaatatatcatcccattcaacctatcaaacatcaaaaaaaaaaagaaaagaaaagaaagaattactatatccataaaaatatagatggacatgtcctcggtgaactctggttggacctctccctctcttgtggtggcgcaccaccacctccagctgccccggcatatatgctcctcccatgtcctccaatcaacggcgggacgtacgttgattacgttcgttcgatcgcctgcgcgtttcatcaaaaaggcccggccctacatgtacacagcgggctagctagccgctttcgcaacgagtaggtcggtcctcactgtttgctgttgatcgacgtgcaatgatccgatgcgacgatgatacaccgattctcgatcgacaagggcaaaaggagctatagcttatacagcactgttccgtgtgtggtaaatgagctagctaccacaatctgctggcgatgcaccggcacagttaatgtgatatatataatctcgtgcgtctcttatgccattcccaacccaataactaggatgacgtccatagtattaaataagctaccacctaggataaaaaataatgtggcaagtgaataaatgagaaaagagaagaaaaccatatcttgcatgagacatgatttctacacaacatccaagacatcatgtgagataaggagcattacatttaggtatagaataatagtgtttattttggaagaatagtgtctattactagtttcttaataatatggagtttatggaaactatttctaatgttttgagtttggaatgccttaatttgtttcgttgggtggtgagatcaaacgatgattaattcgttccgagatgggcgcgtacggcggcgaacatgcgtgttgccggatcggggacatgcgtatgaatgtaccagcaaacaactatccgcttgccacttctacacggtagatatatgtatgcagggcgtttgcacacgcattgggtcatcatcgatcgatcggccggctaaattgctgtagccacagctatatagctacctttcttccgatgattttcgagtcgagtacaaaacagctagcgacgaccgagatgtggtggtggtacgtacgagccactaattgccaaccactattggcgaactaacctgtcgtccgtcctcactcgcttcaattttttcctaccctaattattgaaccatcgcgatagctacgattggcacgtacggtgttaggtctctctagctacgatctgcctcatttttgccaacacggctctgtgataaatctgtatgcttgttacagctgcaccagaaagtccaaagcgtaccttctacgtctcggtggtacataatcgtttggaaagaagttcaccgaactaaatcaagcaaaatttttcaatatttcacaggaaatggttgagatatgtatgtgcatcattggaaggattgcgatgcccgaggcctctggtcataggcgcatatacacatcgtctgcaacactacatgtattcactaatatataagggctattcagattgtaaccagaataaaccttaccaaaattttagtaaattaataatataatattactaacatttttacaagatttcttatatatttactaaaatttgaaaagaaactaaatgtatgtactacatctttgataactttactttaaaaaatagtatggtttaaaatgacattactgtaaacagtctcatagactttgatcatctattttgatgcgcatgtagtatattacgggcctgttcactttgatgaaaaaaaaaccttacccaattttggcaaattgtcaaaattttagcaggatttcttatatagttactaaaatttgacagtaaactaaatgtagcctttttttttgacaactttaccaaaatttggtaagattgaaaatgacatcaaagtgaacaggccctactacgataatgttgctacaatatgcgtgtgcacgtatatggtgtaaaacggagtaacaagtgcgtgcacgcgcgtgcgactactgttacgggagtacacaccgatttcatgagacaacgggctagaacgacgactcgaaggggccgcgtttcaattcgttcgaattgaaagtcccaagtcgcttccagtaggtactactagtagctcacacagtagtcaataatgctactcatggacctcacaatgcttcgatcattcatttacttcgctggggatattcaaacgcgattttggttcacattttacaagttacacttcacatttaccagatgagggctaaatctagctagcacttgtgtaacgctagctagcagctttatttcgttggcttgtgcgtgtgagagagagagagagagaggagagagagagtaaaagaaatgcagagagtagatggattggctttaatcgtttgtgtgcgcagaggacgacaatgtttgattactccctctaaaactatgtgtagtaaaggttagaaaaatataaatctagaaggtaagaaaaaggcagaataataatcaaggagattgaacaaactttacgataaaaacgatcgatcaagtcgatgaagaagtgagacttttcggggagggagagaaatgatcggccgctctgctgcttcgatttgattgttactcggcacgttttccccctagctaccatgcatgatcggaatcatccgatcgagagattgtgagaaagcgatggagagatgtttgttctacactcgatggaagaaaagcttcagggaccgcaagaaaaagcaggttttggagcgcataattggccggacagccagcccaaaagatcaattaattagagtttgtctgtgtatttttgcatcatccatagccttgaaaacaaagggggttgatcgatcgatgtaggggtccatccttgaacacatttgctgcttgatcttgatagctgcgcgtgaggatgcaacagtgatattgctctgctacagtaagggatatctatcttttcctgttactactactcctaccttttttcgagcttttctttgatcgatgaaacgtgttgcaggaaggaaacctggtctctcatgcatgcatgagtagctagtggagtaattgaccattgacacgcccaaatgatgtttgactagagattaaattaactagtgaaagaggagggtgatgcatggaccgtttttatatgggtggccaaatgtcaacgtatataggacttgcgagctgatgcttttgttgatgtcaacatacagagaactttcttaaatatggcaggtacgtataagtataattaactccaattgatgaaatattttatagcacttattttgttgatgtaaatgagagaggaaagagacataggagctggtctcggccctcttatttaattatctgcttaatgaattaatggattattaataggcacacttttcaaactcataaacaatatttttttaaaaagattatggatatgattttttgaaaaattttattttttatttatttgtactctcaaatttattatcacacatcattcatttattcagccattgaaaaagaacacctcatgtgaagaataaaaaataaatgtaatattaattaaataccatcatatctctcttgtatttgtatataatataaattctaacagtagccatctcaaccattttacttgccttaaaaaatgcatagggaatatccagtgttaaccatcaaatacgtaaaagcatgtgaaattcctggtcatctaaattttatccttttcctctcctaagtaaagttgagtttggacttgagatgtagtcgtagcgtggtagtgtagtttatggttataccaatcacttagtaattttatcatggatttggaaaacttttaggtctggttttatttgttttatttgtttgatatttttaatatatattatctcctctaattgtacaataaggatctttcaggccaagtaattagccttttgtgaagaccataatgcaaacctattccagatttgtaccacaaacaacttgggaccattttattccctcctacaaagcctacctaattaatctatgcgtaaccttaaagttaactctaaacaagtacaatgccacccatatatacatggatcgatcgatctcattgctaatataagctaataagcattatgagaggccccccctagcttgctagaatcttaccatttctttgaccaagatcacgaccgcccaaaaagaaagagctccgtgacaaagctcgattaggcagaggttaattaactatagctatacttatacatttttttcgctattaagaaactaagccgctcgtgatggcttgggggaaggcacgtgagggagccgtgctcttggaccacgcatattgctacttgatggttttgtaatgccctaagtacatcgaggagggctaaacaaatgggcagtagtaaattaatttggatgggaaagggggacatttcaaacaactggcatatgtttgcacgagtatttattttggaagatagtgccattgtgtacgtttttaatgccaagggtgacgattatgtcatgctactggttttttaattccatctgatgttttacctcacggtaataatatagcatagtacttttactccatatatattatatactcttatcaataatacatcatctcttttaaaatataaacatttttaagtgcttattcacctattctccatcataatcaatcgtaactatcttttatttagttttttatctagttttatttaaccaatcataattgtttgtcacctcaaacttatcgaaaaatggttatggagtatgtattgtgttaggggtaaaaataacggagagtaaaaagacaaaaaaaaatcgaaatgccttgggaaaaaaataacaatattatcccatcattgtagaatgatagaggcagtaactctcgtgcgatgagagtgaatatatctgcagtagaaatgggcgttaggtagcccgccaaacacagcgggattaccgttaattgagctgatctagcacggtttacccctactgtttgggtgaacattctctctcgcgtgcagcttgcagcgagcgaacggaggtgatatggtgatatacaaaagctcttctttttacggccttgatttaccgagtctttactgagtccgggcaaaagaaggcaaagatcgagaggttggagaaattgagaacgcacgcaacgtaccggaggcgaaaagcggacagcgtacgggcgtggaaaccgttcggtgttccgatcgggtccctgcaggtccatccctgtcacaccttggcgcccggcaagctaggttctgtaaattaagggcagtttttaacaacggccacttctacttaaaatcttcatcaagaaagatggttcagattcaaacttagattgaaatcaactatagtcgtaaaggttagaaaaataaatagtaaccataagctagaaaacccaatctttataaataaatactgaggctgcattctttgctgagagtttacaactccccactctcgctttccacgcatatgtttttcaaactgctttctatatgaaagttgcttaaaaaaatcatattgatccatttttgaaaaaaattagctattaattaatcacacattaatgcaaacatcgttttgcatgccggggaggaggggttcctaaccctttctcccgaacacagcctaattgtttcttaaaattttaagctcatgacctaaatataggagtttagaaatatgggctctggcggtaaagctgcagttgaaatatatgaagcaactttatatatatatatatatatatatatatatatatatatatatagcactaaatgacaacctgcacaagagactccaatcaggtaggtatataactatatttatctatataactctttatctcaccaaatctacctgcgaccacatgcggttgcatatttttatctttgtctcatgcataaaatgtcaccaacacaaaatgactgttaaacagactcacctttagaacaagacttttgtagagggcatagagatcagtgtggggtcgtgcgatctttatcaaagaggaccaccctagaaaggcgtgacgccatctacacaaccgcggcaaacgtgtccaaaagacagactccttcacacatatacactcnctctgacagagagaaaaggcgagttagatttgtgggtcctcgcgcgcgactggccaacctaacatgattgttgctgaaggaggccggaactgataaagtgggtgggagcgcgcgctcacgtatagatgtagatatatagatttcgggggggtacatcccttgggca

SEQ ID NO: 62186 - DNA, 1803 bp, Oryza sativa
aaatgatttcaactgaaaaagtcatcaacaacaaagttgtataactcagcaatatctataacttttattttggtaatttcttcatccgacaaagtaataagagatacgtacattttgtgaacaatgttacaaatcattttaccgaatgaagaaatgacccaaataaaagttataaatcctgatgagttatgccactttgttattgatgattttttcagttgaaatcatttagtacctgtaaatgttgtttgaagttgtcataatttaaaattcaaattcaaaactgttcaaacaaagtcatataaaaaaatgaccataacaaaagttgtagatgttgataagttatacaactttgttgttgacagcttttccatttgaaatcatttactacccgaaaaattatttgaatttcttatattttaaaattcaaattttatatagttcaattaaacttggatggagaaatgaccaaaagaaaattggtagatctcaatgagttctacaactttacttttgacaactttttcacataagttcatttagctgtgatgtagcaggtaggacccgatttgcttcgttcttgatgtggacgtgatttcattgtcgacttactgttctatgctgctgcagcgagctgtctagaagtactattttcattatagggcaacatgtgctatatatacagatagttgtatttcgtgcttttgatacaatgttgttagtgtatataagtaacttcagattttctatctccattttgctgaaaaatgtttctttatttgtgtttatgcaatatctgtttctgcatttttgtgagagccatgtgagattgatcatacgcctcattgtggttacgtagttgcaggatgcaggttctcatgatcagagatgacaaaatgcatgggcaggttgtagttatcaggtaatgatgcagctactctttagatatctcaatcactcagtgtactgaattatgtttttaaatcatgtatagaggtaaatcatgtacaactgaatttgttatgtctacgtcttcttattgtgctatgcctaactcatgaattttactattcctcactcattccgtgtgtttgttaggtgtctgctcaatatgtaacaagtttcatttactattatttcttctacttatcatgcaatgcaggtttctctatcctcttcatgtcgatttgctgattcatgatggagatggctgtcttttgattggtgtcatttcgacacgtgacttggtttggttagcgaatgtaaatgactatttagccatgcgacttctgttttggcgagtgacttttatgttcattagtgacttgtggttgcttattttgctacataggatatggtcatgtactgagtaaacacgtcgctgaattgggctatcagatgtgtggatgttaattgggttttgtattgaattttaattgggctgaatccatttgatatatgggcttcttgtagcgcccgttccgtcgtggcgcctagcgggaaaattatctcttaaaaaccctaattgcgaaatttgtttctttgcttgttgtctagtgtccgtgccatctcaagatctcaatccctgatctatcgtcgagtccaatcccgaatccaatccttccaaatcaaattcctccgcaaaagtctattttgcctcccccgggggtcgatgggccgatttcctcccggcccatctacccctgggggcggctcctttgacttttgcggcggactttgatccggacggatcggattcgggatcggactcgacgatagatcagggattgagatcttgagatg

SEQ ID NO: 62187 - DNA, 2606 bp, Oryza sativa
  unsure (1)..(2606): unsure at all n locations
agctgtatgcacccnctngcnacnnncnnngnngntttataataatgtcgatgcaagttgttttgaatcagtccaagaccatacatctgaaattctgaatcgaatcgttcccacaattaactgagataatggcactaaaacatacagaaaattttaggatgcatgcacttagctagtcgatatgatatcaacagctgttagccactcggtacagcaccctgtcaagcttgcattcaagctagatgaatgaatccatttgctaattttcccatccggaacagtgattacggaaaacggagtgatccatctggaacagtgattacggaaaacggaacgatctattagcgcatgattaattaaatatttgctatttttttcaaaaatggattaatttgatttttctaagcaactttcgtatataaacttttttaaaaaatacactatttagtagtttgaaaagcgtgcgcgcgaaaaacgagaaagaaggggtgggaagaggggcatccgaacacaccgttcacagcaccctagcaagatattgaaatgcacaagttgttacattattatcgttacatttatgtgtgccatactgtcattttctattgacattgtgccaatgaaagagggaatttcctggacatgtgcgtattactgctaaagagatatttggtgaagcgagttctgttatgattgggtttatgcaacaatgcagcgaatgctcattgtactttcactggatttattgtgataatctataaagtaatagaaaaagtagtctccacgtccgctctcacggtctagaaaatcccacgttaattaaaataaaataagaaaaaaagaaaaatagaagggtattaggattaggttttgtgtaaacggaaaaaaaacaagagtaaacggacaaaaaaaaagttggaaacgaaaaaaaaaatccaatcggacaagaaagataaaaagtgaaaacggacaaaaaaaaaacaagaaattccaatattaatctctacttccgttgtccgtgtaaagaaaagggcgaaaaaaaagtctgagcgacaaggaaaaaggaaacaccatccggaaaagaaaccggtggaaaaaaagccggctgtaaaagaaactaaaaaggtggaaaacaatccgatctggatgcaaccgaaaaaaaaaacaaacgccgtaaaaaaaagccaaaataaacgaaaaaaatccgatctctactcaaaacgaaaaacggaaaaaaaggaaacgccacagtaaaaaaagagaaaaattcccatggaaaaaacggtgaaaaaaaacgccgtctgtaaagaaaataaaaaaagtcggatctggatgaaaaaaaaaggaaaaaaaacaccgtccaaaaaagccaaaagaaaaggaaaaaaatatctgatctctatgtccctaatacctactattataaaaattaaatatatttttaccggtattttggtacgtcatctgtgtttaaatcggttttaattttatgtttccattttaatctatatctctacttaaaataagaaatttctgtcgtatgtagaaaagaaagaaaaaaaagtccgacacaaaaaggtaaaataaaaaataaaaagtccgactcaacgagcgataaaaaaaaagcttctgatgtaagtaaaaaaaagcatctcatcgtaaaaaaacgtccgactcaaaaaagtaaaaaaagaaataaaaagtccgactcaacaagcgataaaaaaaaagcttctgttgtaagtaaaaaaaacatctcatcgtaaaaaaatattgtccgactcccgtagaaaaaggaaaaaaagtctcccagtaaaaaaaaagtccgcttgtatttttagcacagggtatttttttttccgatttttgttgcacgcgaaagagttttgtatgctcacacgcaagtcttttggttttttttccggcctttttaagccgatctattcaccgcgcgcctcccgggcgcctttggttttttttgtcaatttttttcaccagttttttctaccgtgcgctttttgtttttctcatctggttttttaatccgatctgttcgccgcacgccttccgacttgaatctagcactccgtgtcaccgccatattgattgtacgttttctcctccaatttgattgaaaaatcgattccccattcctctctcatctttttctccatgattttcctttcgattcggctttaatttgaaaaagcgaaaaatagaagggtattaggattaggtttttgggtaaaccggaaaaaaaaacaaaaatggggtgtggttttaaatggacaaaaaaaagtgggaaatggaaaaaaaatttgggaaccgcccaacaaagttaaaaaaaagtgaacaccggccaaaaagagaaaaattccattttcatatcagtaaaaaaaaccgtgtggtcattataagacccacaattataaccattgttaatattataacaggggggcgttgtatatatttaaaaaatattgggggaaaaccaccacacaaaatttttcggacactatgttggggacaaataaaggtgggacaaaagacaacacaaatcctcctctttttgtctattatatatggcgcacacatatctttctctacct

SEQ ID NO: 62188 - DNA, 5435 bp, Oryza sativa
caaccgggacttcccgctatttccaaattctttttaaacctggttagggttaagaaccgggactactgataagcgcactgaatattattttccattatatatgtgtttctaaaatagaagataatgcattacaattgtttaaagtaaaaagattaatgacaattacttcgaaaaattattgttgtctgtaataacttaagtggataaaacgtaataagcaaatatatgatttaaaattaataaaaattctaataatcatatattcttagcatatgaatgatattattaaattggtaaaaactctaattaacatatgtatatacatacgacatgatttaaaattaataaaaattgtaatcatcatatatacttagcataggaattatatgaaattaaattgtgaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataataattacggtaatacatcggcggtgacagttgaccgcacgtactttctcctcactattgttccctccttgtgatcgctacgtgagtaaggggtgtcttcatttgataggaggatgctagggtcaatcgtcaccgtgaaagggggttgcccatccaactgatcgtaatcctcgtcagtcttgtcctcaacttcgatgatttttcttttgcctaggagaaccacgtgacgcttaggctcgtcaggccctctgcccttctttcctttgctagacatgtccttcacgaaaaagacttgcgttatatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgctagttgttccatcgtgtcccatggcatcgacacgaatagcgcggttttggttcgtgctcttcatgtcttgggctctcgtgtagaatgtgtacccattgatctcatatccttggaatgtcgcgatcgacccagacggtcccctcgccaggaaggcaagttgttggttgatcgactcgttacccatgagatgttgtcgtatccacgcggggaaagtatcaatgtgatgccgtgtaatccatgcatcagacttaccgatgttcctggcgcgaactagagccaagtgctcctcgatgtaaggagctaccaatgaagattgttgcagaaccgtggaatgggctttacggaataaattgttgtctaccgtcattattgctttccttccgagagttccctttccccgtagttgggtacattgctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaacactaacttgggtacattgctcggcttgcccataaccgagggcgcggctattcgaatagattaaactctgatcaaaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagcttgtgtagccttcatttgtcctagagatgtccatcgacccccgacttcatccatctccatccgtgtacttttgtttataaccagactgagccacaaactaagccttacccactagacatgtggaggtacggtagtgctttgcaacagaggcccgaagaccggtccttatatggccgaggtgctactatcaaaaccatgcaccccgagcccaacctaaaaccattttggggattttgaatagagggggaggtgtgaatccaattccacaataatccaaccattccatagtgtccaggtgataagagtgttcccaaagtctagagttgtaaaaccacctaatgttgcctaattaatcagcgaagcatctacctaaaatcatactagtggtaccatgagtagagtttccactagttggggttttgtttattctagggtgaaaaaggaaataataacaataacaacaataaggtcataacaaaggtacataggcatggctagataaaacagtgataacgcgggaatttaaataaagcgataatgcaataatttaaatcaaaataattttataaactgggattcgatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtctaattctgagttcaaatggccaagttatggtcatttgaagtttatatgctctttaaatgaatatttgtgaatttcttcatttaaattttaatattaaaagggtttattgcgtcagccgaggggagggggcgcgcggaccatgtccacgggagtggggcccacgcggcagcctaacggtccacggtggaccgggcgcacccgggctcgcaccggccggcgccgtgggtcccacgcgtcagccgcacctaagggcgcgggcggctgacggccgggccccacaaggcagccactcggcgcgcccgagggcggccaagccggcgcagccggcgggaggcggcgcccgcacccctatggtcgtcggcggcggccataggcacggcggagcggcggccgaaagtggggaagggaagggggaaaagaggcggcggtccacggctcaccctaggtcgacggcgacgacgaaaaaggcggccggagcggaggaaggcggcggcgtggctcgggtcgaaggggtcgaaggcgttccggcggtcggcaagcgaaacggagggatggacgaggtcggcgaggatacggcgaagccgaaggaggcggcgccaaggtgggaggtggtccggggcgacgacggcggcggaccggagctcggcggcgacggcggagagagagagcgacggcgcgagctcgattccggcgaggaggaagggcggcgagaggcggaaacggacggaggaggtgcggggagggtttaaatagagccggggcgagagagggcggccggggaagggaggaaactggcgcgggaggtcgtccgtcatcaatggcgccggcgagatttgcgggggcaaatccgcccgtttgaacgcgagagagagagggaaaaaatggggggaaagggagaggggatcacggggagtgatttccccctctttattgcacgcggggacggcgggaggcggcgggattcgcggcggcggcggcgctagggcgcgggcgaggcggcgggagcggcgggaggaaggggatgacgggtgggccccacccgtcagcgagggtggcgggcgggcccgcccttcagcggcacgcgcgcggggagaggccggatgggccgcggggagaggagagagagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggctttttaggaaatatacaaaaatcctccaagccttatttgacttttaactttgcatattttaaattgttggaggctttcacacggattttaattattctaggcataatttagaggatgtattttagagtcgttttgggacgtgacaactttcactatagttttccttctcaactattttataaaaccttctttagcaaatcaactaaatttctatatattctttcttccccacacaaattttctccctcatcaacttacaactaaattttggagacaaaaaagtgtgcaaaacatagttgcaaatgtaacatgacaaaaaaaatattggaggatgaagttacaaaccttttaggcacctccgatttgtacgtaatcaccaaaataaattcactagaaattttggcatgacctcccctcttttttaaagaaattttgaagcttgctcgggcagctggaggagaaagaagacatatatataggggtcggactttagtcccggttggtgttaccaaccggggctaaagatccccgagatctttagtcccggttggtaccaaccgggactaaagttacgaaggttagtaacaccaaccgggactaaagatcccggggggcctgacaggcgctggcagcatttgaaccgggactaaagatgatctttagttaccaaccggggctaaagatcaaatatgcccgttaccctttttaactaggactaaagatcatctttagccccggttttgtttgtatcggggactattgtggaattcggccgaccgacgaaagatggtttctccaccagtgttataaaatgttttggctttggttaaaattaaactaaccaagtttataaaaaaaataataattttttcgacccaagataaagttattataaaatatatttaattattaatttaataaaaattaattggtaatgtaatacaacttgaagcagtttaactttgactaaagtcaaaatatcttataacctgaaactgtcaattaactatattacaaagttgaaaagttgttttttaaaaacatattctactaaccgtgtatatatagaatttgttttataaaatcataacgtttagcttgcgaagtgtgctgcccaaaatatttattcattcatgacattcgaacagggcaaaaggtact

SEQ ID NO: 62189 - DNA, 1472 bp, Oryza sativa
  unsure (1)..(1472): unsure at all n locations
tgggcccaaggaagggttggggaaggttggttttaaccaatggaggggaagggttgtagaatagttattctagggaaggggtgtaaaatagatccactatctatatatatatgtatatatgtatgtatatatggacatatatatgtatgtatatatatgtataaagaaagtagttcaagtgtaggagtagttacgttgtcgttacattgtaaatatacaactatgctatagtacatttgacactttttagcaattctgaagaaaaatggtaaaataaagactttggctctaatgctgacgtgttgtacggtcctaattgggtcagaaacgagaaattgcgtgtgcgagagagagagggggaggaccaaaggaaggctcatcgactgcgagagagagagagagagagtggggggaggaccaaaggaaggctcatcgactgcggatgcgccggatagagtaggcttcctcagctgtcagctccgagaatctctagtgccagcgggcggccatcgcagcaaagaatatggctgccggagcggccgccggccgccagccatattggagggtggagacgtggaggcgaccgatattacgggagcacaatctccgtaactgctatcccaggccgttggattggagaagatgggcaggatctggcccggcgcacttatccttaaccattgaggattcgaggttgtgttatttaccatggtctttttttttttttttaagatatgatcccgtttcttgtttggttagagatgagaatggataaaataaaaacaataacatacaagtacgtattaaccccacaaaaaaaagtatgtccttttcaacgaaacaaattatcaatagagttgttttcaagtatagctgtgagcctgtgaccagtgatcacccaaccacagcacttcaaagttcaaaccgaaatctacgcattcgtaagccaacaggaggttgtcttcattcctcgccttttggagctagcaggaaaactcctaggcatttctcgtatctatcatctcctggatatgctaatgatatacatctgtgaatatatataacacattaacaaaaaatattggatgtgtatcgccaatttctctgccatatagtcttagctaagtatttagtcggaatcctggagtggtgcttgcattaagaagtggtatgggcgtatggccagtccggcctaacgtggtggcacacggctcgcgcggtgcccccaactggcggcggcggatgccgtcattgccatggcagaggctagcactcgacggaggcggcggcccgctcggccaactccccccgcgaagtgcgactccaaattcctcggcctcttcctcccccttccgcggtggcgaccacaaggacggcaagggacgcgcaccgctcctccccctctctccctgcaccatcacaagctttgacgacgattttatccatgcnatatcggagtgcaatcaaggcca

SEQ ID NO: 62190 - DNA, 4146 bp, Oryza sativa
  unsure (1)..(4146): unsure at all n locations
cagcgccgatagcacnctacgtagcaccncaccggttatagtatatatctgcaattgacaacctcccggaattgaaggagcttgagttagaaggcaaatgttgtttctcttcaagtgtggagagatatcaatgcacataacaagaaacttatacacaagagaacacaggttcaggatgaaccaaaaggaggaccgacactagctaacaagaaaaagtctgcattcttctccatctttccgtccactcatcgctgattcccggtactgctaacttgtgtgtgtgcaagctccatcgtaaatatgtgtgcttcgcgccatgattctcttgttcttgcttgtgttctgttgtgtaagtgtgtgtgtgtttccttcatttgttccgcgcggagcggtatgccgtatgcttacaaaattactgcaagcttgctcctgtgccgagtcggatgtgattgtgttgtgcttggctcttgttcaggatgccctgcatgcatgtctgaatgcatgcgagtgtccatgtctcgagtgagtgccgctttgtgtgtgcgggcatatatggctgtgcccatgcgtttttcctttgaatttggatgtgtgatgtgtgtttatggttccatgaaataagtgacaccttgcacgtcaatgtaacagttgtgttgtgtgaatgtggatttataatactctagtagatgatatcccgcacgttgctacgggaatttgtgagaaataattacaggagaagatgcttacaatggaccaatatataagagtttacatggatattgtttcttcaatcatgtggcagtgatgagagaacacaaaactaaaccggaaaacaatagcagctgagttcgtgaaatcttcttgtgaagcgaaaaaaaaaaaagagagaccagtttctcgaaaaacaaaaacacggttgcaccaccacgatactgaagttctactccgatattcctgaccagccaaataaagttacgcaagttacacatcttttatgtttgcatacgtgcgctcactgcgcatgtcttagacatctcaatcagcagtggttgaacaaaattatgaataacaacaaaacactacttaatcatttggtttcacagtaaaccaaatcacctgcacataagaatggaagcacaacttacctacttgtgaaatctgcgttcgttgttcctagttgggaactaatgtgcggtgcacgcagaatggagcgacttattagcgcataattaattacatattaactttttttgaaaaatggattaatatgaattttaaagaatggctcaaagaggagggaggcaatatagacttattacaggcatataaggcgcgtcctaaagaggagggagcaaaatagacttattccaaccatatgtaagacacggcccaaataggagggaggtataatagacttattccaagaataagcatgatgtgctgatcgtgccatcgggtcggcccgacgcggcccgactcttattgggtcatgcctggaccgctgtgcctcgctgtgcccgggccaagccgagctgggtggcccatttggccatatatacaagcaggcgcctgaagcttctttaaacatttaactaactatttgtcactctcagcaagtttggcatttaaatatttatcacccatatattaataacatgtgaatatttatgtgtttatgacatgtgggtttaggtggtaaaccgttaattgtcacatctaagagtgagaaatagttaaatattcccattttcgatggtttggaaaggatttgagtagtttataggcattgnatgcctgagagcggtaacactgagtttaattttttgcgtgaagcgaggacgagagcacattatgtttatctattgaacaatagttaggagatatctacagttgcaggaaggtattatatataatcacgggagagtatttacaatcgttgataataaattagcagttgcgatgaaactcctgcatttattactttggactagaaaaatacccctgtgttgcaacgggtactcataattagtttttagctacagactagtctgctacctctcttcgctcgacctgcctcttttcgctccagctcacacaaccgattgccatcttcaaccttcaaaagacaatcatgtgtccatacgataccggagccgatcctccccatcgattctggtgaattaaagacaaattaaaaggggaaatcattctggtgaattaaagacaaattaaaaggggaaatcatgaataaaatgatgagaaagtagtggagaatcgatttttgtaatcaattggagaaggaaacgcatgggaaggctgatcgacgtggcgatgacgctatggttttccttgacgatggaaaaaaaaccagattttttttaaaaaataaatccttaccggtgacgtacatccttccgcgtgcgaaaaaaccatgacgtagaaaaatggcgacgaaaaaaaccgcataggaaaaacccagaaaaagaaaaaaaaagtggacgaaaaaaaagggagaaaacaacgaaaaagaatatcaattaacatgctcgtgggttgcaatggaaaaaaatgcagtaaacatcggatttgtagggttcaagtttcgtcatgataaaatcatgtgtttctcgaatactccagcatggatgcacgcacctatcaattattgtgttctctcctactcctgtgcagacaacggacaaagcggatagtatgagaaagcgggatgacgcacaacgacgtaataaaggtcgacacatgtaaattttctagaatacttgtgtattgtgtatttttaagtaagtaggtgtattttagaccggtacgtgtagaattaaatctaaatatggtaagtgtttttattaaattctttatgattaaccacactctctagatttgttttttgaatttttcaaaactcaattgctaattttaataattaatttaaaaaaacaaactgaaatccctctcctaagtatgggccaaatctggcccattcttccttcctcctcccccgagccagcccgcttcctttcctccctcttgggtcgccatccctctatccgcttaggcccagcagctgccccgcttcctctgctccctcttgggccttcatctctatgtccgctcaggcccagcagccgcaccagcccatgaaaaaagtggacgggaataaaaccgagaaaaatggagaaaaaaagaaaaagagaggtgaaaaaaaaaagaaatcggcggaaaaaaatacactaacggacgaaaataaaaccggaagccttatgtattttttaattaggtatatagatatagatatagatatgtatctgtggtcatttacggatggaacttagtgaaagtagaaaatttagtactccctctgtttgataatgtaagtcattctagtatttcccacattctagatgttagtgaatctaggcatacatctatatgaatgtgggaaatgcgagaatgacttacattataaaacggatggagtaaatctaaaccatgcactgaacaacttcacaattcctcaagcaagatattgaagccagaaaaaaaaaatcgaaaattgcaggtttctcttaagagaagcggaatcgaagaagttgagccagaagaatacaccatcgaatttcttcaaatattttttcgtccataaaactaggcataggttgcagagtcagaaattttttgataaagattaaagaatatactcagattagttcgtaaaactaggtctaggtttgcaacagcctattacaaagtcgccatattgaaaatgtgacagccgccccactttgcacacatttattcccggcaaatgcaatatgcattttttggtgtgactggagtctatgctttcttggacggtttgttatctaaaactaaaaggtttggccaaccctactgaattagcgtctaccaaatgaactgccgaaagaagaaaaataccctctgctaagctgcaaaccaagcaacagctacctcagatatgtagccctacatcatggagctatcagataaccaattgtcaccaccttttctacaaagatgccaactcttcttcagatatttccaactcacactgccgaaatgagaagaagcctctnccngngcctctncaatgggctgatcttagntaagccg

SEQ ID NO: 62191 - DNA, 2259 bp, Oryza sativa
  unsure (1)..(2259): unsure at all n locations
ggatctctgaatttcggattgcgatctggtggatcgatgcggcagtagaggcgcggggtgttttattatataggaagtcgggggaacgcgtggagggaggcgtttccgttaagaattcggcgggttgggggggggggggggggacgggacggttacacgtgggcggtgaggggggaggctgacaggtggggcccacctgggatggctggactggtggtggtggccagcgcgcgcgcgcagtttggttcgacggtttttgcgcgtcgttttgtcgctggctcggctcgtttccgctgtttctggaagccgatacggatagagctgccagggagggaagacgcgacgaacggacacagggtgacggctcgtcggtcggctcccggggccgtgttctgcggcgggagccggagtttttgctgctgcaatagtagaaagcgacggggtcgcgttcgtctggctcgcttcatccgttcatcgtcccttgtgtcatcgcctcacacctcgatcggcgtcatccggtgaaatatcagccctgaggaagggagggaagcggcgaaagggaaggcaacaacaacaaaactaggtactccctccatccaaaaaaaaaaaaaagacacccttgtttccgtgtctgtccgtcttatttaaaaaaattataaaaaaaattaataaaataagtcatgcataaaatattaataatgttttatcatctaacaacaatgaaaatatgaattataaaaaaatttcatataagacggacagtcaaaattggacaccaaaatataaggtttgcctttttttttcggagggagtacagttcagtcgtaccgtttttgtactcctcgtcctgagcgtacggttgtacctgtgttgtgtgttgtgtactaccgcactttataggtgtccaagcccgttcgtttctatcgccccgtacgttttgactgcacatctaagagtggtaattccttcggtcctaaaataattgtttcgttatggtttaaaacctatttcacaatactatcttcgtttcaaaaaactatttctaacataacaactacttgttctaaaataaagttattttctcacctacttcttcttttaaccaattataaccatttccctctacctgctttatatttttaacaaatcacatacttctttcaatcacctcttatttcaatttctaccaattctttcacgtactaaatgagagagattttaattcttacttgctgaattttaatttgtgctagaactccctccgtttcaaaatatttgacaccgttgactttttagcatatgtttgaccgttcgtcttattaaaaaattgtgaaatatgtaaaactatatacgtacatgaaagtatatttaacaataaatcaaatgatatgaaaaaaataaataattacttaatttttttaataagacgaatgatcaaacacatgcttaaaaagttaactgtgtcaaacattttgaaaactgaggaagtaatatacagagacacgtatcaagagacggagtgagctcacgctagagtgggcagagctcgtagtggagttgagtaattcgatcaccccccagtgcatgggcgtggtggtggcgcgtcacttcgccgcgggtcgcgcgcttgatcagctgccgcgtcgccgtcgtcggtcgtcctcgggacgtggggagcgaccgacgtatccggtcttgccgtttttgtttcctttgctctgctgcggtttcaagatttttgtcctatccttacccgtttgctgctggtacggaaatgattttctcagatgagttccccttcagttttgtactactgcattctctttttcttttttttttcaatttttggagaaaatattgtgagccgggtgacttaacatgcctgctcatgaaaatagttttcgcttatggtttgtgagatgctcgtatgagaaaattccgatttatatnnnnnnnnnnnnnnnnnnnnnnnnnnnnnnnnnnnnnnnnnnnnnnnncctatagatgagtcgattacaaatnactggcccgtggttttcacacgtcgggattgggaaacccttgcgtacccaacttaattgcttgaagacattccccttttgccagtgtggtaaaaccgaaaaggccgnaccgtttgccttttcaaaaattggcagctttatcatcgcnagttagggttaaccctttaaaaagaaagccgttttcctttgttgggattcacaaaggtattttgcaccccccggcgacggttgggatcct

SEQ ID NO: 62192 - DNA, 1731 bp, Oryza sativa
attacaaatctaataatcttatactaaaactcaaatagtgatgatatatgctaagtctaggtgatgtatattgtaggaccctagctagtcaattattatatactaagtctaattagaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacgtatattatcgaaccctagctagtcaataattatatactaagtctgattacaaatataataatcttatattaaaactccaataatcttatatgctaagacaaaaatagccatgtttgctaaatgtaactgtcgtatattagaaccctacacaatcttacatgctaagtctaattacaaatctaataatcttatactaaaactcaaatagtaatatatatgctaagtcttggtgacgtatattataggaccctagctagtcaataattatatactaagtctaattacaaatataataatcttatattaaaactccaataatcttatactaaaactcaaatagtcatgtattctaagtgtagctgtcgtatattagaacactacacaatcttatatgctaattaagtctaattaaaaatctaataatcttaattgcattacaaatataacaatcatatatatataattacgtcacttgcctgggcgaattccttcgagggctagctctaccagtccggcttgagggacgactccgacaacgtcttttctgcaagatacaaaaagatgtattaggataaacgcgaagtaacatatattgcatttgacgttcacgtttcgttcacgatatcgttcatgttcgcattctcgttaaggtcacgtttcattcacctacgtttgttcgttcacgttcattaacttacctataattgcatttcacgttcatgttcgttggctcgttcacgttcgtccgacaacgttctagttcacgttcattcaccttgttgtcgttcacgttcgttctctcgttctcattcacgttcgttggctcgttcacgttcgttcgctcgttctcgttcacgttcattcaccttgttatcgttcatgttcgttcgctcgttctcattcacgttcgttcgctcgttcacgttctcggtgtggcggtagcgggacggcggtgtggcggcagcggagcggcggcgggatggcgcggcagcagcgtggcgccgcgcgcggcattggcgtggcacggcggcagtgtgcggcgtcgtggcgtttcgtggcgcggcgtcgtcgtggtgcggcgtcgtgtcgtgacgaggtcggcgtcagcgtctgaaactcggtggccggcggcaaccgagagggagagagagagagatcgagatcggagagagagatcaagagggaggcggcgcgcggcggctctcaccccagagatgcggcggcggcggaggaggcggaggcggcggcgacgacaacgagcgcgagacgacggcgagatacggcggcggcgtcggcgcgaggatgccctaggcagtggcggcgaaggagaagccgagagagatcgatcgggcaaaaacttctaagtgttggtggagaagacgagggcgcgcatcgggaatatatatagccctagatctttagtcccggtt

SEQ ID NO: 62193 - DNA, 3060 bp, Oryza sativa
gttcggggcgagacatcgccccctagggctctcccgctggttcgccccaaggccctcgcccagttgccacgtggcggggggagagagcgagaaggggacccaagctagacagccataaatacgcggcgccccaactgtccctcactgcatttaatgcggtaagggcagacgtgcggtgtgcctaactgacccccgtcaatcggatgtgaccagtctgtgaccggcctgttgccggtcacgtccgattgaacgggcggccgtgcccccacgtcgcctctgtatccggtgaagtggaggtaggtatgacccgtcacatcggagcgtcactcgaaggagggctaccacaagtcttcgctcatttatgagggaatgacagggctgtcccccgtgtcaggcggggggggggggggggggcggcgctgggtcccactcaaggactggttgctgcttagcttccgggcgaaggcacggatcgaggcccggtcaaagtaaagtggggtccccctcccatggaggggtaggtagaggcggcgcatgtggtatccccttaagctataaaaggaggaccttgcccaccgagacaaggggacgactctcagaaaacctgaactctaggagaaggaaggcgagagcgctctccggagtaaaggaacccttgtaaaactcatccataatcccaaacacaagagtagggtgttaggctccatagcggcccgaacctgtataattcgattgtgtgcaagctagccggcagtcttaggggcgaacacgtgatttctaagaggcgagcctctgcccccggccgaactcacgaaaggggggtctcacgactccccgctatcgagggccttcccttgacaatgatatatatgttatgcgcgtctggctttaaatatacgacgctgttaattttttgtatgacggttgatcattcgttttattcaataaaactacaagtattgtcttttacttgtttttatatcattaaagatactttaaacactctgtttatatattttgcactaaacttttaatgagtcgaataatcaaacgttatacctaaaggttaataacatcatacatttgaaaacaaagagagtgcatttttagagatgcagcgggcacagaatgttatttcaaaatacgaaaagaaattctcaactatataaagcatgatgatacgagatgtcgctgaaagtgaaagggaagaaaactggtggacgcgggagatatctaagattatatttatttgaatggcagagaccacgcgaatctcaatcgtgctgtgctctgcttgtagaatataaatccacatggacaactgatggccgagaaaagcagcaagagagtgaaagaaaaaggctttttagggcggatatggtgtctgaattaacgtaatgggagaactttaacggtcgttggagtttaattcgctttacaaaccttgtcttttagcaaagtgttgttcttcctgttgtcttaattaatctattcatttgaacttatttaaatagcacatacataattacatactccctccgtccaaaaatataagcatttttagaatagtgtcgagttaaacatttttaactttgactattaatagcaaaaaaaaagttcaatcaagtaaaattgatattagtacgcagattttcattaaacaaactatcataatatgtaactttttttattttaaacatcttactttatatatattgttggtcaaaacagtgtcttgaataccgcatcaaagtccaaaatgcttatattttgggatagagggagtatatagtcttttagttttggtggctatcttggggctgtacttttccgtttttttttttgcgagaattgatgcccaccaaagcatatatgccagtacactatatatgatatgcgttggtacagaagggacattatgaaatggttcacaaatgatatagggtatgtctcagacgatttcctgaattcctgtacagtttgagatgagggggattatcacaaatataggtctagtaagggcatttacagggcattgacgtggtaattggctatggctctcgaagccgccactccgtcttagttagcccgcgccatgcccttgccgcagggcccccttgtgccttgcaaagggcgcattgcctcattagggctgaggcccactcagcggtaagcctcccccctgctttaaaaatccatcattcgataccactagaagaaatatgaccttatgtgatgaatttctcgtgacgtcggagctattcgtcattagcacattccattttatgacgattagtatgagatgggttggctcagtgacgaaaaaaaggtgttcgtcgttaataccaactagaaatcgtcataaagtatttcgatgggatatcgtgacgaatattaatttgtcataaggggcacaaagcaaatgtcacagatttatataatgcatttatagaaaaatatatttatagttaaagcaatttaatcaagtgaattaatgaagaaactaaaattttcctataaaaatcatggacgggaatatttttgtaatattctacgtggtctaaattattctctgaaattttccgtgaattttagaagctcaataactaattttaataacacaaaattcatttaacctattaaaataaatagaaaacaaattaaaatcactctctttgtccttgggcctttttcggcccaagtattactctccctccctcagcccgcttctctttccctccttgggacggcttccttttccccagttcccctcctccctcttgggccgctggcctaatcctttttctcctccctcgccaaaaagtctattatttctccctcctctcaattcaaataaatttttgggtagtaaatgatttcaaatgaaaaaattatcaacaacaaagttgtataacttatcaagatctacaacttttgttttggtcattttgctatatgactttgttttaataatttgaatttgaatttcaaattatgacaacttcaaacaatattttcaagtactaaatgatttcaactgaaaacttcatcaacaacaaa

SEQ ID NO: 62194 - DNA, 6723 bp, Oryza sativa
  unsure (1)..(6723): unsure at all n locations
gcagaggccattcgcatggaagaggatgagggagaagaaaaggggaactttagtttgggttggcaggggcattttggtattttctaaaaattctgacaacacaatacacggtgtgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcttcttttttggtctcgcctcgcatttctttgcttggtaaagtcttgatctgtctagagatttggtttgttggagggtattttaggatttgtttgtgccttgcacatgcatgctcactagtgctaaataaaacataacattggaaaaaccattatataacacttcagttttatttatttccctaaaatataattctagtatttgaaattagtaagtatgaagttatatccatcttggactctcaactagtattttcttattttaatctaaaattggaaattaataaataaatactccatctgtttcacaatgtaagtcattttagcatttccaacattcatattgatgttaatgaatctagacatatatatctatttagattcattaacatcaatataaatgtgagaaatgctagaatgacttacattgtgaaacggatgaagtattaactagatgtaattgcgtcgatcttttaatctaatctaaagcactacgatttagaaaataaccattgtattgcaacgtacatgtaggctatggcgactagttcacagaagggttctgataaaattattggggggagaggggttgggttaattatatctagctcaagggtgtgaaccagcggtccagcgcggttactgaatatgcttcaattctaaatttccgtgaacaggcaagtagccgtgaaaaagacagaccaagacaacgatattcacaaaggttgtcttactgttgatctattctattgcagatatatttctttgtcaagtttgattactggctcgacatggggaagtagctgggacgtctcgtcaatggagcagcaaattctacaccagcagcggagtttccatcgtacaaaaatagtgattctgaagtgctgagtgcgaactatcaatgatttggtaaagtaaggcctactgatagtctgatatcgatgcatataaaccgtatcatctctgatgtacctatacatagtcagatccaattaatactgtcgaaattttcagaaaatttcaggtaaagatcaggagaggagaaattcgccatggagttagagctggtgtatctgtatccggtgaccttggtgccggcagtcgtcggccggttcagcatccttgcctcgccgttgctgaaggaattcgaggaacacaacctgcaattcaccagcataatcccgctcttcttcttctactcctacatcagcaagttcctctccgacctgcagggtcagccactgcctctagtcaagctctatgcccgggcgctgcaccggtttaccagctgcagcagcagcaaaagccgtgctagcttgaggatctacatggacactgccgtcgtcgtggtgctgtcctacctgtctctgctcaagatcaacctgagctacatctggctcgccgtcttccccaccctcacgctcgccttcatcgncgctctgttcaacgagaagctccgcggtgacaggagaccccccgttgctgaggaagacgatgcaggaggaggaaagatccctcggctcgagcccaaggcgatggtggttgtgccctattaggtgctatgcgcgatggggcagtttcatggaggtgacagctttgcggtgtcccagtttcttctcttcctcggctccacgctgggggcgctggcgctaatggcggcgcggctgtcgcagctcgccggagcagcaccgggcttagcgccggcgtcggaacttctccgcagggccacgctcgtggtgatgctggtgacggcgcacgctgcggccgccgagctgctgggcgaggccacgatagcgctgctctgcctgccggagctcgcgccggcgctcttctggttcacccttcacctcgacggtgaaagctcgccggccgccaccatcgacggcatcaaatcgcacaggaatgtgctgtccgttctcgctgccgcagccgtcgccagtgttgcgtacctcgcggccgccatgggtgagcgtggcctgtccgtgagcaccatcacgatggtgtcttgcggcgtctcagggcttctggtccgctgcgctgtggtcgtgctcggtcagtggccggggcaagctgagacggccggtagtactgctgcctctttgatggaagttgtcctagtgctcaagttttgggggaacactttgctggcagtggcagctatgctgctgctgcttgcgttgctgactgctttccggttatgccttcaagaaccaatgttcgcgacagttgctaaatgtttcagcgactacattgacaaggtcccccaaatgatagtttagctgaaggggcacgttcatgtatttcctgtgttgacatatctgtgacttctcaagacaaacaaaaccgcatgttcataacacagtgccatacttgcaggtaccttaatccatatactgttatccatgattcgcagcccatagtcagaagcccactacaataccgtgacacaaacggacttgtttttggtaatcatcaggctgcttagcgatatatagcttgcctacctagcacctcacacataactacttgtaggaagtacaaaatacatgtgtttacccctcccctgttcacacataaaactgctagaaattggcaaaaaccctccacacacagatttccaacagactcgtcggacaaacatcccagttccactttgatgttggtattgtatcttatatcaattcctgtaactacttatatggcagaaagcaaaatgtttaacattaatatatcagaaagtataactaaaacaggaagacaaacctaatagcacatatatacgtatcaaaattccagcacatgcatgttggcagttttaccacaataattgtattaagctaaacccagagtacattaatccacctctatacaaacaaatttggagtttagcccttttacattcatcaacaaacagaaaatatagagtttatcttaatcagaagtgatatatcaggaattagaaatacagcacataaaggaactttgggaaaacatgaatatagaagcagatccctttgatgcacctaatggtaaaaaactgatgtcaaaagattaggtatcaacaatatgctcagaagtagtctccaagagggagcatagatcaattcagttttcaggccagtagtatccaagagggggcatgaatccagttttaggactaacctctttgaaagctgggtactaggttgtgaataggagagaagcagcaggtctaccaataagttaatagcaacatagcttattttaatactgatcatacacatagataccacccaaaaagaaacacattactttccatatttacaggaaacggggtagatagcagcattacaccacctgggaatgctgtcctggggatacaaggacattttcatcgccaccttgtataaacctctcgcaagtagcataccatattccttgaccccgttcctcgatcccatcaacccaggaacagaaactttgagcctatgttctggtccttaacagtgggatcttaactgatttgaagaatcataccacatgttgacaaaggatggtctactagagctcttaacatagagtagtttatattcagataaataaatgaataagacagtcttgtgagcttggtttttgaagataacaatcaaggccaacccctgttctgcttcaaaaaagataacaaatgaacttaccccatctctaataaagttgttaacgattgaagcctcttacacccccaaacaaaacaacaacaaaaaaaaagaaccctacaactgttgccgaagcctagatatcaaccctaaaccacgaagccagacattttacacccctttccataaaaagaactggttaaaccgttaaaggacccgtaaatgtctggattcacagctgaagagggacaaaacagacattactgttaacatattgtcagttcaaggcgtaaaataccacaagttaaagataactcgaattccctgtttattctcccttttcattagttacaatcattaccatattgctcaacatatatgaaccattattttatttacaccaatgaactaaccgtagatcaaaaggcatagccaaaaatcagactggtatggcagtacctgcctcaaaacaaaagtatcattcagcaaataatattaggacaaccacaattcttcaatcatccttttcaatcattgtaagcatgcctaaataacaatatctggaatggacattatggcaaactactatgtataagaatcagaccgcatcagactacattgtaaagtaatttgtgtcaagaaattcaacgaaaacaaaacaccacattcaattgttcttctatttcagttcgacgaaacaaagatggtcccccaaacccatagaatcacaggcgggagagcaattacccattttttatgattaactaagaaagaaataccagcttatcaagtattcgagtgcaattgtttaactattctatcagagatgcaactcttaaatcacacttctgaattattttaagcatgcccaaatgccagtagctgcaatggagattacagaatactactatgtacaagaattcagactgcatcagccatcaggctacatcctaaagtaatttgcattaagcaagcaatcttgagtccaacaaacgaagataaaaggtcatgttcaattgttcttcagtttcaattcgacgaatttgtggctgttccacgattcgccagaagcgagtaccacggaacagagatcccaatccccccaacctatagaatcacaggcaggtacatatatacagaagcggcagcggatttcagacaagagtgacgaatccgccgacaccagagacgggatcaaggcaggaggagaccgaccgttgcgaaccccaccccccttcaccagacggtggggacgaagcgcagcgccgccacgcgcgcggcgaggaggcccgcgagcctccgcacggcgaactgggtgcagttggagagcgcgatgaggcacatgagctcgtacaccaccccgagcgccgcctccgccgcggacctccgcggcgcgggcacgtngggctngnnggcngagtcctcgcatgcagcccgccaccccgaccgccgcccccgccaccacccccctcctcctcctccacccccgccaccgcccgggccgaagaagccgtcgccgtcgtccccggagaagggcccgcccgcgtcggagggaggcttggatcggcgggtgcgggggcgggtgcgcgcgcggcggcggacggtggcggtggccgaggcggaagggcggcggcggatgatggtggtggaggaggaggtggcggtggcgggggggacgggcgaggaggaggcgagcgggcggaggaggaggagcgacagcggcggcggcggcggcctggaggagggcgcggcggcggagatctccatggttggtggggatggccgcgcgatcggagaaggggaaaaggaaaggaagagacgaagagtaggcaagtgggggaaaagttacgtgtggcgggtggtgagtgacggtgaggagaggagaggaggacgggacgggcacgcggcggcggagagggggatctgcgtgggccgtgcccgtggtgggattccgtcctcaggattcagacgctgctgggatctttctccgtctcgtgtctggttgctacaccataagtttgattttgtggttgtggcaaaccgggaacgactaggatttattatacggacaggtttatagtggagatttgggtttgagcaatcggaagcaatccaatcgaggcagattgaaggcgggataaagcttgagacctcgtctttccacttatgtttacatttatattatctaaaatttaaatttttaatcttaaatttagtgattttaagattttttttatcgaagttttttcagtttttatttttaaatcgctgaaaacacgtatataaaaattttattcacaaattacttttcgtttgtaaatatgccatttccgatggctccgtaaccctcgactggtttttccgacaagttttggtgaatattttgcccctaaaactgaacagcacattttcattacttagacatacatgaaattacattcatatagttcaagaactatagaagaaacggttagggactatggattatacattaaaaacacacctaccgtctcttcacatatttacattatcccttaaaaatatatacaactagaattgatgtcaaatatatatgagttctattttattatagccaggcttggagtaataatttaaataaatgttggtgtcgaacagtatacaatagaatgtagatgcgtgatcaactattgcatcacattgaaaattttgatagtacattttcttaatgataatagaagttactccctcctagaaaagaaacctcgtactggatgaatgtgacatatcctattttatatttatagtactagaatgtgtcatatccatggaggaagtaccttttagtcatatcacg

SEQ ID NO: 62195 - DNA, 22392 bp, Oryza sativa
agagggaatcaccgggaataattcccccctattgattgcacgcggggaggacgggggcggcgggattcgcggcggcggcggcgctagggcgcgggcaaggtggcgggagcggcgggaggaaggggatgacgggtgggccccacccgtcagcgagggtggcgggtgggctcgcccgtcagcggcgcgcgcgcggggagaggccggatgggccgcggggagaggagagggagggggagggagatgggctgagccggcccaagaggaagagggagggaaaggggactttttagagtttttctttttataaaatcattttaactttgtttatttcttaataattattatttgtgctctgaaaattccactaaaatttatttacgtattttaggcttttaggaaatatacaaaaatcctccaagcctcatttgacttttaactttgcacattttaattgttgggggctttcacaaggattttaattattctaggcatcatttaaaggatatattttagagtcgttttgggacgtgacaggaagcacgttgatttctatgtcccagtgtgttgtatattggccttgcactacaattttgatgtattccttgtttcccagctgcatctattccactaacgcctcattctcatttgttgcatcaatagtcaacagtgagttcagcttgtcgtcagcctaatcatacgcctagcaattactatatggtgcaacaacctctttcattgcttcacttaggccagagtaatacacattaaactcttgcacagattcgacatgagtttgttccaagaactcatcaagtaaataatttgaggaagcagaaagttcttgttaaaatatacggaaaatagcaaattgtacatgtacacaagaaactagaagctggctccatggaagcatttcatcaagcaacttgcatgcagcattagagcgggttgagctctcacctgctcaccgtgtggttgcagccgagaaaaagcggagaactgcaggggttcgagggaagatgcgacacgctgctgcgtatggacgtcaatgggaggagcgaggaggcaacagacggggcggcagcgctgcctccgcagctttgatgactccactagtattgccaggctataccctttcttattcactctagctacaaactttctccaacttccagtgcatgcaagttgtactacttcccactgccaagcatactcaccccttacaggcctcacagttttgataacaaacttttgaacaattggatcaaccctaaacatattatgcagccaccctaggacatcgtacataacctactactctagtgaatttaggcatataagttcaaatctaccctgctaacgcaaaattagtataggagcatcaccgtcatacgcacaaataaccacatcatatgtcatcttgatagaacatgaaaaaatgtcttaccatggaactacccaataatttcacatgtggttcagtttttactgatgcaatacaacttcattaaaatacggttcaacgtcaacttaatactccgtgttaatttttactaccgccaattatgcacagtaacatacgtgctaccaaaaacctttttcactgtaataataaattaatactaagtaaaaaagacatgtactcaccaagtacttacttaaatatttaactactctaactattctagtaaaactaatttaaatctgtgctaacatccagcattttacttagggattgggaatttaaccttgcaatcacctgagggagggcctccactgccgctcctctcccgctgtctgcaggtgtggcctccttcctctctcgtggcctccagcagcgtcctctcccacagctgcactccccattcattgccgacgccaatgtgccctctaagtggtcctccctcttcagatcaaaacgacccctgtcgagctgtggggaaggatttaaaagggctgtactgaatgcccattgttcaataggggatatactggggccaattgaactactgtcattagacagggcctgcggctgttagttgtgggcctagtcgaactatcaaagttcaacaagcccctattgaaccacccgcagtttgaatggcttggctcaccgcgcttccaacaattgatatgcctatgttgaacttgtgcccttcgacaagcctcacatcgaacatcatgaatttgattggcttctactttcacgattataattaggcacaaaatatttttttctcattttccattaaaataataatatattttttaaaaatccaataacttcaacacaatgacagagttaggcatcataaaaaagtttgcgccggcaataatgatcataatagttataaattcttttatttgcatatacgtagatcatagtacttgtcttccacccatttgagatgaacgctactataatgatcttctccaaactacgacttgctacaatagcctccaaatgatagttccagtatattccaaaatgtcgtattcgtagggtttgatatgtatttctaataaaatcaatgccacttctattaatttaatcatgtggctaaaagtatttgttttctaaaccacaatgggtggttagctacatatgtttctccttcttcaacgattgtggttccagccttggtacaaagaaatgaaaacttattggctattcaatgccagcgatccatatatatcatgtgtgcgcaatattactgttgcagatacgtggaggtgaacgagagtactagcgtgcgcctcttctactactttgttaagtcagagaaggatcctgatgtagacccacttttattgtggctatcaggtgggccaggatgttctagtatctctggcctaacccacgagataggtaaattaactagcaggttttttttctcaaattattaaaaagtttacattgagttccttcggataaacaatatatattatattataaaccatgcttataggtcatgttacaataaggcttgttgtacttaacaaattgtttatgtccatatatttatagggccattccaattcgctgcaaaacggtattacagtggaggattgccggaaattatctaccgaccagagacttggactaaggttgcctacattttttattgaatgtggcaacaaagaaaattatttgtatctctgtctcaaatgaaaaaaaaggcatatgcccttatccaggttttaagggatgaactttgtatggttttgcaggtgagcaacataatctttgtggattctcctataggggcagggttctcatacgcggcaacaatggaagggtccaagtctagtgataccaagacagtgaaacagctttatattttcctcagaaaggtaactctgtgctgaccaatgcatgcccagaatttcagatttttactctatctgtcttgtatggaattggtttaatattttttttatttgccttatggttttcttcgagaacatctgcgggctttgaatgtcatttcagtaacatccaccatcagttacaaaatattttttttaggttgctcagtaaattctatggttaggtcaaaagattccttttttgtcacttgagttgtccatttttaaattttaaataccttagattttctttctaagcatctgattggttctaggatcattgagatgatggaaatcataagaatcaatgcaggattgcttatattgtaatataaaattggaatcctagagctccttatattttgaaatggacggagaatgagaaagtacatgtacagcacataattaagtgtgacttcaccatactggatgtatcaggaagtaccacatttaccatttagtaactagcagttactatgaggtaccaaattctgcaacaaaaaatattcttgtactatttgaaatgctgcacaatatatatagatgtaacaaataatgaaaattgaccattatactcccctgatctacttcaataacttaatcatctaaactatttttttggctcactttaatccctacacaattgaaaatggttcactttagttttttttaaaagaattgttcactttacttcttaataatatttctgttttagttcctctttatacaagatatattttaatctaaaatttttcatgaacgtttgtgtcgatggtggatacccgtagaccggatatagagggtattggggtacgttggtacgaggatctacgtaatacgatatcaagcaaacaaaagacaaggattatactggttcaggccccttgataggtaataaccctaatccagttggtatgggattatatgatggaaaccacagattataaagggaatagcggaactcaatgataccgatgagaccgtagtcgagttggttcgactaggtcacccggcgacttggctcctgtaggctccgacttcgtatgctatggtggatgtattggcggtgagattcgatgccttaggtcctgcccagggggtcccttttataccgcgggttacttgatctctaagtaggactcggagatatcggacccctcacgatatggtaacgacctagtcttgtccgagtaggactccttccatctgtggattctgtttctatcatgtgatagatttccttaacgtatacaggaactacccgtatacgcacgggtataccgtatcagtatacgacgtatatccatggatagagggtataccttatccgtaaccttgacagtttgaactttaaaatctccatgtttagttcagtatttggtgcttccaacatatgtagacagtgatataaaagtctaaaaaaatgttaagacataaactgtaatgcatctatctccttatgtagagagaagaaaagaaaagaaaaatatcgttacgaagtaagccgaactaatttcactagttaggggtgtgaattgagctgcatatagtttaggcggtttactgctttcacaaaatagttcaagagactacaattaactttttcataaagaaatatcataaaaaagaaaaaacagttttttataataaaataaatgtgtgatttattttctctagggaaacaaaagtttgtgtttacatcagacatagtagtccttcatgtcaaattatccccaatgtatagttctattcaaatgtgagagtgtcatgttactttccttcgatagcaaacacagtaacagcaaaacataacaatatgagaaggcttgtgtataaggtctatcacggaagtctgcctacgaaaaagccctccattttcacatgcggccagctatatgcagccatggatctgtcaaaatagccttgtcccaggcagccacctatggaaatagaggctttacggcatctattgcttgggacaagatgttttcgcatgtagcccgtgctttattgccttgtccattaaaaattaatgttagactttcttccaatgaaaatttacctttgttcaccttaattgggtttgtttgcagaatttgctattctaattttgatgcttgtagacaaaatttagatttttgctattctagtttccacacctatgtatgtgcaacaagttctctcaagctatacggaccaagctgtgaatcaagttaattttctaatctaagctatattgccgaagctatgaattaaaatgagtaaattctttatttccccatggtagccaactatacggccattttcaagttttctagattatttgtccaatgatccatcaaaagaccatgttgtgtgtcataccatggaaaagagtttccgaatacaacattaagtatgatattatgtctatatggtaagtaaatcgataatgatgcatcatacagttattatgttcttgagaatttttgacacttttcattattgcctttttacgcccatccggttggaggacgctacacatgccacataaatgcatactaacagttacaatatttttttcttaaattatttttgttagttatatgcatcatgttaattgtgacaaaacaatactattatgaaatttagtttctacttgaaatatgaagctgcgattgtcagggttacgggtaaggtataccctctacccttcgatatacgtcatatatcgatatggtatgctcacgcgtatacggacgttttcagcatacgttaaggaaatacatcatggagttcacagatggaaggagtcctactcggtcagaactgggtcgtcattgtgtcgtgttcggactggcctctccgagtcctacttggagacagttgacctgcgatataaaagggaccccccgagaggacctaaggcatcgaatcttagagccaactcacccaccacagcttacgaagccggagcttgtcagagccaagtcgcggggagatctagtcggatcaactcgactacgatctcgtcggtatcgtcgagttctgctattccctttgtaatctgtgatttccatcatataatcccatatcaactggattagggctagtacctaccaaggggcctaaaccagtataatccctgtttcctgtttgcttgatgtcgtactacgtagatcctcgtactagcgtaccccaataccctctctatctggtctacgggtatcccccgtcgacagtggcgcgccaggtagggggacttggtgctcaaggttctactactatgacatccagcttcgccgacaacagcgtcaacaccaacctcaaccaaggagttcctacttcaacaacactggtgtggactcaagtcggtgaaatcatctttccggtttacaccacagtgccgatctcagctggtccgccaatggccagaaacgagaatgcagtggctacaacctggggcgactccatgtcgaaggatcctcccaccgaagcggagatcggaacgtcgacgacatccgagcccgagaaggatcctaatgcggccaagccttgtattcccaataggaatcacaagccgacgaggattacttccgaggtgacaaggtcctgatgtcctatcacaaaaccaggaaacacaccctgcaagcctgctggatctttctcaacgtccatgctgaaattcgtgcctgcaaagagcgtggaattcagcgtacctctccaactcatgatgtctattgtcctattcacaagacaaagaatcacgacctctcgagctgcaaggtctttctcagcgccatgaagacgccacctcctaaggtccagcagtcacacatccccatcagggatgaagacaaggaacagggagcgacgccattttcagatcgatttgttggggtaatcgacatcgatccccacaaaccatcagtcttgcactttctcgaagactatggatcatcgacaacaagtatgccgcatgaggtattggctatcgacgatgtcggcacgtcagcagcaccaatacggaagcggagaatcaagtgactactccggcccagcacatcagagccgtcaacacaatactgagggaaaccccctacgatcctgttctgaacgacgatctcgcacgttggacagaacgactacgggaatcaatgaccaacctcaacaacgcgttcgaagagaccgctgctgcagcgcacccggaacagccaccaactggcgatgctaatggtgaagaccctgaacggcgggaatcgcctcatcgagccacccctccgcctcgcggcaccggcgatctccgcgatcacctgaatggccgccgagaggcacgacgcacacgagacaacgagaaccgttcccggcgtcatgtctcttcacggtgtcatgatgacgaagatcgaggaggccgttcaagcgaagaccgagaccatgataaccgccacaatcacgacgatcacgaatggcaggtgctgggcgatactggtcaaggacgtcgccataatgatgacgatgatggagacgacgacaggattctcgagaacccagccgacgtcctcgtaataatacgctggaaccaagcgacccatcgtcatcgtcatcatcctcgtcatcttcatcatcagatagacatccacgaagaacgtatgatcgccgacaacccaccgcccccagcgctgggtgtagagctttcggtcgttcacttcgggatgtccgatggcccgaaagattccaacttggagcaatagagaaatacgatgggagcaccgacccggaagagttccttcaggtttagtccacggtactctacgctgccggagctgacgacaacgcgttggcgaattacttgccaaccgcattgaaaggctctgcatgttcatggctgatgcatcttcccccctactcgatctcttcgtgggcagacttgtggcagcagttcgtagccaacttccaaggaacttacaagcgccacgcgatcgaagacgacctacatgcgttgacacagagcccgggcgaatccttaagggattatgttcggcgctttaacgagtgtagaaacacaatccccgagatcaacgatgcttctgtaattcgcgctttcaaatccggtgtcagagatcgctatactactcaggagttggcaacgaggcgcatcacgactactcggagattattcgaaattgtcgaccgatgcgctcatgcggataacgcactgagatgcaagaacgacaaaccgaaaaccggagaagagaagaaaccagccaaggacgcacctgagtcaagcaagaagaaaaatcggaagagtgggaaaaggaaagctcaatcagaagttctcgcaacagaatacgcggaccctcccaagcgcccagacccacaaggcagcgacacgaagaaagcatagtgccctatacacaagacggacagacattctctagaattgcctcgtcttcaaaaagttgctcgcaaaacacatggcatcgaaaaaaggcaagcgagtacgcgtggttgagaaggacgctgaggcgcctactcaggaatcggagtcagcatacccagattccgatctccatgtctcacacattttcggaggttccacggcatactcctcaaagcgagaatacaagaaagtggaacgtgaagtctgttcgacgtggcagggggccgcgcccaagatgaagtggtccgagcagaagatagaattctcagaagaggaccaccccaagactgctgtcatcctagggcgatatccgatcgtggtcgaacccactattcgtaatatcaaggttgcccgagtactgatcgacgacaggagctcaatcaaccttctcttcgccagcgccttggacgcgatggggattccacgaagcgagttgacacctaccgatcaacccttccatggaatcactcctcagtcatcatccaaaccattgggcaaaattacgttgcctgtgactttcgaccaagcaaacaacttccgaacggaacagatcacctttgatgtcgctgaattcgatacagcatacaatgcaatcattgggagaactgcactcgcgaagttcatggccgcatctcactatgcgtatcaagtgctcaagatgccaggaccgaagggaacaatcactattcaagggtacactaagctggcagtacaatgcgacaagcggagcctcgacttggtcgagcacacgcccagcccgcctgccacaacagagccaccaaagaaagtgagcaacacaaacacgacgccgaaaccagatggtgcaatcaagatcattccactctccagtgccaaccccgacaagaccgtcaagatcggggcatcactaggcgagaaataggaactcgcgctcatcaccttcctccacgacaatgctgacgtgttcgcttggcagccgtccgacatgccgggggtacccagggaggtgattgagcacaaactcatggtgcgacccgatgccaagccagtaaagcaaaaaccgcggagatttgcactagatcgaaaacaagccatacgagaagagctcgacaagcttctcaaagccggtttcatcagagaggtactccatccagagtggctagccaacccagttatggtacggaaggccaacgagaagtggagaatttgtgtcgatttcaccgacctcaacaaggcgtgccccaaggatcattttcctcttcctcgaatagaccaactggtggactcaactgtatggcaaaagaggatgaggagaagataacattcatcacgccgttcggggtattctgctacgttaagatgccgtttggactaataactgcaggaaacactttccagcgcacggtccaaggtgcacttagcgaccagctcggaaacaatgtcgaggcctacgtcgatgacattgttgtcaagaccaagacaagcaactcattgattgacgatctgcgagaaacgttcgactacctccgacgatatcgcctcatgctcaatccagagaagtgcacgttcggagtaccatcgggcaaactactcggcttcctcgtctctggcagaggaatagaagcaaatcctgagaagatcaaggcaatcgagaacatgaagtcacctacaagactcaaggaagtacagaagctaaccagatgcatcgctgcactaagcaggttcgtcgctaggatgggaaagcgagcacaacttttcttcgctctgctgcaaaagcaagacaaatttgtatggacataggaggccgaagaggcattcattgcactcaagctctacctatcaaatccacctgtatttgttgccccccaacctaatgaagaattatttatctatattgccgccacaccatattccgttcgcactgtcattgttgtcgagagagagaaggtgcaacgaccagtctactatgtcaacgaagctctccacgacgcaaagacaagatatccacaaatccaaaaactgctctacgcagtaatcatgacatcaagaaagctacgccactacttccaagcccacaaggtcacagttgtctcctccttccctctcggtgaagtcgtgagaaacaaagacgttgtcagccgcattgccaaatggatagtcgagctaagccaatttgatatccacttcgtgccacgaacagccatcaagtcccaggtacttgccgatttcgtagctgattggaccatacctgataataggtcagacaaccaaatcgacaacgaaacgtggacaatggcattcgacggtgcactcaacagccagggagcaggggcaggatttatcttgacatcaccttcgggagatcaattcaagcatgcaattcacctcaacttcagggcaaccaataacacagccgaataccaagcactactcgttgggataagagttgcagctgcactcggagtcaggcaactgatcgtgaaaggggattccgaactagttgcgaaccaggtgcataaagattacaagtgctctagccccgagttatccaagtatctcgcagaagtcaggaagctagaaaaaaggttcgatgggatcgaggtccgacatgtataccgcaaagacaacatcgaaccggatgatctagcacgacgtgcgtccagacgagaaccacttgaacctggcacctttctggacgtcctgacgaggccatcagtgaaagaggcaaccggcacagacagcccggtcgcccccaacatcggctcgggggctacagaggcagagcgagccgttgccgatattgagaccacagacaactggcgtaccccactcattaaattcataggcagcgaagagttgcccgaggatgacgtagaggccgagaaaatatcccgtaaagcaaaagtctactgtatgatcggcaacgatctatacaagaaggcaccaaacggggtactcctaaaatgcgtctcgtccgacgacggcagacacctcctcctcgacatacatgaagggatctgtaggtcacatgccgccggtcagacattagtcggaaaagcttttcgacaagggtttttctggccaaccggcctcaaagacgcctgcgacatggttcagcggtgtgaagcctgtcaattccacaataaacatacaaagctgccagtgcaagcactcctgactatccctcttacttggccgttctcgtgctgggggctagatatactcgggccattcccgcgaggatagggtggctacaggttcctatttgtggcgatcgacaaattcaccaagtggattgaagcgacacccacgggggaaatcaaatccgacaacgccatcaaattcatcaaagggatattctgcagattcggattgccccacggtatcataacagacaacggctccagttcatcagtgccgatttccaggattactgcatcaggctgggagtcaagatctgcttcgcctcggtttctcaccctcagagcaatggacaagtcgagagggcaaacggcatagtactacaaggaatcaagacccacgtctacgacaggctcatgtcacatgacaagaagtgggtcgaggaacttccatcaatactatgggccgtgcgtaccacaccgacaacgtccaacaaggaaacacccttcttcctcatttacggctcagaggccatgctccccaccgagctacgacatcaaagtacacgagtacagaagtattccgatgagtatcaggaggaacagcgatacgacgatgtgaatctactcgaagaacatcgcgaacgagttgccgttcgagcagccagctaccaacaagcccttcgacgttaccacgagaagcgcatccaagcacgcacgctttcgatcggcgactacgtcctccgacgggttcaaagccaagcagggcgcaacaagctctcacccaaatgggaaggaccgtacacgatcacacaagttctgcggccaggcgcattcaaaatcgcaagcggcgatggtcgcgagttggcaaattcctggaacattgatcaattacgtaaattctatgtataagtcaatagtatccatacttataagacatcttacagcctcaataaagcctatttttcaggaacagactacaatcaaagtgttcctttccgatgatcccttacccagatgacacttagcattgaaacctatcctcatgttcctttacgccgtcttgacaaggcctccgaggaacctaagggaacttcggctggggacgcctagagccgataaggccttgtcggatcctgtagagacgaaagaccatgtaagatctggtcgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctaggggctagggagagtgtacaactcaaacgactgatcgaagtcgcgaagtgagaagacactcatacacactacatccagagtaagaaagcatagttagatagatttcttttctattacacaaacatttcttacaattccatcaaaatccaaattacactttttcctaagacatttgtcacaggacacggagactaccaggaaggtcaacgctagtccatcgactggaaaaccttctccgccagcggcgccatcgacttcgccaagccatctatctccgtaggagttctccgagaacgtgaaaacccttcgcggaggaactcaaggagcagctgcggacaatgatctcgtacgcaggccgacacgagccccccggcatatcagcttgagcgacgacactcctgcttcaaggcctcgtcgacacgttgaccgatgccttcgagctgggcgcaggccccattcagccacgagatgtatccggccaccgattcctcgggatccccatggggtactcggagctttctacagactctcgacatggatgtgcagcaactcttcagatacgagttgaaccacacctcatgaccccggagtgtctctatggcctggtcctttctcacctctagcatagtcctctcgagttccgcaacctcaaacttcgtcctccaatactggatgcgacgatcctggtcagcaagcgcactctcgagatctgctcagcatggaaacgactaagtcaagctgctcttctctcctaagaacacaacaaattaagtcgatccagacggaagggcaaaggagatggtaacaaagacaaccaacctaagggagtcgctgccatgctcgtttccactggcaaacttcgatctacatcgctttccggcacatgctgctcggacgcaagtaacggaacgaccactggcaactcaggctgcccgcgctgctggacatcatcgacattaacatctctacaaaggacaacaaagtactcgagatcaaaatgctaaagaaggttaaggcaatgatcgcacacaaagcatgactaaagagtacaagagagctaagaccctactcttcgaaaagcgggaggacggactcccccaaatcgccgacctattccatcacatccttgcgcgcgtcgctagtcgccccctgatccaagatcttccgcagatcgagttcagggtgcgccagcctcacacacgcaaggacttggcacgccccggtgtagatcccgttagacgtctcctctccgatcctggccgcatgcttggaggggatctcctccatcgccgtcaccagctccgcaagagaagacgtcagcgagaactcatcgggattcgccggaatggtggacttggtaccgcactccccggcgagctgatgcagaccagtataggtgacccgcaacgagccacggatttccgacaacttgttctcaagctccgacatacggtgctcgagcccctgccgttgtcgcttgttgctggccaccagttccctcatcttctagaggtcctcgcgaacctccgccagatcacgcgccagccgatcggcgcgctcgttcgccgacgacccagccgccaccctcgcctccgcaatctcgcggctaacacctcgagcaccagcttcgaggaggcaccccatctcaacctggagctcctcccaggtgaggacggtagccggcgaaccacgaccagccacgtgatcgctggccagaccgctaggtctcgcctcacggctcctgggcacggccacgacatccgtcgaggccacggcagaagacgcgctagaggtccctccagacctatcttgcgccgccttcgcccgcgccgccctgcaaaaggctacgattgagacagagttcgacaaaatcatgaaacgtcaaatccattcacttacttctcgctgagcgtcataagccgctgccgtcgcggaggcgggggagacgcgtccgaggcctgtagtacaatcgatatgatgtgaggtggaagttttccgactacgtgatcaaataacaggagaacttaccaaggtggtgggtgtcttctgatgatgtccaactacagaggagaatttcctcccctttttcggaacgtcgccgctactcgtcgtggcagcggcagcagcagtgtcagacacccccttggcgaccttctccttcagtgatgccgccacctgatggtccacgagcggcccgatgatatcagtcaaagggagagcctacgcttcataaagtcataatgcgatcccggaagaaaaatgcaaaaggaccgctaagtacacttacattgatggcagcgtcgctcggctacccctttctcgcaaaagggggacggggacgttgctcgccgttgttgggccgctaatcatccgttagccaacacagcgctccacggttgcgctatccaagcctgtagatcgagaccagaattcgataagccgggaagaacacgcacataagggagtcaatttaactaaaaaggaaataccccgaggagaaacccgggtcgcgtcctctggcctagaataatcaaaggcaggatgggctcgagcctgaagcggctggatccgcctaccaatgaagtcggcagcaacttcataccccgacaacccccgttctcggaggtcatcaacgatatcgatgaaagattggagggacggggtcaaggcaggtttagtggtccaagatggaatcttgtctggctgctcctcaggaacaacgaagacaggatccaaatcctctatctgaagatagaaccacctcccccgccatttgctgcgagatgaggggcactgaaaggggatgtatcgcgacttcagaccatcccgaagtcggaaaccaacacactcggacacctttttggattccatccagcgtaactcatagtaaaagcggaagaggtcaagaaacggctccaccccaatgtaggcctcacaaagatgcgtaaaaatactcaggaaggcgatggagttggggttcaaatggagcaaggaaagaccatagaaattcaagaccaaaaggagaaattcagaaggcggtggaagaaaaccgcagagaataaagtcctcaaccgcaaccatgcgacccaggacaggctggggttcagtacctcctacttccctctccgcggtcccgcgaccgggaagggcgccatcctcctgtagttttttcattgacgcactggtggaggtagacttgtcgagatccatggccaccggagatcgccggagaaaggaccgagatgagttggctagggtttttgcgagagcgaagaagacgaaggacgcttggaagctggagagtttttttaacaggcggacctcaaattagatccccaaaactcccttaaatagacgcacctccgccggtgcgaattccaaggaaaggagagatgaccgccggaaatttctaggtccgttacgcgcggcagtttttcggacttcaatttaaattcactcatgaccgttgaacttcacccgatgttgtcgatcactccttgtctctcggtcctcacaccgagaacgacgacaacttcgacatcagaagttgcgatcggtttcgcgagttcatttaagcagaagtcaggggctactgtcagggttacgggtaaggtataccctctacccttggatatacgtcacgtatcggtatggtatgctcacgcgtatacggacgttttcggcatacattaaggaaatacatcatggagttcacagatggaaggagtcctactcggtcagaactgggtcgtcattgtgtcgtgttcggtctggcctctccaagtcctacttggagacagttgacctgcggtataaaagggaccccctgggaggacctaaggcatcgaatctcagagccaacacacccaccacagcttacgaagccggagcttgtgagagccaagtcgcggggagatctagtcggatcaactcgactacgatctcgttggtatcgtcgagttctactattccctttgtaatctgtggtttccatcatataatcccatatcaactggattaggactattacctaccaaggggcctgaactagtataatccctgtttcctatttgcttgatgtcgtactacgtagatcctcgtaccagcgtaccccaataccctctatttccggtctacgggtatcccccgtcgacagcgattataaaacacatgttgttatgaggccatagcccaattttatttttaatagcttaggtataagattcagaattaactaatcaaggatttatctcctggatttttcacaatttggtccttttgaaaaacttttttcacaaatagattcctagaaaaacttttcgtggaaatagtcatttttggggcgtcagagtggctggcgccatcgtccaatgcctgccaacgtggtggccaggtactgacgtggcagggggagcgcgccagcctctctggcaccccccccccccgcgaatacataataccaaaaagtgtctcacaaaaactaatacgggtaatatccgtatatttatccgggtaatatccgaattttaccggataatccatatccgtcggatactacttcccgaacccaataccataaccaccataaaatactcgtattcggacccaatatccgtgaaaagtcccgggtacccgaatttatcctaaaatacccaatgtggctgggcgggcgggcgggaaatacctgccccatattcacccctactcctaagtgtgaaaaaatatgaaaaaataaaagaaaaataaaaaagttgcacatctctcctctgcactagagaggagaggaaaaaaaatggcgtgggttggacaggggtggcatcagccttattggcgtgctcccccgccacgtcagcaccaacccgccacggtggcaggaggacggcaccagcgactctagcgtccataaatgactatttctatgataagttttttaggtctatttgtgaaataagttttttaaaaggaccaaattgtgaaaattccagtaattatctctcggtggagatactaaatcttgctccgtgatgtacggagtttgttgagcaaaactctgctttgattgagcataaatcacagcttgaagatgcaaaagcagtagcacgttatgtacttttaatctgatgcgctatcacagcacaagactgaggtttttttttctcatattcatttatattgcccctcggtgtatagcagatcttccagtgatcattgttctaaaacatttgctttatacagtggcttcacgatcatccccagttcttgttgagtccgctgtatattggaggtgactcatatagtggtatcattgtacctacacttgcgctagcgatcgatgaaagtaagcttcttgccttgtgaatggataatttccttagacatcctcgtactgttacacaacattaaatttgatcaacaagcagtttcggaatatatttcggtaaataataccatctctcatatgggaaatggttgtcaccatgtatcaattactatcacaataattactagaaagatttttcttttcctactaactaaatactatcacaacaatattaggacagagatatatatatatatatatatattttttattcatgagttaaagacaaatttggtgttcactttctgcgcggattaattgtgcgtgtttccaactactaactactaactactgattatgcatcttatttttcaggcaatgattcaggagataagccaattttgaatctcatggtctgatcgatcttatcagataaatatcaatcatgaaattttatatttggaatcttaattacgtcaatagtctacataaattgcttgttaatgtgtactaccaatctgccctgtaattaacttttgccttcaaccattttatttaccttgtctttataacgcaggggtatgttgctggcaatccagtgaccgatagccaatttgatgaagatggtaaaattccatgtctccatggcatgggacttatatccaatgaactttatgaggtaatccataatccagtaattaataactttatatgtttcctatagtacattcagcaaatatttgtaggtattaattccaaaaaaaaagacaccggcctgtttcattatgaataacagatcacggcagtatatatctgaccaactaggcaatattctaattcttttcagctgaaaggatgaataggatgatggagtatctgatttttttttataatacccgagagcacgaactaataaattgacaattaactatattacaaagttgaaaagttgcttttaaaaacatattctaccaaccgtgtatatataatttgttttataaaatcataacgtttagcttgcgaagtgtgctgcccaaaatatttattcatacatgacattcgaacagggcaaaaggtactattgcctacgtgcaaaatctattgtaatatttcttacatattatatactgaccactcaaaccaattttctaccagcatgctaaagaaacctgcagagggaaatacagtgccccagggaatgctcggtgtgagcagtctatccaagctatacgcaatgtaagtattccaagaaaaactatactccctccgtcccaaaatgtataatggcgttgattttttatatgacgttgaacgacgctgttgactttttatataacattgaaccattcatcttattcaaaaatttagattaaatatgcaaaattataagacaacattataatttctttgatgataagacaagttaaaacaaaattaatattatttatatattttttcataaaatgaatggtcaaatattgtgctaaaagtcaatggaatcatatattttgggacataggtagtatcagtactagctactgtttgtgtgtatacaattgtcaataatgtaattgaaattgctgtgtatagttctctgttatgtggcctaattacatattttacaaattaatcagtgcacaaaggacatcaacatgctacatgttcttgagccattatgtgaagaagtctggagccccaggatccataacacatcagcgacagatggaatgagtaggctcatgctggagtctgctcgtgctgctgatgatgacattattgaattcaagtgtagagttgagtgcatgaaaaatacaacattaattactacatcccattgaattccaatttatctgctctagttttccttggatagcacttgacctaagaaagtctaatttggcttatttactgcagaaagcttcctatgtggttttaaaaatatgggcaaatgataaaactgtaagggagagtcttggtgtgcacaaggtatttctactatggtactatgtatgcttccattgacttttcaaagtatatgcactttgctactggtggatggaaatccaaagtttgcaaagtgaatatataaattcactttgcagttggtcttccgcatgaaattaggccgattatcatattacaaattcagcattgtccttacagaaggctaatcattctttgaatccttttatatcagaataattctttgaaccgaaactcagcctatccgctgtgaaggccaagggaaaggattaatttgcattgcatgatagttatgcatatatacgagtttaattcatagaagttgctatacaatacagggaacagttggaaagtggacaagatgcaattacgatatagattacattaaagatgtgtatagtacagtggagtatcatttgacgctaatgagagaaggataccgatcattgatatacaggtaattatatatcgaacaaataattgatcaatatgtacacttatgtcctctgataccgaactgttgcgtttctcttattcacaaaatatacatgcagttatatattcttacatggaactcaactactatacatattggaaactaaaattcttttataagattatggaatcctcggctacatcatgccatcttccgatcctttatatattaaatttgattgcaaccttgcggttcaaatccaccaaattgctcttctcgtcgatagcaaattaaacaggctaacccatggattattttttttcatttaattaattaatgatgcagcggtgatcacgattgtggaattcctttcactagtacacaagcatggattagatttctcaacctttctgtagttgatgattggcgaccatggtatgttgctggacaagttgccgggtaagaagtaaatatttccgttgacagtcaatttcaagagtgattataatttcgggggatatattgcactttctagtgtgagctactgcactttgtagcacgagatatgtttagtgtaaatattggtatatttcagtgccttcgtaaaaatgatgtaaaggaatcccaaattaacttcaaaaattacggtacccccattaccattccaagcaagagtatcatgcattaattttttttttagaattatacagtacaactcagacactcacaacgcacgcaaaccctacccctataagtatcttcgaagactgggccagtaaaattggagaaattgacgaagtcaccataggcgtttcgctatcgctgggtacgtcgcctcccactgggagcgaacccaggacctcaggtgctactgaggttcttgtaaccactaggctacagacccttttgcatatcatgcattaatttttaatacaatagaacacaatgtcaaatattatacgcttttggttagccgttaagcaaataccgttgtttctacagttaacctaccatgaggtgcaaatatattagcacaagaaataattgtactccatcacattataaatttgaacaaacttgatgaagaatttgactcccaaaatgacttacaaagggagtagtatctttcactggctttttaacaatagtaaaaattaataaatgtgaagattatcatacttataactaataaattctgacatatcatgaaggccagttggggaagtggctgatgagtggaatatgtatttacagttattttttaatacaatagaatttattctgttcattatttccatgaagctatacaaccagtattatagagttcaaatatgatgaataattgcgaattagaaaattatggtttgactaaaaacaagaaaactactaccaatattacctcaaaagacgaagttgtt

SEQ ID NO: 62196 - DNA, 5811 bp, Oryza sativa
  unsure (1)..(5811): unsure at all n locations
aggactactgcatatttcagtcatgttagcatgggtcgttacgttgtcctttgttctgtttgaaatatccaatattattccatataggctcaaaacattattcgtatcgttcatcatatatatgttaatacatgattacaaaattatggaaatatgataatcctaaacatgcattgagtcaaatgaaaaaaaaaaacaaagccattggataactcctgtacttatcacaaccatcaatgtattagggcatcctcaatgtggtatgaaaatagtccacaggcaatataatattttattcagccagctagcaatatcatgtaatagtccatagtagaaagaaaatagcaaaaactacccattgcactatgggtaggcaagagcacaaaaaaaaaccatagttgggcagtgtcactattcataaataataaacaaaagtttcagtaacagttgcacaggtagccactggctttctggccatttcgcctaaaaaaactttcgcctacaaaaactgcaccaaaatacaccagctccattcatcaaatttgctagaacacaattagttccaatgaatccctcccacagaaacatctcaagtttcacaaattaagactccccaaaccaatactctaagagtagtgaccatatctcacctcatacaccacaatctcagtttatctttacatcaccaaattatccacaaaactttaacccttttggttctccaataaaccagccacctttggccactctcctccaggattttttttgaagagaacacagcaggggaggcccctgctgtttgaataattttattaaagaaaacaagaacaaaattacaacagattaatccaacttatgattacatcgtgatatctcgcagtaattctaaacaacaaaaggaagaggtcaccctttaagagttgcctccaagtgatgaaagaggggatcttttgctcgaagatgaacccattcctttgtttccatatatgccaagcagcataaaggaatttctccttgaacagctcccctgataatccaatttggcccttataaacattgcttccaaagggagagtagtatcccatgtaatgcctaaaagactccaacaattttgggcaaatgggcataaaaagaacagatgcattaggtcttcaacagccgccgattgacaaagaacacaagaaagatcacaatccggaggagcacaattcttataatttagcatgaacttggtgttcaatctattcatcatgagtngnncctgatgaacatttacttttgaaaccgctttgcacttccataaccatagaaagtggactggttcctccaggatttcaaggcgttcaataccaagggagctggttgtaacatactccatcaagctttcaaggttttcacctacaagagagttttggtcccttaccaacgatgcaatttggagatattgccaacaggccaccatctttgctgcaatttagctattcgtctggtgcttggtgctgcagccaacacctcttcccatggatctgagtctacttctccatgccttgcaagagaaaacgagaaacaacatgtaaccattgatgagtcaagcagtagcaatgacgaagaaccaaggcggcatacacacataaattggattgaagaagagaacatacgacttcttagctgttggttacaccgctcaactgatcctgtaaaaggcatcgacatgaaatcagaatattactaaaaagctgtggctgatgagttcaacaccaatgcgccaacaaatggacaaagaggtctgtcaagcaacaaaagacgcattggggtgatgtgaagagaaagatcacaaagttctatggagtacatggtagagttaaagctacctggagcagtgacatagccgtgaactcagcccatgtgatattcgaaaaagaaaacaaggacaaacctttcacattggagtatatgtggagggaggtcaaggaactgcctaaatggtgtagaatagtccaagagaagagtggaaataagaggagttgggggcgacagagagggctggtgcaatggcagcgtggggagggacgagaattgggcccaaaggaaatgagaattggggagaattgaggggctgctgatttttttaccactgtgggaccctccttaattactaacaatgtggtggtttcaacttctatagactagtatgccaaatacattgacgatgcccttatgtgtagttatcattctttatgaattacaacaaaagcacaaaatattatgtgcacttatcgttctctttgtccagataatatcatataaaaccattatctttttaatccagatttgtaaggtagaatcggagcaacagggacatgtttattgacttatagatattagtatagatattagctttttaatctctgaggtctccatttttactgactcgttttaataaaaaatgatgctccagtgctttctactggtaatataatagtactagtagaaatgttctaaatcgttcgttatatattaaaggtaaattagtaatttaattactaatgcagtgattaagggcaactttgtcatttatgttttttcttgggctagatcgatacatggttatccattgtactagcatcgctcatattccattagaaaagtcaaaaagtaggaaaaaaatgtgtagtcagtgctaaacgatgattatacctcttcgcacctttttttttcagagaataagctcctccacgtttctactataccgctaactagaataatactataaatatattttaacccttcgatcaaatgagatcaaatgttcaaattgctttctactaccagcaagagagtaccgtagtcgggctcttaattatattactcatgtatgctctaatctaatgtttctagcaacaggccggcactaacatcattcgattgatttcttttttgttttgaggttgctacgtgcgcatatgcccccgcacactcactgtgttgccaaccagcacgcgagctagcttactcgtgctcggcgtgtgcctccactttgatcagcaccatttgattgatttctctcattttctaataatttttaccaacctcatacgtttaaattttattccgaaatagtaatatttttattactctctcattgctttcggccttttaattgaaccagatcgttacttgagagcaaatgttccaatttattatggccggacagccggttcggtccgaccagttccgaataactgtgctatataagttggtgattattgccaaccgccttaattaaacttcatcttgcactcggctgattcctgtcagtctgtacaaaatggttactctcatccaaattcatcgatccacgcatactcataccggcagcgatcaatcatataacacagcaattgtataaatcaaaatgccttgcacttttgggagataattttcattgtaggccaccgagtgagctcatgcagtgctggctacgctcatctgaatgaggaagtaagtctatatttactcaaccatgagtctaattttcctcaaccgtaaaaccagatataacatacccttaaatattaaaaccagattaatttactgatccctaagcggttttgacggtagttttatctctcttctaggttgcccaaggaggaggaaggaggtcagcaggggtaagcagggagctcctatcgagcttgagcttgcagcggtagtggtagtctgtgaggccgttaagcttaagttcacgcgacgatgactgtagaaaagcttgagctcatttgacggagaaggagctcaacctatagaatccatgtgtcgtcgtggtgccacatatatagcaaagagtggagagagtattgacacgatagtagaaggcgaggaagccatcgatggccaagattgtcacctgaccgacaagggtaggttaatctagcagattgagatggcagcgacggcctccgagggctccgggaaaactaggacaatgaacatggtggcttcaattgctccgggaaggctaggatggtggaggtggaggtgaactatgatgatggcagctatgcaacatgcggcagaggtcaaccccgcggccagatccgaccaaaccccaccccgatcaaaaccagcaccggcaagaaggatctcaagctctgtggcagtctcaacgagctcaatccctacacgtccagctagcatgcccagcttgtcagtgttcaccacactagggaggaactcggcggccgtcatgccggagtgctagagctcaatagagttgttcccaataactccttcgttcctagtccaatttgatggatcgccgcctatgccaattgcgggtttgatcatcggcctctagcaacttcatggttgtcactctcctccagctcaagctctccacctccatctcaaagtggttgtgctgagtagctcgagagaagagatggagaaagagagagcgtggaggggtcgacgaggtatagtcaatgacatatgagtaccaccatttttaaaagttctgccctaacaaatttctagccacaaatatttatctcttattggcaccaatctaaaacaacgtatcagctgtaccttactaaaatttatgtttgtcattaccaatattaggttagcataagattaaaaccctactctactaatatgacagctagaacaatacttgttgggatcacctgggagtcactggctcactgctaaccacgtacaatctattgcattgtaaagaacaatcaaataatcaactacatatgttaggactatcttatatctttagctctattgggcttgttaggttactttgtcccatgcatgttatacttacaagatcccccacggatccaaacatagacccatccctggccgatatgattttaggtccccgcccaagtgcacatatatgcccccctccccccaggggcatatcctcatcccatatgggaaaatttccatctgtagcaaccacataaatattgaggggactatatatgaaaccaacaaataaatttataggagttaaaatgatcatgcattgacacttcacttccttaaaaacttagggatggatgattggtgagataggtgttccttataattataggggagaggctatgtgatatatgtgggaaaaggaaaaaatagtaaataaattcatgggcatggttttattcgcaaacgattgaaatactatatgctttagaaaaagagacgggtggagcgcgtgaaaacaaacatatcatgccaaagcgaaccctctggaaggacaagatcacaacgcatagaagagaaaatactatatgctttagaaaaagagacgggtggagcgcgtgaaaacaaacatatcatgccaaagcgaaccctctggaaggacaagatcacaacgcatagaagagctataaaagatgaccccacaattagcactaggagcatcgatgaattgagaaacttctctagctttgtcacccaagcgctcaatttttttacttacccctcatctcttttgtttatacttagctttctgtgtttcccatggatctccttcttcgttgatggatatactattgtggttgatactagtgttattattgcttatagatacaattgattaatgccatacataaaaaagacaaggtaattctattttctccttatcagtttttcaactcaaattcttgtttattgcaaccaaaagttattatgtattagtttactaaatcaaatgttttctcttttgataagatgcgggtgaagatcaggtcgaagacgcaggaattttacaggaatttcaaatgcgac

SEQ ID NO: 62197 - DNA, 546 bp, Oryza sativa
  unsure (1)..(546): unsure at all n locations
tacaaatattgagtaaaatacatatatgtaaaattaggaattgtagaatcaaattcatatggaaaataaactaaaatcgggataaatagaaaaatacactgttcattatggcgtaggtgttcgatgtggtccctagccttccccctcctctcccacctctgtcctagcacgccccgagccnccgtcccgcgcgccgtcatcacgtcgccaccgtcaccgcgcgtagccacctcgcgccgttcgcccgccgcgccgccgtcgccatcgtcgccgtcggcctcgcgccccgtgccgccgcctcgagccccgcgccgccgcctcgcgctccgcgccgccgctgccacgctgtcgccgcgccacgcgcccgtcccgtcgccgcgccatcatcctgtcaccgtcgcatcgccgtcccgcgccgngcccgccgccatcgccatcgccgccttgcgccccgcgctcgcacgtcgcgtcgccgcgtcgagccccgcgccacctgtcacaccgncgttccgagccccacgccgctatcgtgtcgccgcccgcgcg

SEQ ID NO: 62198 - DNA, 2058 bp, Oryza sativa
cttcctgatcttgctggtacatgcattcgatctggtcttccccggaggcggcggcggcggcggaggaggagaggacgatgtcgtgaagccggcgtcgctggagctgagcaaggtcgcgttcaccgggttcctgaccgtggcgatatctgccaggacgaccagccgtggcccgctcagcacgtccacccagtggttcctcatctttgcagcgtcggccattgtttcgggcttcgcttggaggctcctgacgcaggccaaagttgggaaaagtgccaatgtagcttccttctgcacgcatttgtgcatcgtgcttgcaacggtgccatttacagttatggccggacaagctctgcactgattatttgtttgtactacagggtaatttggagggttattttgacaggcaaaaattaataaccctttagttgggtttggatgtttggtccagaaaacttttctcttcagtgacaggagtaggactatactataccgtttaaagtgttcagactcaatacgacataattttacctactcagttattttataaaaaaaaaattaaaaaaagacctctttttttacctgaagactactttggattgaagtactgaaatacatttttttagcaaaaaaataaaaaatcttgacatgggatgatcaggttactattcatgttttgcccttttgttatttcttcctctccttaggcctggtttagtttcaacgatacatctaatctttggacacatgcatggagcagtaaatatagataaaaataaaactaattacacaatttgcatggaaatcacgagacgaatcttttgagcctaattactccatgattagccataagtgctacagtaacccacatgtgctaatgacggcttaattaggctaaaaagatttgtctcgcggttttcaggcgagttatgaaattaatttgttcattcgtacccgaaaaccccttccgacatctggtccaacatccgatgtaaaacccaaaaattttcttttcacaaactaaacaaggacttggtacaagccatatcttgtgcattaaaacaactggagaaagattccatgtaatcaactcgcacttcaatttccctgaaaatactactctacaagtcacttgttcaatattccacctcataagccattttattacaaatatttagccctactcaattttgttgtaaaaaccactctagtatacacatgtttagctgaatcaacatgttttcataaattgtgagctatcaatgtgattcattaccatagttaaatacttctaagagtagtatcaatgctttttggagattccataaatataattgttgacgacaggttaaacattatcacactaagtctcgctatatgcaaaaaaaaaaatcaatggaacttgaagaataagtttaatgcaagcacttgaataagattgactcgactagtttaacaacaacagaaaaacgagttgatttcgttaagcctgtggttaagcagtcgaggagctagaggctagagaacgcgaccggagctcacgcagttttagtagacggagtcctcacggagatgaccgatgcaggcggtggggctagacggtgttggagctaagaggacggctagcaacgcgaccgctctgggcagtgggagggggcagtagtgggcttccgccttctgtttggtttcttttttgagtaaatcccttgtgtacacatgaaaactcacctaatcccttctataccctcgaattttacacgatcctctctgtacccctgaaattttgctttgatcccttccatgcccctcccgttaggtttccttcattttcacgttatgtgtggttccaaatgtctaaaacacccttgtagatggaagagtgccagctagagtggcatcaggagggagatggccggcaaagcccgcgcggcaagaggagcggcgaccggtggcccgcacggtgggaggggcggtggccggcgacgcccgcgcgacgggaggggcggtggccggcggcccttgctgtgggggcgcggtggccggcgacacccacccggcggg

SEQ ID NO: 62199 - DNA, 1187 bp, Oryza sativa
aagtttagggaccggtgatgaactttactctttttctatttcgaatagtgacccaactgtagcacacagcaccttgcatgtttgcctctggaagcgtgacgcctgaccggccaaactaccagccacaggtccattattactactttgtacgcctttgtttgtcttgacaataatccaaaaatgcatgcttgcaatcatcctttcgcttatctacatgcttttttaaatcgctcattactatatatatcagtaaagaatgtggtcaaaagcaaatactataaaacatttgtacagatccttctatctataacggcctctaacatacctagaaatagcgggccattacagggaagtcatctcaatcaagccgaaaaagtgcccgattgagatatggtcgcacagacatattagatgggcatgaaacttaagcccgtcacggatgacacctatcagtgacgggccgtagtttaggcccgattgagatacattccatatctcaaacgggcttgaagttggggcccgtcacagatgaccatcatccgtgacgggcaccaactttaggcccgactgagataacattccatatctcaaacgggtcttgagttggggcctgtcacagatgacaatcatctgtgacgtgcaccaacttgaggcccatcacagatgactcatcagtgacgggctatatactaatccccggttgacatgacttaatctctatcgggcattaattaaagcccgtcaccaatgagtatttttccattttttatatgaaatgtttatatttgtaagttgaactatagcaaaataattaacttggagtataataatgtattttatgagtcaaaataattttacgggtagtaaatgatatcaaatggaaaagtcatcaacaacaaagttgtataactcatcaagatctataacttctattttggtcatttttctatataacattttttgaatagtttgacttttgaacttgaaaatatgacaacttcaaacaacaatttcaaatactaaatgatttcaactgaaaaaattatcaacaacaaacttaaataactcatccagatctataacttttattttggtcatttttctatataacatttttttgaaccgtttgaattttgaatttaaaaataagataacttcaaacaacattttcaaatgctaaatgattt

SEQ ID NO: 62200 - DNA, 3472 bp, Oryza sativa
ctgaaatttgagctgtaaagttcaaaaatgcagttagcagacgaattgaacccgtcaccaagagaatgaatttattccagtcaagatgttctgtttcttttttccaacttcctatggcaaataagaacagcttcagttgttaataaaaattactattcttttcataaaaaaatggggtttggttgccaatccattagtcaaataaattagaagagctcacgagttcgtggatccgagtgcttatgacattaaaatcatgccttctcaggtccattttgttaaattgtttagagacctccaaaaatgtagtattgcaaatcaacttgcagtagacaaatggtgacatacatatcttcaaaaaattgagttatataggggaaatacctctaggtggggtggggtggtggagaggagacaccaggttcaacagttcaaatcatattgtccacaataggcctaattaaaaaatcacttcatttgtcaaataaaagggaaatgatggaaaatttatgattattacggagtagattgagtagatatgattagagtgatattacaaccatatacgaataaaattgcgtttttcagaataaaacctttctgagataacttgcagtagtggagacagtggacatgctgaaaaatgttcctttcatgtcctgccgaaaaagcctaaaaaccgtgccaaccttgggtttgttagagggggccacaaacgaaaaagcaagaggttgcatatataggagcaacctaacacaatctacaaatgccaaaatcttcaaactaaacctaattacgatccaaattaggttttggccggtcattatagctagccgaggttaggaagatgcatacctaaaacaagtgtctgatagggaagaaccaacctaacatacaatataccactagttgcaggtttcatgcaaaattattacaaatcaagtagagaccccaatccctcccaaaaacttaggagacaagccatttctgctgttaaattcagaaagataccttcagatattcagatgtagaagaaaagaaaaaaaatgtagaccaagttatgtaggatacttgcaaagatggttaatgtggggttcatgttacaatggctttgagagtgagagctcatggtagtgagcaatttggaggcgccggcatagtgtcactgtgctttataaatcaattgccatggtgatcaggcaggacatctaatcagattagacgtgacgtccatatggtaggaaagggagaggaggaagtttaattattgggcgacaagaggatgtctttgagcttaattagtataattaaggtatacttcataagagatgcatcgtcaatacgatcactggatgtgttattgtccctagtgcagcagctgtaatcctcttgaagccgcaaccctagattataatgcatcttgttgatcagttagcaacaggttgtgattactaaactaattgtaatttgaaaggtttcaaaggctccaaaaaggcatcttttaatgggggagaggaatttgaaggatctattttgttctggcattaagcaacgagtagtagtttagtggttgcacgagttagctggatcaactgtgcaagtgtgcatagattaatcagatcgatctggcacttttgcagttttgctccatgcatgctgattcattcacatgtcacatgtagatacaaatgaatagtactctatagcagatacaaaatgaatagttagtctattgcagatgcagctggtgcttcaagaaagaatctaaagataggagaagaacagaattaactactagtaatgctattgctttgcttatggcttacctaattctcattactggttcagaaactgtgggaaaggccaacagaaatgcctctgcatctgctccaccatgcttatacttatcttcctgcagtggcatgtacttctgttagtattaactattaccgattactaaccactgcattcagaatggtctcaagcttatactaattagtattcagtataacaggtcagttctaacagttactgcagcttataatatacggagtacatggacaagatgatggacgaggatgcctttttgtacttggaccatgccaaatgacttgtcaagataatgccagcaaatcagagtacaacaatgatatgctacaaaaatgcaagaaatatgggttaacacaactgagaagacacaatcgctgttgctgtcaggatcataactcactgacgaagggtagtacaaagttgccgttccagtacaaatatgatcaacgactcaaaaagagatggatgcaaactataatataatgttcaggcacttgatatatattaaaacctaatcatgataaggactagcttacagacacaagcaactaaacctacaatttagaagtataaatcacctggaggtaagatcataacttctgactaatacttacgatgtgctgacaccacctcagctccttaaagtcattcatgtaaactagtcgtccaagttccaattttcaacttctgtaaaaattagttccaggtaagagcacaagtcatgttaaacagttaaaacatagctccaaattccaaaaatatgaaagcagcagtcacgctgaatgtaccactacaatttgtagtatgattagaaacattcaaggacatgtacgtctcttgtctaacagaaaattcgaacaagtcgcatacgtacgacgcagatatataaaccaaacctactccaaaaattttggacaaataaattctgacagcaacagatacaccatcaccagctactctgatgcatgtatatgtactcatagcagtataggcttatatcatggctagaccgaaaagataacaatctttaacttcttaacatcgcattaggacaaatgactgaagcttaattagcatgcgatgcatgtactagtgcccattaaatcggttgaggagaaacgccatcagcaacacctacttcatggaagaaagaagctaaactcacttttctctgcatcaccggggttaactgtgttctgcatgtcacctgatgtggatgcatgcacatctgacggtgaggcgacgccgcagagcagcgaacaccggcaccgccaatgctgtcacgtcccctgtaaaataatgaagcggatggatgcatcaggggaagacgtgacgaccatgattagacgagtaagagcccctttgttaatagcagttgctgcagttgagttgatcttaattgcgtgtttcagctgcaacacaagagatgcacactgtcagccacaaaatggtgctggatcaaaatgagctggattaaggagaggaattacgacaagaaactcaagaaaaagtttttgtctgataaagaacggagatgcatgatcatgcttaggtttatttcattatccaagaaaaagttcaggcttaggttgtctagatttatggagaagcacgaacaagaagatgcttggcagaaggaata

SEQ ID NO: 62201 - DNA, 10280 bp, Oryza sativa
aatgttatatttcacatctttggcgattataatgatcttggaatatattttgtgcatagagtttacatctgctcagatttagaacttcctgtacatgtggataaaacatgcaagctagagaaaaatgttcttgctaaccaaattgtctcgagtttgccttgtttgattggaagaaacaggttgttgtaaatggactacgcaaagagcaccatatggaaaaaccgaggacggttttccatgatgaaggggaggatgatgtgaccatggctaccacggatgcaaccattgctcacatcatggatgaacaagaagatatcgagatcaagtactccaagtgctggaatccgattcggccacctattacactgctgacttcaaacggccaccgaatctacatacgacctccgttttcggcccgtgagtacttgatggaaagctctcggagccctctttctaacagatccagcctcttctctgaattccatctcgtgtggccggaatcacaagaacaaggtgctgcgtcacctataatgggcctatgggcttgtaacttcatttgggaccccggcccaggtggggcccatgtggggtgcgccccaagctggtggagcatgaccctaggcacccctaggttgtcctcccacccctatatatagctagttaccccttcagggtttctggggttttgatagattaaagtttagccattgctacttgcttgcagtgcgcgtgtctgctagactgtccgtctgcttgttcttcggaaccccaacttatcatttgtattaaattcctatttgtaatatcatattgcttttatcttgttcttgcttgtttcttcgatttgcttgcaagaatagggttgatctgcaccggcaagatcaacaacccacggagaggtgtatcgatcgctaaggcgcaacacaacgtctcgtacggttgtagttggatcgtcaacgtttctcccaaatcatagttatcacaactcaccgaaagatcgggccaataacagccttgagtgttgagaggaactcagggttcatcaggtggtatcagagctttcgttgctcggtgagttttcatttacttataaccagaaaatagcccgaaaaaaaaaattcatacattacgtagccacatttgtgccattgcattgttcttttcagtttttgctttgttgaattttgtgttgcatcgtcacgtcgtgttgctggtcatagcgtttagttcgtttagagtttcgagttctggtcacgttttgtaccactgtcatcgtcgtcgtcgtgtgctttgttgtcgtcgggacctacgaaaacggaatcgtctttccgccaaggtttcatttttctagttttcagaagtttctatcggtcggttttgttgttgctgagttgcatctagttttttgtggtgtgattctgcgctgtcccgaggccgtgttgctgccgtgtgttccttttgccgtgcatgtgtgtgcgaggaagaaggaaggaggagagatctgtctagattagattggattggtttctgtttggtggccaacgtagaaaagaaaaaggaagggagggatttgtctctgttttcacatggagcctttccatagatcgggaatcaatctccacccgtgaccgagatctccagccacagtttcctctcggcattggtgagtccgactccctccatcccctctcctcacggtatagatagcttggtgaaaaattttcgtgtatcggattggagatccgtctgcaaaaacggaacctacgggacgagagcattacatttttatatagttttaattttgagtttggacatttacagttgagtccttgtattttttttatatttacatttgagtccctgtaaacttgctttatagtccttgaggttgtttttgttagaaaaatccaaaaaaaaaaggcagaaaggtgcataaaaaaagaaaagaaaagccgcaccaaaaaaaggaaaagagaaaaatcagttgtatctttgaattttctttcatatatcagagttgtgcataagttgttcctagtgctatcttgtggtaccgtttgtgtctagactcgtgtctctagtacgatctagcctaggaccagcatggtacttgactttgaaccattattcaactttgcattctctgatttgaaccattgctttcctttgctacatatttaagcctacccagagctccacaaatttgattgcagccgtacaacaagtgtttgccgaggcatcgatacatccaacctctattggggtgcttggttgagtcaccattccacctgcattggtaagatcttgtaagagcttggttaaaagcttgagtgtgtgtgagatttgagctgccactacctagtatttgataggagcgtgtatattcttgtatatgtttcttgtttgctgctaaccatggcaggattgcgcaaggggaaacaagatggtcatgctcaacgtcaacatcttcaccatcaacgagatatagcgacttcttcacgcatcacatatgaggtacatgataatgatcttacaagggtagaatctaaattgcctagttttgatggtaagtatgattccgccgcttatgttaattgggagctagcagtagaaaaacaatttgatgaatatgatttttctaatgctcaaatgattaaggctgctagtaataagtgtaccggttctgcatctttttggtggcatactgtgggaaataagcttgaaacttgggatgaatgcaaaatactgatgagaaaaagatttgtgttttcatactatagacgtgctctccttgagaaatttgaacatctaaaacaaggtgacaaaactgttagggagtactttcatgattttaaaatatgtatcacttatagtgatttacaagaatctaatgagaacacaatgactagatttttcagagggcttaattccaatattcaggctgggcttgttaatgtgacatataatcatataggccaattgttcatgcttgcttgcaatgttgagcacaaaattttggagaacccaacggagcaacaagctatgcttgtgcctcctatcactgatgttttgcaggaagttcagaacagtccccaaaatgagaagaacgatatgtttgagatgtcacttccttcactcgcgaatgaggagaaggctgatgcacctacattatctgaagaaggcataaaaggtaaattaaatggtgcagaaattactcaaggtgagtatgcttctgatgaattacatttttccactttccatgctgacctagagcaaactttagtggaacctacttctgaattgcctttgtcacaagttgatttgcattctgttccttgtgataaagaagagttgtgcaatagtacttcacttatatccattctacaactagtgaatgaacatgcttcttttaatcttgattctccatgtactgaatttaagtatgttattcacacgtccggcgagaatgatgaacttcaattgcaatcttctttaaatacattggggtattttatgtttgatggttcttgtgagctcaattgtttgaaggacaaaatatttgctcattctgatttgccatgtcctcgtaatgttatatttcacatctttggcgattataatgatcttggaatatattttgtgcatagagtttacatctgctcagatttagaacttcctgtacatgtggataaaacatgcaagctagagaaaaatgttcttgctaaccaaattgtctcgagtttgccttgttttgattggaagaaacaggttgttgtaaatggactacgcaaagagcaccatatggaaaaaccgaggacggttttccatgatgaaggggaggatgatgtgaccatggctaccacggatgcaaccattgctcacatcatggatgaacaagaagatatcgagatcaagtactccaagtgctggaatccgattcggccacctattacactgctgacttcaaacggccaccgaatctacatacgacctccgttttcggcccgtgagtacttgatggaaagctctcggagccctctttctaacagatccagcctcttctctgaattccatctcgtgtggccggaatcacaagaacaaggtgctgcgtcacctataatgggcctatgggcttgtaacttcatttgggaccccggctcaggtggggcccatgtggggtgcgccccaagctggtggagcatgaccctaggcacccataggtcatcctcccacccctatatatagctagttaccccttcagggtttctggggttttgatagattaaagtttagccattgctacttgcttgcagcgcgcgtgtcggctagaccgtccgtctgcttgttcttcggaaccccaacttatcatttgtattaaattcctatttgtaatattagattgcttttatcttgttcttgcttgtttcttcgatttgcttgcaagaatagggttgatctgcaccggtaagatcaacaacccacggagaggtgtatcgatcgctaaggcgcaacacaacgtctcgtacggttgtagtcggatcgtcaacgtttctcccaaatcgtagttatcacaactcaacgaaagatcgggccaacaacagccttgagtgtagagaggaactcagggttcatcaaaacaggttgatgaaaacctctaagagatggtagatatgctatataatctagattaacaacgatatctaaccctatcggttgcgttccattaatagatgttggccggtttagggttggattatgatactaataaagattatgaagcatataagataactcgacgatttacataaccaatgaagcataaagatgtaagcactaatcccgagaatgcaagccgtcataataagttttacctcttgttgaagatcgaaatcgatgcagctcaacctgaaagtaagaactcatcgaaacaatgaaagtagaaaaaggtggcgatgcgccgaaagtgttattgaactgtcgttagatgtttacatgggatcgggttatatttatacccgatatacatgacaggtccttgtagggcacgactcttatctctaacaaactctaatatacgaacaagttttcatggcagactcttgcggaacatatctgtaaagaaactatttaaaatatcctaattaatagatacaattgcctatccgtgagcttatctcaatcatggcaatccttgcatagcatgttgatcaatcccggagacaattatataaccatcttaacgaaatcggctacatcggatgtcttctgtctgatctatgtcagccgatgcagtctttagccgatgtcctcgtagccgatgtgcactctattttcagaagacaaatccgtatcaaatcctcttcgatcccgatacgaatctagttcatggcttaccaaatttggtcgttaacaatatgcttgcatgttgatttgtagaattaaatagattgtagatgctcttgcatgcttgcatgaggttgaatatgtaattattgttagtagatgatgatgttgaagtatagattagaaagagaatagcatagaacggtgacacaccaaggtggtcactaaggggtgttaagcgacccggctgattattcctgcaagtgaaaaagaaacggctaacactaaactagacgctcataaaagagtaagcgaggagaagaagaacatgaaaagctaggtgtcaaacaaagctcccacagggctggctgtggcctctgggctctggccaaaactgtcctttctacgcacaatctgttcgaccaccatagggccgcgaccatggttagaaatttcgtttcaaaattttggtaattcgacccccaccgacaaacacaaatctctttgaaatttttggttttttatcaaatatttttaatttgatcaaaatttattcaaattcagtcaaaatatgttaaaagttcaaataatttcggttaaaaaaaaccctgaaaatcataaaattttcaattttttggcaaccaccgaagcattggaaatttctgtagcaaccgaaattgtaaaccctggctgcgacaggtttaacaacttaattgttccaattagaggagtcaatggtagtactccgtccgtcccattttaagtacaaccataagtttctgcgctctctcaattttgatcgtccgccttatctaaaatttttttataattagtattttttgttgttatgagatgataaaacatgaatagtactttgctcattacttatgtttttaatttttttttaaaataaattttaaataagacggacgatcaaagttagacgcggaaaacaataactacacttaaaatgggatggagggagtaagttggtatgtcaagaacgacggctttgccatctggtgtggcatcgttgtcatcgagatgtcggtcgtccagccggctggttcacttggagagctgggaatagataggttttggtgctacggttgtttcgatgtgtaaaacatcaggagccactgtctcatcagcttgattatgatccttttgattgattatacggtttctccgtttcttcagtcaaccactgttatcctcattgggcttcccactagaaacctcactacaaaggtcatgatttcacacaatctgtcttcctacttagaaacacaacctttctatgtggcagataatagtctctctaggatgaaatttgcacatctataatacataagaatattatttcttggatctttaggtcatccatcgacaatgaaagggttaaacttaaccgcatgcaaatcaaatataattaataataatccaaaacatgtaagatttcagtttcacattactcatgaatacattgtttatctttcggtgtaattttgtcaaaacttttggaatattgacatgaccatgtgcgtagagaccaccatagttggagtacttgtaagcgaagaatatgcagcgaccgtcggtggtggagatcgtcggctcggcggtcgtcggcgaggccgtcggccggatatgctcgtacctcatcagccgcggtgaggaggaggtggccgccggcgatggagccgagcatgacgaggagaggatggaggtggcgctgctcaagattcaggccgccgtcgaggaggccgacggctggcacatcaccaaccgcccgctcgtgcggtggcgcgacaagctcaagcgcgccgccgacgagggcgagtgcgtcctgcgggagtacaggcggcggcggcggcggcgcctgtgtgtcgacgatgatgatgcgcgccgcctttggtttccgaggcgcgttgctcgggccgccggcaagaagctcttcgccttcggcggcggagacgagcagcggctgagcggcggcaccgtgcggcggttcgagcggctggcggacggcgtctgcgacttcgtgaagctcgtcgagagcggcggccgcgccaagcggtttgtgccgttccagccggtcgcggcgtcgctgctcgcgcggagagcggtgagcttctccgtcaagccgccggcgtcgccgggcgccacggcgcacgcgttcgcgttcccggacctcacatcaccgtggcgccgcccgcgcgcgcacgtcgtgttcctgtacgcggacggcggcggcaccggcgagaagctggagctgttcgtggagctcgacctctctgagagcgctgacgtcatggcgctcgctctgtcctccatggacgcgctgccgccgcacttccgcttcgcctccgccgccgccttcgggagcttccaccgcttgcaggccatgacgcaggacgacggcggcggcgaccacctcccagcgtgggacgcgcactactgcagccagccgtcccggtacgagcagccggagtggatggccgccggatacggcgacgagccggcatcggtggcggcgctgccggagcacgtcctctacgtggtcgccgagtgggacagcccggcgagggacgcaccgcgcacgacgccgccgccgccgccgcccgtccacgtgagctaccacctcgggcggcagggcgcggactgggcggtgcggcgggaggagatggcgaggcggatcatggacggccggttcgggacgcgcgcgcggcgcgtcgagaggcacgtggacgccggcgcggagaccttcaacggggtggtgatgtgcacggtggacggcttccgccggcgaagtaaggcggcggtggcggtggcggggcaggtggtgcggtggtgcttcgtgtccgggtgggtggtgtacttgtccgtccggggcgtcggcgccggacagccgtacgaggtaggcttccaaggatgatgatgccattgttgttgaatgttggtactcatcctctcacaaatctcattatgaattgaaattagggatacaagcggatcgatccgtgagtttaaataaataataatttatgggttttcgcatcgtggcctaacttgctgcatctaaatatacaaatggatcgatctataaacctatttatagttaaattcatagttaacccgctagttaaaccggggggttacgcactatttttgtctataagcgggtttgcaggtaaacccacttgcacccctaattgaaatcaaatatgtgctttgtgtactcttcgaagagaaaattgcctaaattttaaatattgagagggagagcttgaaaagcaatgagcaaagacaaaagagtctctttgatcatcatgtcttagagcaaaacaatgtataaagtgaaagtaggcattaatatgggcccaggtggataccaccattttatatggacatcttcacagtgtatattaaaaaagtgggcattaaggtggactccatgttcccaattactactactctctgcctcatcctcatccccatccccatcccgactacctcatccccatctactccgactccgagagagagagaccgcgagaggcggcagcgtggcggggtggcggcgtcggattggcgatgacggctgttgattcggtgacggagtgacggcggcggtggttgatccggtgacggagtggtggctatgtgcgaccgcgcgcgcgggcaaatccggtagcggtcctaagtggatctccggcggcgtcggcgatggtcgacggtggatccagcgtcggggacggtggtctcgagcagatccggcagccgtgtgagcgagcggatctggcgggagtcgtgggcagatctccgacggcggtcacggcctcgcgggtggatctccagcgacggagacgacagtggcgggcggctctccggcgacggccatgcaggtgctccccgtcctctttcactctcccatggtgggctcgttgctgcttctcctctcccatggcggtaaccaactactttggagagagacaaagctagagcaaataagatcggattgtttattccttatgggtggttcttatgggtggttcttatgcataatgctacctcaagaaaaggatagctataagaaccacctccacaatatataagtagacctatgagcataataccctctcttattttcacattgtgaatgcccttatatgtagaaagggagtcgaaggacggagccagagaattgttagcgactcaccacgcggagaaatttactcgtgaagggaaaaaggcaaccgcccaatacccggatcaggactgacaatttatattggaaccccttctattattgcatgctccctctaaataaaaaaatatttacaaaggcaccccaatatgctagtcgatacgcatacaacccgcatagttagggcttgtttagctcccaaacaaaatttttcacgccgtcacattaaatattcggatacatgcatagagtattaaatgtaaaaaaaaattacacagttcaccagaaaattgtgagacgaatcttttaagcctaggtggtgtttgaaactcttgaagatgacgatgaagtaaagattaagtgttttacgcaaaatgaggtggtaataacatgtgattcattgagttttaattacaacaaacttaaaaaatgattaatcttatattttagaacaactctcatgtaaagttttcgcacgaaatgcatagtttatcagtttgaaatgcgagccacttttatctaaaagtttatccaatttttattggagaaaagaacagggcccaaattgcgctatgatttgacaatgtggtgctacagtaaacatttgctaatgatggattaattaagcttaataaattcgtgtctcaattttcggatggaatctgtaatttgttttgttattagactacgtttgatatccgtatatccaatgtaacatacatgcatt

SEQ ID NO: 62202 - DNA, 8993 bp, Oryza sativa
taaccaatgccttaatttggtactgcaagttctacattgggataacaaattagagatcgacgaaaagcggaatatcctttttatttgcgccctgacggatatctttcagtttgtaaccaccggatgacgcacggacggctcggatcatcccgaaaagatcaaccgcggcgcgagcacgagaccaccgtgggccccatggcccaccgacttacacaatctctcccactgccatgcgggcccacacccgcaacagtccagtccagagagccccgaactcctccaaacccgggggggccacaccctgccacgtgtcacccgccgcgcctccctctcatcctctctctcctcgtccagtgcttctccttctcctcctcgcaaccgaacgcctagaagcgcgcgtccaccaagccacggactcctctaattctctctcttgctttctctctcctcgcttcccgggtttgatacgtggtacgtgacgctttgcccttttcctctctctctctctctctctcttgatcagtttgatttgatcggttccgccattagcaaacctcgccgattctctctctcgatcgaacaggggtagggaagcgattaaccggcgatcgatcgatcgatgcaagtgatcgcgctcggttgatccaggaattggagagcatcggctgatcgagagatggcggggaacgagtggatcaatggctacctggaggcgatactggacagcggcggcgcggcggggggaggtggaggcggcggaggaggtggtggtggaggtggaggtgccggtgaaggtggaggggtagggggagtcgaccctaggtcgccgccgacggggacgccgagcccgcgtggcccgcacatgaacttcaatccgacgcactacttcgtggaggaggtggtgaagggcgtcgacgagagcgacctccaccggacgtggatcaaggtcgtcgccacccgcaacgcccgcgagcggagcacccgcctcgagaacatgtgctggcgcatctggcacctcgcgagaaagaagaagcaggcatgcatcgatctctccctgtctttttctttctttctcgtgttcatggttgatttaatttagtttctcgtgctctctgcatgactgaattaattatctccgagatacttctgaactttctattcgacagaaaattcagattttgattttaaaagaaaatcttgtcggaactatgttatacggagtgctttaactattcatcaacacgataccatataatatcctttacaaggattcagataatttttagtggtaacgatagatcggctaaattgtcgtgtagggctagatcaggccgttggcatgattcttttctgctttcaagaaaagatcagagtgttcaattaatttcagatatgattatagtcccttgtagatcatgtagtttgtattatgcaccacacacgtttgtggaaagaagaaagtatggcaacccaacggtgtcagtaatggacgatgagtgtgctatcttttttccttttccaagagtaggaaacaggatctttttaaaaccactcaattggccatgccaaaagtgagtttattgtgttcttttcgatgagaaaaaaaattatgactgttcatgatgctcctaaaaggtatttgtttctgagattgcctaaatttttatgtgagcagctggagcttgagggaatcctgaggatttctgcacggaggaaggagcaggagcaggtgcgccgcgagacttcggaggaccttgcagaggatctgtttgaaggcgagaaggcggacaccgtcggtgaattggcacagcaagacactcccatgaagaagaagttccagaggaacttctcagagctcaccgtcagctggtccgacgagaacaaggagaaaaagctgtacattgtgctcatcaggtcttataccgcttactttactcattggtgccattctgtatatgccactaaattgcaaaattttactgagttcctttattctttgttctactttagtcttcatggtctagttcgtggcgataacatggaacttggtcgggattcagatactggaggacaggtaaaacatgattgatcttttcttttcttttgagcagatatttcttatcatctccagccctagttcaaaaaaaaaaaattcttatcacccagccctgcatggttgcgtattactgtttttcatgtcttgcaggtgaaatatgttgttgaactcgcaagagcacttgcaatgatgcctggcgtgtacagagtggatctgtttactcgtcaagtgtcatctcctgaagtggactggagctatggggagcctactgaaatgttaacctccggttccactgacggagagggaagcggtgagagtgctggtgcgtacattgtgcgcattccgtgcggtccaagggacaagtacctccgtaaagaggccctgtggccttacctccaagagtttgtcgacggagctctcgcgcatatcctgaacatgtccaaggctctgggggaacaggttagcaatgggaagctggtcttgccatatgtaatccatggccactatgccgatgctggagatgtcgctgctcttctttctggtgcgctgaatgtgccgatggttctcaccggtcattcacttgggaggaacaagctggagcagatcatgaagcaagggcgcatgtcgaaggaggagattgactcaacttacaagatcatgaggcgcattgagggtgaggagctggccttggatgcagcggagcttgtcataacgagtacaaggcaggagattgatgagcaatggggactgtatgatggctttgatgtcaagctagagaaagttttgagggctcgtgcgaggcgcggagttagctgccacggccgttttatgcctagaatggtggtaagtgttcaataataagcgtaatagtactgtatcatatctgacaaatttccacagatcttgtgtttgacttgaaacttgtggtaatcaattttgttttgtatgtgtgatttatgtttttggtaattattatgcacactcctccacaggtaattcctcctgggatggatttcagcagtgttgtggttcctgaagataccagcgatggagatgatggcaaagactttgagattgcctcgccgaggtcactgcccccaatctgggctgaggttggtttctggatttcctcttcaaatgtataattgttcccttcaaatggatttcaaatgctgatgaaattgtttattataggtgatgcggtttttgaccaatccccacaagccaatgattctggctctgtcaagacctgatccaaagaagaacatcaccacccttgtcaaagcatttggagaatgtcgcccactgagggaacttgcaaacctagtaagcaacagttacttgaataactacatttccttttttttattcgcaaggaagaataactgcattttcagcactttaccagtacaatactagtaaatagtaatattagattatagttgcaccccaaaagctaatccatctgtcatgaacacaaagtacaaaaaatatttcaagtagtatgtacaattgcatactacttgcaaatatttcaagtcacaaaagtagtatatacaatgcttctgaacattcttgtacaattgcataattcatgtattactagtacctagcaataaaatttgccttttgttgcagattctgatcatggggaacagggatgacatcgatgagatgtccgctggcaatgcaagcgtcctcaccactgtcctgaagctgatcgacaagtatgatctgtacggaagtgttgcattccccaagcatcacaagcagtcagacgtaccggagatttatcgcctcacagggaagatgaaggtctgtcaccagtcatgtcctcactctgtttcagcttagccatgtccccactctgtttcatcttctgtaacttgtaactaaccaaaaacatccgctctccttttgcagggcgtcttcatcaatcctgctcttgttgagcctttcggtctcaccctgatcgaggtcttctcatagttcaattctctgacaaccacctgattattattctttcatgtacagcttaactgacaaactcatggcatttatttaggctgcggctcacggtctcccgatcgtcgccaccaagaacggcggtccggttgacattaaaaatgtaagcatccatcctcgccaaatcttgtgtacaaccgcaatatttgtgcaaagaattcatatccgtgtgcgtattcatggtgtttgcaggctctgaacaatggactgctggtagacccgcatgaccagcacgccattgccgacgcgctgctgaagctggtggcggacaaaaacctgtggcaggagtgccggaagaacggcctgcgcaacatccagctctactcgtggccggagcattgccggacatacctcaccaggatagccggatgccggatcaggaacccgcgctggctgatggacacgccggcggacgcggccgccgaggaggaggaagccctggaggactcgctcatggacgtccaggacctctcgctgcgcctgtccatcgacggcgagcgggggtcatccatgaacgacgcgccatcgtcggacccgcaggactcggtgcagaggatcatgaacaagatcaagcggtcgtctcccgcggacacggacggcgccaagattccggccgaagcggccgccaccgccacctccggtgccatgaacaagtacccgctcctccgccgacgccgcaggctgttcgtcatagccgtggactgctacggcgacgatggcagcgccagcaagaggatgctgcaggtgatccaggaggtgttcagggctgtccggtcggactcccagatgtccaggatctccgggttcgcgctgtcgacggcgatgccgctgccggagacgctcaagcttctgcagctgggcaagatcccaccgaccgacttcgacgcgctcatctgcggcagcggcagcgaggtgtactaccccagcacggcgcagtgtgtggacgccggggggaggctgcgccccgaccaggactacctgctgcacatcaaccaccggtggtctcacgacggcgccaagcagaccattgccaagctcgcgcacgacggatccggcaccaatgtcgaaccggacgtggagtcctgcaacccccactgtgtctccttcttcatcaaagaccccaataaggtccgtacagcgccctgcattctacttaatcacaatctcctgacacattgaaaaatgttctaatttgttggtatctgaaattctgaatctgaattctgcttcattttttaggtgaggacgatcgatgagatgcgggagagggtgaggatgcgtggcctccgatgccatctcatgtactgcaggaatgcaacaaggcttcaagttgttcctcttttagcatcgaggtcacaagcactcaggtgaagtctacatacaagttttacacactgtagtgtgattactgtagcatttacggcaacagatggtcttattggcaatttctcgtaaattcaggtatcttttcgtacgctggggcctgtctgtgggaaacatgtatctgatcgtcggggagcacggcgacaccgatcacgaggagatgctgtcagggttacacaagacggtgatcatccgcggcgtcaccgagaagggctcggagcagctggtgaggagctcagggagttaccagagggaagatgttgtcccatccgagagccccttgattgctttcacaaagggtgatctgaaggccgatgagatcatgcgtgctctcaaggaggtcaccaaggctgccagtggcatgtaaattggttgcctgctgggaagcctaatattactctgaagcctggaagaatcaggagtgccagcttgatgaagtctcctggctctttaactgaaagacaagactctttttctctccttaatttacagcataatcttatggaccactaccacgaacttaccttgcagtgagaaataattatgacactgctgatgctactgttggctcaaatgtttatgagctgattcagttatatgtattttttcttttaatcctgcacttggttcaagtacgcatatcatggcaattcttttaataatttcggtccttgttcaggattggattacttggcacgttctctccgtggtttgtgaaaataacctaggacataaatgttttgtaacttaagtttcagtaaacccagtcaaaaggaaacatacaattcaaacaagctgactgataattaacactgtatttctgacactaggttcattttctgagactgtcctatcgctgaaaccttttttttattttttgaaagaactgaaactttaccaagctaactaatactctctccgtccctaaatatttgacgccgttgactttttagcacatgtttgaccgtttgtcttattcaaaaacttttgtgaaatatataaaactatatgtatacataaaaatatatttaagaatgaatcaaatgataggaaaagaattaataattacttaaatttttttgaataagacgaacggtcaaacatatttaaaaaagtcaacggcgtcgaatatttagggagcataaatgaaggttaagttatatttctttaataataacttacaggccacgtggcacactccaattggtcgacaaacaaacgcaaaactggaatgataagggaaaaataatctgctactagtatttatcttgcctacacaacttccagcatgatgctttctgaaacgtccctgaagcatttacataggcaattgattggttcaatatctgcttccctctgcgagacatgtctcttccctaatcaatatcagaacgaaactgccacaattttacaatatatacagggattggcagaggccattgtgcaagactgcttattggttccaatcaagagtgtatactaacatggaagaaaaggaggaaatgaccatgctttcccttggagttggagctgctagcaagcactcaatatccaacagaaaattcagactgaaagaagtgacagatcacaaattcaaccttggagatcaagatcataacagtggccatgtgaggaagaagctaaggcttagcgaagaacaattgactgtgctggaaaatatgtatgaagctggcagcaatctcgaccaagtaagttcaaatttgtgatctctgaacattgatgcatgacaaaaatcccatgtttcctgctatttaatgactgaaattaggcactaaaacaagggcttgcggagaagctgaacataaaaccacgccaagttgaagtctggtttcagaacagaagagcccggtacttgcatttcattcacatgcatggattctaacttctaagacctctgaaaactgaattcatcaagatttatgaactgcagtttttctgatgattgcttttgtcgaaaattttaggaccaaacataagcagatcgaagaagaatgcaagaaccgaggtggttggagggcctaaacaaggagaaccgaaggctgaagatggaactgatgagggtttctcggcctgttttgactcctcacggcagcacccataatgtgtcagaggttactgttacttgtttatcttgcaacaaatcttcctacgagactttcacagtgtgaagaacctggcggtaaaatacatgagggtcaattcagtgatctgaatatagtttctgatcaatggagaattctcaaaggcctacaagattttctctttctttttcctttttacagaatgcgcaaaaagactgtattaagaaagggatacaacaatggtaacaagattattatttttttttttgaggaaaccatggtaacaagaaaatgcttccaaagtgacatagtctcccatgttaaataataaatatgcatttatttttttaaaaaaagtggatgtttcacttattcagatttatatgtcaagggggaacaacagtaacaaccaaggaggaacttttttttttttgagaggaaaccaaggaggaacttgatggaataatttaaaagaaagtgtcagcattttaagaattgcactccaggaccatggggttgaaatttagtacctccggtaatagaaggtacggaaatttagtgcaaattttagtacatctcaacgacggtaaaatttctctttctcttatgccattgatcattgtaaaatggaaagctactaaaacaatatacagcaatatcccccgttataacttcagggaataatgtcttggcaccttcctgacagtacagatgcagagctgctccctataaagttcagaaaataccaataagattgctctatctgcagaaagaatatgaactgaaaaaaagggcagtaactcagtccattgcatgcatgcatatgcgagaattccgaacttgaccttccaaaattgacaatgtctcaccattcgcctactcttaagcaccaccaccacaaaacaaagcgcctccccttaatcctctcctatccactcctctcaagctataaaaggagctcccaagaacacgaagcatccatcgatctccaagtctccacccatcaagattgcagtaataatccaagctcaataaacgagccaatccgtcgaagaaggaagcagcggcgatggcggcgaggtccggcgaggtgcgggcgacggtgctgggcatggcggtgctggcgctgcttctgctgctcggccaccacgcggcggccatcgaggccaacgtcggcgtcacccgccaggccagcttcagcctgaacggcggcgccggcgccggcgccggtgctcgcgctggcgctggtgctggcgctggcgctggcgtcggcgctggcatcggagctaacgtcggcgttggcgctcgcgccggcgtcggtgctggcgtcggcgctggcgtaggtgcgaaggtcggtgctggcgtcggtgcgaaggtcggtgctggcgccggcgttggagcacgcgctggcgttggtgcgaacgtcg

SEQ ID NO: 62203 - DNA, 13313 bp, Oryza sativa
atgcggaatgacttgcttgatggtacagtagttcatcataaatatttttaaaaattaagttttaaaatttaactttttagctatacggttcagacatcaaccagctgagctgcctcgtgatttcctttccttttctttttctttttcttgaaaacatactaattccactacaccgcactattttgtcaaacccttcgtcatagagcatttaggtctttttcggaacgcagaaattttagaggttttttttaacataaaacagtttaactcctccaagattcccgtgcaaaatcttccaaactgaatggcccttcaagttatatatttcctctaaactgcacattaaccttgtttgagatccaggactcgtccgctttgctcgtgtggtctagcgtgctaatcttcaaccatgattgatactcctgcgatcttagcctacggtatttcaggtgcatgtgcgcaacaaatatatatacacagatatggaccgatcgatccatgcatacgtgcgtctcgcgtggctgcgattccatggcctaatatcttaattagcgcaggaagatagtactactacttacttaccagctaattgcctaatttccacgcccagtgagcggctggagctaagcacgcagctagtagctaacaaactcatatatcaatcaaaactgaatctaacacaaatatacactaacatatactccatagtgcaatgataagagatgtgtgattctaactccaaggtaccataccgttcccaatacattcacattttcttcttaattttttttagagacgtctctttctccaaatttcattttctaaaactgaatctaacaccaattataagctctagataagtgatatgaagctatcggcatatcacacagtgtcactatgctacgtacctgccgttcaatgtgtagggaggagaacgatcgaacccaccaaatgttggtgttagttgctcttgttgctattgtcaactaccggttacatctatcagttcatctcttgcacaaacacaacgcttgtcctggttgatctataggacaaaatggtggtttcggcttagctattccagtagtactttcttctcggaaagataatgtcttttgaatcttctgggtaggaatcataatccttcttataaatgttgttgaatctagtagcatttggagcaactttacaatgcaaagataccggcaccctacattaaaggtaaaaaaaaaaatcccccagacaaataaatcttaccagctacagtaccacttactactgccacagctatacagtaagatctctccttaccatcaattttgccggtggttagagcagtaaaatgactcggttaaaaaaaatatggagcagtagcagtaaaaatcttcaaacaagtttccctttttacccctgggtgttgtactactagtacttggggcttgtggctagcctttgcccccaaaaggaaaaccatcccggtttcccgaacacgagccgcccgcgacgacgacgcatccgccattccaccggcgacgcgacgcgacgcgagagcacgcgcgcgctcgcgcggggcgccaccacaacccgcacagtgagagagggggggatgcggtcgcttgctccggtagctgcggctgcggcggatgagcgggggagcaggagggggcagtggtaggaggtggggatggacctgggtggcggggtgggggtggtgatggcggcggtggacgggggtggcggcggggagctcggtgggggagggttgctcggatctaggctgatgaagcacgggaggggcaatgcgggggaccaggagcacgaatggaggccgccggcgaagcaggcgaggggcggggacgcgtcctccgccgcggccgccgtggcggccgcggcggcggtgtccgaggcggtcaaggtggcggcgccgttcctgctcggggcgtcatgtagccccggccatggcggggagcagatgctcagcttctcgtcctccgcctcgtcgtgctcctccggcggcggtggcgccgccgtggccgctgcggcggcggctggcggggcgatgccgctgtactatggcacgcctgcttcttgctcaggtgaggatggtgcaaaaatcttttcgtttcctttatttttttcttctttctgttctgctcgtctgattcgatttggtgattgaaaagctttctgctccttttcaagtattattgctgtttgattcatctctctttgttatagatttattttccattttttatgctacttctctgcctttttattcgttgctatgcatcatgcttgatccttgctcacactgggatgggatggagctgatttagttttagtttttgtttttttcccacttggttcttttactattgtggtttagattcggatttgcatcttgtattttttttgtttcatatttctcatttttttgtctccttttgactagatcactgactgcgaatagctcacttcctctgaaatagaccagtttattatctttagcatagatgagtgtgagtataaactagttcttgattttttcttgatactggagtataagtttcctgttcttttcagtgacatccacaaacgctttcttgtcctcatcggtgcggatcgggcgtattctctttcgtcataccttttgccgaaactaaaggagaaagcacatatatggatgagaaaagtcgtgatctttagcattatatcactactatttctactacgtttttctcactagggaagaaagaaaggttaaagtaggaaaaataaaaacatgcaagaaaggtttcaagtaaacaatgcggcaaacgcgaatcaagctttgctgcaacggatcgaacatgtggttggttggtgactttttatgcacacgccacctacaaatccgtgctgcttctgatccttgcagccactttgcttcagatttttgtgtcttttgcttgcccctatctatgttatatcttgcacaaggatcgtgtttaggaaacacatgcatctggatggtggtcgtcgtctcgtcttctataaagtacatgtgtgttttggctgtgccttgttggcttgcactgcctagcttgttgctcatctccttggtgtatctggctgcaggattgagctcagtgagcttgagcagcagcatgcagggtgcaatggccagggtgaggggtcccttcacgccgtctcagtggatcgagctggagcaccaggcgctgatatacaagtacttggctgcgaatagccctgtaccacacagcctcctcatccccatcaggaggagcctcacatcgccctactcacctgcctactttggctcaagcacatgtaagccaagaaatgggaaaggaagcagatcaaccgaatgctttcttggctttagttcctttcatcatggactgatatttatgataaaagctgttccattccctgatcttggttgcattgcccttggttgggtttttgctttgcagtgggatggggatctttccagctgggctactccggcagcgcggatccggagcccggccggtgccgccggacggacggcaagaaatggcggtgctcgagggatgcggtcgccgaccagaagtactgtgagcgacacatgaaccggggacgccaccgttcaagaaagcatgtggaaggccagcctggccatgccgcgaaagcgatgcccgcggcggtggcagcagccgctgcctctgctacccagcctagtgctccggccgcccacagtggcggagctgttgctggcctcgctatcaaccatcagcaccagcaaatgaagaactacgctgccaacactgccaatccttgctctctgcaatatagcaggtagaatgttggcagcactttcaagctccaaatattgcttttagtcaatcatgtagccaatgcttaagctcaagacgtcaagtttcgcttttgccattttgcatggatattccatttccgtacatatttgcctgccggcatccaccaaataataaagatagaaggtaatttagttacctagtttatttagctaccatgattggagatgagccccaaagataagctattaatcatttaccagcaattaaacaagtccattatttacattgctcatctatgtactctggtagccctaaaggtacttgttttgtgagtagagtggccgttgaagaactgccatactaaaggaacaactgctatatgctgtattaactacttcactaatgaatcacttgttgatcaaacttctacagggatctggcaaacaagcataatgagagtgaacaagtgcaagactcagacagtctctcgatgctgacttccattagcacgagaaatacgggcagcctgtttccgttctcaaaacaacataatccttttgaagtgtccaactcaaggccagattttggcctagtatcacctgattcactgatgagttctcctcatagctccttggagaacgtcaatttgctcacttcgcagagtctgaatgaacaacagagttcagtttcccttcaacactttgtggactggccaaggacacctgcacaaggagctctcgcatggcctgatgctgaagacatgcaagctcagagaagccagctctcaatatctgctccaatggcgtcttctgacctgtcatcagcctcaacatctcccatccatgagaagctgatgttgtcaccacttaaactgagccgtgaatatagtcctattggtctcggttttgcagcaaatagagatgaggttaaccagggagaagcaaactggatgcctatgttccgtgattctttgatgggcggaccattgggagaggttttaaccaagaataacaacatggaagcaaggaattgcctatcggagtctctgaatcttttaaatgatggctgggattcaagctcagggtttgattcatccccagttggtgttctgcagaagaccacctttggatcagtatccagtagcaccggaagcagtcctagactggagaatcatagtgtttatgatggcaacagtaacctgcgggatgatctcggttcagttgttgtaaatcatccgagcatccgcctggtgtgagcttcttgatcaacaaaaaatgcaacaagatgacaggcatgaggaaacgattcaatcagtcttcaccttgttacatatcgttatgacgtcttcaagtgtgagcatttacctcggtgctttgtcattcagactaatcttgtgtttttggtatttctgctctgttatttttcctttgctttgtaaccttcaccttggatcttgacgtgatatgacgtgtggtatggatggatttggtactccattgtggcatatcatcttaaaatatcccatgctgtgacgtcataatcgcggatgaatgtaatccgatccttgtcttgctttctggtagtattcaatggattgtttgtgagctgatataagtattcctcttgacttcttgatgcttgttggtaattttagttggtccatgcggcattcgtgtagtgtttcactggtatttcgtgtacggactgttctgtttgtctcccaattattggaccatatattcggtgtatactagttttgcatagtacttctactttgtttgcagtcactaaactagacaaatgagaactatagttaggtcagtttggacgaggcaattggggtttttttttttttttggggggggggggggtccttgcgattaaatctgtgcaaaattctgaccaaatagtttagcattgctttttggagcctgagggcggtctttcttttcccactattattgacagagtggactagtggtctaatccagttctgattgtactcccaaccaacagcctcaccagaatacaatgatacaaatttcaggaccattcaccaccagccttttcttcctcttttaacagctgccaagccctgcaaaaagagaccagcctccctctagcttgtgtaactacccaatgttcatcactgcatgcatgcatccatggccagcctctactccaccacaggcagcaagcaagcactgtgtggttttctcccttttgatgatttgctctacagtagcctacagtagaatgattcatcatcagcagcaatagcagctagctaggcttgcagttgcactggtgtgcaagatgagagccctgatgccatttgccacctgctttttatgcacccagaagactcaaaagcgatccatgcattgcataccacacacatggatggatagatgatagtagtgttcttcctccaggaatgggctgacctgggtgactccttgattgctcacctgctagacatgtcaatatttttatttttttttcattttcttgtgcttattttactttgtttctcatgcctattctgattatttgaaggagaatgttcactgctggatgcaaattactggttttgtttggaggcacagaaagggaaaatttttgacacagaggggtttccccgtttttcctgcctgcccgtcacgtgtgctcgctagcttgtgtttggacaaaagtcgcgcgcgtgcaatacattactgaaaagcaatgcactcgtgtgtactagcagtacaggtaaagaatgcttccgtgtttatactatccgaatgttttcgtacttgccccagcattagtgtgagcttagccgcactatcaggtacaggttcacaccactgccttgtgtcttccagaaaacgcagtactagtactacgcatgagtcacagtgcggctgcatttcacggacgttcttgtgttcacgagaccgactgcaaacgccattcagaaaacgacctgaaccgacgccgaaatcgccgagccgatcacgcaacgcaacgcatgccaaagcagtagtcgatcgagccgagtcgatcgctcgcgttgtgtgtggcgttgcagagtacgtgtgcgcgctgcaccacgtagcgatctcacgggcggagcagtgggcatcggagtgaagaggcgcgaaaggaacagcaacgacacgtccacgcctccttgctcacatgccaaggtaaagattacgtgccaaggtcggccacggtcgcacgagagctgagtacttgatcgtcgcgtataaaaaacctcgacggcgttagtaaaaaacttaactcgtcgatcgatcgatcggagtgagccggtgaaacgggagaagaacacgagatgagccggaggagcggcgtggcgacgagccgccggaccaggcgggccgccgagcaggaggtgcagccgccgccgctgtttgccgcgaacccgatcttcctgtgcgaggacgacggctcggcggggcggctgatcaaaccgggcggcggcgtacgcggctacgggccgggctcgctgcacgcgctcgtgcgaggccgcggccgcggccgcgacgtggcggcggacgacgacgacgacgacggtggcaacaagatgctgccgttgccgctgccaccgtgcagggcccaccgcgaggggcgtggtgggacccgggttcccacggcgtggcacgttgggcccacgatcgtggtgggcccgcatggcgcggtggtgaggatccgtgcgccgccgccgcctcagcagcatgacccgttcctggccgcctacgtggcgtgcaccaagggccgcgccggcgccggcaacaagaagaagaagaagaaagccaaggcggccgcgcgcggcgggtgcggcatgtggaacgggtgggcgtcgggcgcgaggtacgcacgggtgatgtcgtgcaggcacggcggtgccgtaaccgtgctgcagggcgccactcctcttcccgccgtcgccggctatgccgagtcgccggcgcaccccacgctggacctgtcccgcctgccggcggtgctgccggggaggagacgggtgcacaactgaggacagatcgtgtactcgtacgtggccggtgcatgtgtacattgatactactgccatgacgtcgtgtgcaaagaattaagaaagtagtagtccatatttgcccaaatattgtcagtccaaaaatataatgggccgtatcagccctaaaagtaaaattttagcccaaacagtagtatgggccgggtcacaattgtcaaagctttacaacgcaataaaatctggatgtcaatgtcatatcatatgaagaccgagtcaaattagccacgtatgcgccacgacagctaaaatcaccgtccaaacatattgcaccgttttagacagttgagggacctgttgtatctgattttttggttcaaggaggagaatgttaagttaagggatctcagatgaacttattccataaaatctcgtttatgattcgttgggccacggattgcgtagggcgcaaagtgcaccgccgccgctacatccgagggtgcttcgtgccttcgtctgctcgcttcatctgctgggcggtggctcggctgctccggctccggctccggggagaatccggcgtgagcgattggggagtgggcctgcctcgacggcgttgaagcgggaccgccgggatgtcgccagccgccaccttctcggcgctgctccgcgggctgccgccgccgcggggccggcgcctcctcgtcgccgccgccgcgcgagcgcacagcacggccggcgggagccgcgcgcgcggtggcctgccccgtttccattccccgacgctcccttcgtccaaggcaagcgcgcgcttcattcattgtcccctgctcggctgctcgacacgtccatctgggtcggcgtggtcatttcgtcgagcacctcgtgctcaataggttcagcatgtcgtaagctttcttggtagttggtagactatgaccactagagaaatgttcgtccccgttgtcgtgggaagacattgtctgtcgtgtagactgtagagtgtagagcgctgttccttcacttaccccataggcattttgccgatcaggtggtgtgcgtgggttttctgcgtgatgttccattccttaatatcagctgtatgcctgtatctaatataggtatttcctttcagggtgaagaggttcgaatccaaggagacgaattctggcacatgacaagagtcttgcgccttggcataaatgacaggtctgtcttattgctctgcatgagtgtaaatttgctgcggtgaattccagcttcaattcatcaatgctagattatttagtagaaattctatccaccgctgatcctaagagtccgaagtttggaaataatttgattgctgcatatgttcatatgataagccatatgtgtaaaattttcagcttttacttcgaggcaccaaatttatttatttattatgagtctgattactatttgtgtacatattgaaactttatatgaaaacttggaagggttgaactatttgatggcgcgggtggtttggttgaaggatctatacaaaaagttgacaaaggcggttcagatgtgaagttgcttgaggatgctagactcattgctcctgatggcattcaatggcatgtttatgctgcatttggtgagtcccataaattatgcgcacttactgtgaatacagggtagttttcttctccatagcttaccattttataattccattccccagggacattgaaaggtggacgtgcagattggcttgtagagaaatgtactgtatgttatgtacaattttgggtgtcttgtctcttcacaatctacttctaaacattattttactctttctctgtttaggagcttggagcttgtagtgttacacctcttcttacagagcgatgccatacaatagcagaaaatagagttgacagattgcaaaggcttgtgttagctgcagttaaacaatgtatgtgtctctgttggcaccaagatttcagagcaaaatgaactgaaataaattgacagcattactcttgtttctttaggccagagaatacatggaatgttgctgaatcccccaattcagatagctgaccttcagcctgttgtaagtgttcacatatgctttattatctttgcacataacattgtaactttgttacctagttcatgcattggatagtaagagttttgtatggatccagtaacttgcttttttataaagtgggcaagcatgatattgacctttgttgagcaaatgttctaggtcaaagcgcaataatctttagtactgcattgtggagtgaatggtcatgatgcattgtgcagtgaaaattttgttaagaataaaacataggaataaaattttaatgtatgtactagaatgtagaactaccagagtcattattgcatcttcttttacaccacgatgtgtgattgacaaagtcatattattgtgttatctatcatcaggtatcacagtcaaagctcgctttcgtagcttcagcagaatcacctcctcttttaagcactttgccgaagtcctgcaatgaagaaagtgggcttttgattgttggaccagaaggaggtaagtctaactatagattagattcatgtctaattattaaaataataagatcattggttagggtaaacatgtgattttcagtattcttgtttcttgcttgtatcaaatgtgcacttcacgattttgatgtgatattagttgtctgtgctttatgaagtgaatgctttatgtagggccaaaagaaaaacacacacaataatgtcaaagatatgttcttgcagtagcataatgaacagtagtaaatttatactggtatttattaatgcagttcagtagtgggattacatcgagtttccttaagcatgctagattttaaaacacaaaatataattttgaggattgaactatgcgaataattaatggcttttgaatttggcccgaaaaatctggggtccaaaataaaccaatgtcagtagtattatttcactggaactaatatgctttgttttctcaacctccatttcatcagatttcacggaagaggaggtaaacgttttgaaagcatcaggcgctgttcctgtaggtcttggtccatgcagactacgagttgagacagccacaatttcactgctatctgcgctcatgctgtggtcagatgctcatcgccaggaaacactgaaatgcaggtagtcaatgtagagctgtcacccatgtgctactttatactcgcattatgtccaaaccttttgaggtgatatcctcttaagcaagacattttaaggtgattttctttttgcctttgaaatgtttttcaaaacctagttgggcttatcaaggagcaaaatcaaagagaatcgttccactggatctaagtgagcatctctgtaacagcatgacaattatggactggtcagtggtactaacaaaatcaggcaaaacgttatggaaaagaaacaaagtcgtcaatttgttgatattataggtcatagttgcatcccgttggttagtcgtatgttgtctcgctcgcatgaatgtgacctcgcagcatatttggttagtacaccagcagcagccacccttttcgaagacgatcatagaataaaaatgatgatgaattatggccttgatctcgcagcgtattggtcgaatgtggctgagacagctagaaagttttgtcatgttgtgatggtacactgagacacacgaccatcagtccagataagttgcatatgctacatattccgttcgcggagacgcgaagctgttcaaacagattcgcaagtattttttaagctaggaactcgtttttttgcataatttgcccgtggttttatcactttgtcatgtgccatgtggatgtggaacagtggaagtgcttttgaattttgctgcatataaacaaagaggtaatcatacgcaaaaatacaccttcgcgctcatactgtttcggtagcatactagcatgtgttatgctttttcatggtcattcgatctttcgaatttgtaggtgagtcgtttttaaacttgtattttgtgtagtgatatataatagtgtataatgttattttttttcttcgtaattatttaaatgacatagaaaacaaacaaatttgctacatatttatccataaatttttttcttaaaaatttgacagatgtaattacagtacaatcgtaatgtaattaacttgcatgtaactttaatgtaattttgaaccgttatatttgtttcaagatttgtgcaaatgaggaagggaaaaagtcacagcacgcacacagtgagaggattcgttcccacaacctccatttcaccgaaatactacatccgtcctaaaatataagcatttttttttaccctgacacgatctgtaagatgctactttaaccaacaatatctataaaagtaagatgttttaaataaatatagttacatattatgatagtttgtttaataataaatctagtagcattgattttacatgattggtctttttttattttcttgctattaatagtccaagttgaaaatatttgacttgtcaatgtgctaaaaatgcttatattttaggatggaaggagtagcatgttacatggagatttttgaacgttacatacaagttactccatctgtcccaaaatataaacatttttagcatgtgacaagtcaaacatttttaactttgactattaatagcaaaaaaaaaaattaatcatgtcaaattaatattactagatttatcattaaacaaactatcataatattgtagttatatagatattgttggtcaaagtagcatctcgaagaccgtgtcagagtccataaatgtttatattctaggacggagggagtatattgtagttatatggaagttatagtgtagttacatcacgattatactataattatattgtcaaatttttttaaaaaaatttatctataaatgtatagatgatctaaaaacaaaataatttccctcgcggacaaaatgacttgcccataaatactgggaagagaagaaacccgcacgctgcatcttcacacacagacacatccacgttccccacgcacgcgcgcgcaaacagtcgcgtttcggcgtgctgacgtcgccgtgcgccgctgcagccaccgcccaccgcacggcgcacacgccacggttgcgcggatgtctctggccgccgccaccaaacgtcccgtgcaccacccacgcgcggcgccgcccccatccctcgcttgcccacgcacgcacgcacgcacgggcgtcacgcccaccgcaccggcgcgcacgtctcaccgctttctcgttgcgaccgcagccgtacgttgcccgttgggcctttgtcccccgcggcgccacgtttaccgcgtcagtcaactcgcgcacaaacttgcaggttaaccgcctccgcgccgcgttgcggccatcgcacgtacgtacgcgcgtacagagagatccgcgtcatg

SEQ ID NO: 62204 - DNA, 7434 bp, Oryza sativa
ttcgttgctagataattttttggaggagcttcaagtaagaaaggatgatgtttcggacaccaggattgcgttcaacaaagacccattccttgatgatgctgtcttgtcaaatccaagcaccagtaatggcaacaagtaaatgaggtggcaagtcttattcatccccttttgtaacaatgaagttgtaacattccttcttgtttaatatactgtcttttgttttgagagaaataagagaattagagaatttattatatgttacaatggaaatttgaaaagcatatgcacatgtatggtgatcctgaagatgcgatttcaggaaacaacaacgatgacactagtcggtgacgtagttgttccccacatatgagctatttctacaagggagctcctatcactgtagctatagtcatgcacccccatggtgcgcatgctgttgctgttgtcgatgttgacctcatgcacctctgccttagaccccacttccaactcattctcttgtgactccaaaggcagcatgctgttgtctttctctatcgtctgtgccacgctactgctcactcccgggcatgggcctagattgggataactgtcattgccaataagagatggagctcgattaaggcaatttcatctattaattagaatgttgagtcggtttgttagagatttggtaagagaccgccgtatatggtcttatttgtattaactttaaaaataatagactgagtttgtactcggcatataaatatgaaccccatagcattgaaataagggagccaatccaatataacttcggcgcatcgccatccttttacttttctcgtttttagtgagttcttcgcaagaggaaacccgtctcaatggcctgcgctatcggggctaacatgttaggctcgatatcacgagtcattgctatcatatctcttagttaatctattcttagcttctcaatttagctctatcggctgctgctcgctttagggtttatgctggtttcggttaaattgtcttggtagattagattagctaaggcatctaccatcctgaaaagtgcctaattgcttgattgtttagattgtatgtttcttttcatactttgagatgcatcatttctagtcgtgcttagaaccatgcaaactagtctgcaattagacataataaggatagtatcggggtttcagccgatcttacctaatatgcatgttcactatctgtttcatgtatattcaccacttatatagatagatcattttatataagcatatcaagctttagtcggtatcggctagattcttgcaccttcatgcttgatttctgtttgatatgtttttatggatcaatttgtttatataagtttgtactagagtattagctagtgcattatcttttctgctctaaatattgtcacataagctactttcataatattgtcttaaatcaatctattaaactcgatagatagtattatagccgattaggtgtgtttagggtttattattctttgatatatccagtccatagccgatttggtccaactccatcggctaagaccatcaacgatatgctatcggcctatcggccgattggctatcggtcgactaattctgcttttattcttttttgctgattgcatgatcaaatcaactagcacgcccttgacacacttgaggttagccttggacctgcacaggagttaagcagatatcccaggccgccgtgctttcacatcaaaacaagcgcaccgataagtagtacctctcatcgctcatgaccagcatttccctttttttttataagagatcagttttttctccatcggcaacccttgattcacccacgttacataggaagttaggtgatgggagatttgctcgagatcttgtgatcaacgacatcgtcttccaggctgacgtccctcgttgtcctcaacttggtcagcctcgtccaccataacctccctggcatcctccccgtggccagtcagatacagcctcaatgactgacgtcttgaccagtttgcttgtcttagtagtagggtccataggggtcgatgtttgtattccatcctcacaattcagcatgggaatctttctccgcgtcatgtatagatgctatgccacttgtgcttctcgtatgttgatcatgttattgcctatgggcttttgcacaacttgggtaccatatagatacatatggggcactttatagtagatattatggttttgatgatcaaaatcctaaaccaagcgacatcacacgacttggttttggtttttcatgcgaatttggtgaacattttgctatctcaatctgtaatttttatatatccccttaaactgaaccgttgagttagggtgcggcacctcttaattctcttgcaaccaattgcaaagctaaagacatacattaacttacagtcatatagtggacaaaagctgcatttttctaatataagtgtttgctatttgttgtagctttgtgaaacatctagctaaaagttgtaaaaacaataattttaacaatatgtttgtagttttatgaaatttactctttatttgactcatttatgctctaaatctaaagtttctaccaacatgcacattacttctaagtactaacatcacatcattcgattggtttctgtataaaccaatgattgcgtactactcttaggccctcttaaacttattggcttgaacttttaagctaaagttttagcttataagatttactagatgttatccagtgtgttgctgcaggatagctacacatataaaaaattgaaaattttccgctacagaaaagaataaagcaaagcgcaattttgtcgacgtttgcgatcgcgactacggtatttggatggtatggggatcgttggtactagggtatatgcaagattgaggtaaaagagatagagatagagatttttatacaagttcgggccccttatctgataggtaatagccctacatcctgttggcagaagccgatgttgctctttattcatctggatcacacaaatacaatatttgggacaacctatttagctgtcgtcgacttggcggctagataaccaactcatagttgatgacaaggtagtcttcctcctcgaatctgtactcggcgagatcagagatagtactaaatccctcttgccggtttccgtaggcaccggatggggtatagctaggctaatctccgatgtcgagatctaacggcttgtgttggcttgtggctttgtggcttcgtagattgtggtgggtgtatcccctctccacctaggggggcttgtatttatacccataggtgcccccttgtccaagtaaaactagggaaaccaatatggatataatctgattagtccgtcgtttccatatagaactctactcgtccttccttatccagaactccttctatatacgaggtttgtttccatataagacatggtatgtggtgggccctaccgagcttagtcgattactattgggtatgtggtatccataatcctgacaaatttgtagttaaaaatttgaattaagattttaatgtgttagcctatcaattttctatataccaaaatcaataaacagtgccaactacataggcttgcaagagaaacaacaaattccacataaccaagcagacaacaaaggtcaaatacactaaggatctagtcaaaaaataaaataaaataaaataagcatcatatgaaaacgatgaaagtgcatacatataattattagtgccatgcatattaatccctggagaaatatatactgccataacaaatttaaggtattacattaaacataaaattaattaaagactaatgtacatgagtaaatggctctttgttgatggatgaaatggttgactccttcaaccttgttgcaattatcattgaaccatataattctctacagaataatcgatgaaacatgaataatttcttttaacagaaaataatgtttcaagacgtgtgagcaagcaagctaacctgttaattaatggcaatccataacggggaaacgctgaccatggcagggacctagctagtacacagtaagcaaatgtttggacacaaaaggaaatcaactgaagcatggcaatgcaaaacaatctatatattctacgcatgtctgtgaagttaattgaagattcaaggcaatatatggagtcaggcgactgacttgagtttatatggtgttgttgaggttaagtaatacatgtttaaatgccgtgaataatttcagaagaagattaatgggaagaaaacaataaagagaatacaaatcaccggatggactgtacaattgtactaaaaagatgatccatgcatgaagatatatttaagttgaagtgccataattgttcatcaaaacgtaccaaaaattagagagcaaagggacgcagcttgtctgctccccccgtgtgctcccatccgtactcccgtatatgtggcaacatctccatcgttttggcccatgtacccgattacaaacataaatatttttctattataatataattatgtaagattttgttgtaaagatttaattgcaacgaacacaatggtataattggattgtagatcagataaataatttgaaagaaaattttataagaagagaaaaaagcatgcatacttaacgctcttatgcttctcaagtaaatcggatggctggcagatcgagagacctctcgttttagattttacgttaacaaataatgatacagtcttcttattttgtctcttttcttttactttcggaaatttcggcagcagtttttaaatttgaattcaaaatttatttgaaaatttcgtccaaaatatttttgttgcccccggattaaaaaaaggcaaaccaatagttgaaaccctaattgacactacccttaaatttaagaactaatcatgtatatttcactctcttggaaaagtttgagatgaagacggggagtagtttgtaatccgtacatgactactctgcttttccacctcttctgcctcctatcatgcattcatgcgagcacgccacctttctctctctctctctctctccctccctccctccctctcccctcttcttccccttccattcccgcaaacttcgccaatctgcaacccagccaggctccacacgatttcgcgaagaaaccgaaatccactcggttttcctgcggtagcattggaatatggaagagggattcgtggaatcaggatccttctcccgctcctcctccttcgtaagtgcgtccgaaatgatatctcagaacagggaaaccatctctttgcttggtcttgtttgattgttcttgggaggtttcgttaccctcgatctcggtttcttgcagggtgggttcgaggaatggatggcgctggtgaggaaacgcaatgggagtgggacgccctcctcgtcgtctccgcagcagcccaggtctggtggatttgctgcccaatcttcagtcaggtatatatcatttgtctcccgttgatgtattaacgatgaaagatttgcatctccgttgtactttcgttttccatgtctgacccttacatggatatagattgtactattagattagcatgattcgtattgtgatattttttttttgtaattgtgtttagattatcaccaattcaccatatcagagaaaatgaacaagatacttgtttatagatgtactaaagcatgatttctgctcattcattgtagaaggatacagtgacatgatttcaactgtggcattatgggcacgatgttcttagattgcctcattggatgaggttcttgataaagctcatatcattcagtatctgctaattaatatggtttctgtgcactatatttttcagttcagaaggactagaacttggtcacccttatagcgatgcgattgactatagcttatcataccaactaccaacaacaagcttatgggataggcttgggagggttactatgatggacatcgagtcaagtgacttcaactggagctctctctcttcactgcaccatacaaaacatactgatactagtacagaaccctacgaggatgacaccagcagaagttttgaggtctattgttttcacttgtatcttttacagattatgttttgcattgttggaaaatgttgtcaatactagttataatatcattttttttagaaaacaacagcaggagctctgccggaatttgattagagatataaaaacatagttatactgtcatttcccaacaaaattttattaccatatacttttatctgttttcgaattccattacaaagtgtacatctttgcaactgcatcgtagatatgtatctatcagcataagcctaaaggccagtgcattatcctgcgagagacttcatgtccattagcattccccttcatatgaatgttcaaaataaatataaattttgtttatttgtcatgtctctagctcattttctacatgtatctttcttcataggttacagtaaattctggaggagttgttttcattgcattattcaaaacatctgaatatgatgaccttccgtccaaggagactgcagcggtcattaaaatagcgccttcaaggatggccactcaatcagaacgctttggctatgaacttgcgaaatggcttggagtgaggactcctcaggtgaacacccactttgcttgctggaattctggttaaccataaaaatattacattgcactactctgttggccaatgcagggcagagtgattcacaacttctcatctgaatggcatcaaatgaaggatgcagttgagaacgctcgggatgcagcgatatcttcttgtgatgaactcgaggaaatgatttgcactgagatgctagaggcgctcgaattgagccgatgcttattcctaatgaagtatacacatcaagctaccagtaatgtacatgacggaaatggtccttccttaacatgaaagaatttttgtgctgttttgcagttatgtacatggctcccctctgctagagaacacaatgccatttgattcacatgattctgctgaaaaaactgctgaagctttaggaagggtcttgatactggaccttgtactgagaaatgaagacaggttgcgatgccgcccccttggttggcggggaaattacgcaaatttacttgttgccgacaggaatgcttatgcaaacctcgattcattagatgatgtttatgattctgcaatcattcgttacaagccagagatcatcagaagccctcagaatcggaagccgagaagagcagtttcaataagtggcagtattggctcagatacatctgatctcatgtggccggacaatcctagtcagcctgagatttccagctttcacatcatagccattgattcaggtgttccacgcagaccgcctgcttgcaaacgggcgaaagatcaagagagctatcc

SEQ ID NO: 62205 - DNA, 4748 bp, Oryza sativa
gcatggcgtcgatcttgtccccgtcttccatctcgagctgaacaagtttgcaatggtcatcagtaatggattggtgatgatttgctaggctccgcaaatactgaattgagtatgaagagaagataagctacgcacctcgtcaggggtctgctcgccacggagcctacgaccatcaaataggaatgcaatagcattcatatccacagactgacggtcacaataggcgttcatcagcttcttcagctgcgtagatctcttgatgcggaagaatacctcgttcccatcctacagaacaaaggaaattgttaacgaatcgagcacaaaaaaacacaactattgtcaaataatttctcattcgagagtgctgcataaccaaaatatcatgtacagaggaaattctgatgctcaaggggaaaaaaacaaaggcatctgaagttatggtctctagacttgactgtaacttgtaagatacgtatttctactgtaaactgatatatttaacaaagtacgctctcgattgtgccacacttttcaggaagcaaaagattagcccattactgaaaaatgcagtacgacaacgttcagaacaatagttgcatgcaacaaaaacatacaatctgttgaaatgaatgagcgagtgattcttccaactattgctacaaattcaatagaccagcatacacattagcatgaacaacagaagagttagtgaaggtagtattaaccatacaatccccacagttcataaaacccacagtaagtttttacaaggaatactgaccacatttttacaagatatcatacaagttaaagaatggaagatggatactaatttgcaaactctagcagattaaacgagcaatactgaccatatttttcatcttgtttgctgaaaagttagcatttttatggcaaaaatcaaaaatcaaaatttcagtgtcctcagattgctggcatcaaacctgagtttatgtaccctacactagcagtgttactgagttaacattattgtcaaatcatctaaaagatgttgctgcaaacttaggatgaaagtaatccaagctcaaatccttccataaataaaacccttatccataaactccgtgagactaccaagcgctgatgatgctcattcaactaaatacgaattcccattataaatccacaggaaactcatcactcaacaacctaacaaaagatcgattcatgcataaattgaacttcacactagcatcagcacaacataaaacaaaacgttccctatctggacgaatcaagcaaagtcaaaccatcgaaccaagtgcttggtcgcagccacgctaatagctccgcaaagcaatccgaatccatcgccgaacataacaaccgccactatatcgcttgcgggcttaccaatcgaacctaaccctcaaatctcaattctacaatccatacatccactatggaacaaacttactcctatgtactactggataataaggctacgagtttgagagcaagaagagaggcagacctgtcccttgaccttgaggttgatgtgggcgccgccgccctctccccccgccggcttcttgtcctcctccccggcggccgacatctcgcacgctcgctcgctcgcacgcgcggcccgacgctggatcacgcttgagctgtggtggcactggcgagaggaaggagacgacgacgaccctgtgctggtgctggtgcacgggcggacgcgatggctcatatagcgcggcgtctcagaagcgcatttaataagtcggcgtcacgtccggatctatcctgcgggggggaaccctgtgggccgcgccggattggccggcggtgtccggggcgccggatcgcgtgtggcccgcgggcctcgggtgtgggccccgcgtaacccccgccgcgtactttgcacgcggaccgggtcaagccaagcaccccgcccgtttctcccttttttaatggaaaaaaagttgtggtgttttttttttgctgcacagaaataatttggactttttggtttcatcttatccagctcgtgtgaacacgtgtggcttttcctcctcctcgcacgaacgggcggtggatttgccgcgaatatctcggccactttttacgaaatttcggttcgaatttaatattcgcgagcgaagcgggaaacaaaatgcaacacgaaaggaatttttatctttttttttctccggtgagaataaacggaccgagctcttcgtgaagtggccagcttgtatatatggccgttctttttgctcgcaagatgaacaatggcatatcgcccgactcgtcgtcgtcacggtgacgccaggatggccgtacgtcatattggtgttgctggccgcatctccaccgttgatttggtcattagaagtcgtgcatttgttttaccgttgcagataagggcggttttggtgcaggtgcagctcatgcggacggaaattttggtgttaaggttaacttgtagggaagcgtgttgtttttggttaagctgaaaaatgtagcatcatgtttttagcaaatcagtttttattttagatagtggatggtggttatgctgtttctggtaggcgttaattttgtttgttatgataagtactcccttcgtttcgaaatcttattcaaaaacttttgtaaaatatgtaaaattatatgcctatataaaaatatatttaacaatgaaccaaatgatagaaaaataattaataattacttaaattttttgaataaaacgaacggtcaaacatatgctaaaaagtcaacggtgtcaaacatttcgaaacaaagggagtatgaaatgtctatatatgcaataatctcaaactcacgcgagatcaatcactctgcatgggcccagtcaggagtggctttcgttagactgccggtactgatcatgggcttatggaccaaggcctagtatgcagtttaatctggcccatcttgcagttggacttatggcccaaggcctcgatgtacagtttaatcggaccaggtatggcctacctggcagtgaccgtgtccgacaccgacctcgcggcgacgcttctagaaaaaaaaaaaaaccctctcgaaaccacaagacaccaccagagagagttcgccgcgcttccgcgcgcctttcgatcgagagcagcagcagcgatgccgtcgccgcgccgggccgtgaatctccggtggtcttcgttggagacggaggtggaggcggcgatcgcggtggagggcgggtgcggggtgaacctcgcgatggtcggccgggcgctggggctggacccggccaccgtccgcctcaacggctacttcgtcaaccgcgggcgcggccacgtctcctccgccgtcacgtggcgcgcgctcctcgacttcttcgccgcgcgcgggctgcccacgggcgacgcccccgccgcgcctgtagcagtccaaaacaagccaaggcctcctcctcctcctcccccggtgtcaggtatgcgcgcgcgcttctccacgaaccgttggttttcgaatttcgattcatgccactactactgttacgagatagagagaacgatttggctggaggtttgtgagcttgctggttttgtggcatcgattcatgtgtttgcatagatgaaagttgtattgtaaagtgcaggagtcaagtggggtgcctgataattttgggtaaatttttttaggaattctggtactctggtctctggagcatgcatattgtagaatgcagatagaagttgacacactgtcacacttcattctggaatttggagtgccaatagcttatttctgattctcatttttgtagtcttatgaagagtatgaacaataggactgtaatctattttcaactctctttttctatagtgaattgcaggaactgcctgcctgtcccctcgaaaaaaattgggctacttggtttttttaggctgatttatatatcaccaaataatattgaggtatgaaaggctggtgctgatatggttgagccgttgagtactagacagaagaaaaagcagagttcacagtatttcctcactttctgttgaagtttgctgtattgcagagttaagtatgctaggcttgaacaaatttgagtcaacttgataaagactacaatgtaaaatttatatggcattttcccagtgcttcagtttcctgaaaacaagtcaagtttcaattccttattcattttttttcttagcacaagaatattcagtgatatcttatccacttaattctagaagaatgcctttgcattgtattgaagttcatttcaaaaaatagagtctaaccctgcaaaatatgcttctcttcagattgtacaatcaatgtttgcccaaagcggaaatttgggttggtttcagattgtacaaccgagatctgtccaaagcgaaaatttgggttggtttcagattttacaaccgaggtctgcccaaagcgaaaattcgggttggcttcagattgtacaacagaggtctgcccaaagagaaaatttgggttggtttcagattgtacaaccgaggtctgcccaaagcgaaaatttgggttgtatgctggaaaaagtcttaagaagagcaagaattccgaagatggagttctgtctagaactggggctgatatacttagcgatgaaatcacccttggtttgaagagaagactaaaattggatgacgccaatccagctaagaagatgaagcaaatagaatgcaacacacgttagtgacaaagctttctactattagataagaacattttct

SEQ ID NO: 62206 - DNA, 12411 bp, Oryza sativa
aaataaattgaaaacaccaaaaaaaaaaacttgatatcataggtagtagcagaaagacttgatattttgataattcgtggattaaaacgatcattgaattcatctgcaatataatgtattcaagcaaaagagaagtgtaagaatttgtaaccatgcaaaatgaaatgggattttttcgcaggcacaacgatccttttgctctgctactactgatatgctttgacattaacatccaacaatctagtggagaaacaaagatgaatttgcattgtttggctgacacagaacgggtgccgatggagccacggaggagcggtcgatgcagcatcgccggaggtggcagtggcagtggcggtacgtactccctcggcgatggccttgctggcggcgcgctgcacgtcgggcagctggtggtcggagtctggagtggagacgacgggggcgagcgggacgtggagcagccaggcagagttggcgaagtcgaggctggcggaggccccgcacagggcgagcatggcggcgtcgtgcgcgcgcggtctccttgacggtgtcgaacgtgccaacccagagacgctcaccgcgcgcggctgcccgggaggccgggacacgcaccttgcacacccaccggcccgcgcacccacgccgccgaacccccggggaacactgggtgcctcgtctcctggaacttggtccgcgccgccggccgcttcgacgacgacggcgtcgccgtcacggaggaggtcatcaattggctggtggcggcggtgttcttctccatggcgcgtgcgacgtctcaagcagttggttggtgttggcggcggcgacaacgggggcgagggcgtccgcgcgtacctcctccgcctccccgccggccacagccgcgcgccgccatcaccgacggcagtgacttgatggcgtcgtcgtcgagtcgatctcagtgatgatggccacagccgcgcgctgacatcgccaaccgcacgagagggatgggaaggccggcgagctcgcgccgccctaagcccgcgcgccgccaccctccagccgtgcatgccgccgcctgtgcgagagcagagagcgagagggagtaaaggggaaagatagcatgtgcttacgtggacacctaacatgtagggtccacgtgggtcccacgctgactcagccgtcacctgggacaaaactggggacagaaccgctgaagaacctagtttgcactggttttgtacgttaagggatacgttgtatccgattttgcggtcaggggacaattttgtaattcgatgacaagttgagggaccttcggtgtactttttccattgttttttttttgtcttttttaagggtctggtttcactgtttcaggcagccttgaatgaagtttatttgttacaagctctgtttcaaaatataacaaattctagcatttaaagtttatcttaaaatataacaacttcttctcctacgttcttttctcgatcaatcacaaacttctaccattcaaattctctatctacatactattctcaatcagtaataacttttcatcaccatttaatttcactaacatttttaatacatgtgtctaatgttagaatcattatatttatttttgagcggaggtcgcagtggataattattattcgttttgcatgtgcaaactgcaaagccctctagttttggcatgtctccaatccatgtattgatatattatggaaaatgcagtttgtaaatttaaataatgtgatttagtgatctaattttagtctcgaatgtcaacaaaatgtctttgtcgtcctaattatcctactctatttcatactaaagtttaaattaatttttggagctagagacatcaactcgaaataaaaagaaaatccttgtagtttacattttttttcaataggtgttttatatatgattctaaaggaaagatagacgagggcaatgtagaatcataatatgccatggattgtctgtggtaggtaacgtttcatttacgtcatgaaattttttaatttatatcatgttttgaaatctatgatgttgacatgacggaaattcattcatcacctattgtacatcttctttgaagaaaatatttgttttctgtcattgagcttgtgatgacccttctatcatcattgagcttatgactcttattttcatcactatcgaacctaagaaacatcatcttggcctataagggcaatatagtatcattttggactatgctcaattgtaagctcggctagaggtaagcctagtccatctgaaacatagcaattgacacactgttgacatgttaagggccatgtagtgagcaatctacgtatggctaagtccaattgcaagtccggttagatttaggtctgacccatataaggcatagcattttatacactacttcaatccaattcgttaatccatttgcagtagtatcaaatactcctgcaaatggcttaacgaataggctcaagcattttatataaaggttataggccagttaacatctaataaatcctagtggacatctaatacaatggccaacctagccacacgtcctagcaggtttactaacaaaaaaaaacattataagttcactgaccaaaacagaaccggttcagtaacatcagcatgttgaccatacatgcctttggtagcaaaataaacaggtccaatacatcattgaccaaattgagccacaactcactgaccaaaacaaagtcatgtccagatcacaatcttattattaatatatggaaattacttggaaaaagttcgtgttttggggggtaagtttccagcatatatgaactttcttgtgtatgtattgccaaaattaatgtactctgattaggatccccataacctattgtatgtacaatattatggtttccattcattttgtttgttttgcaaggctgtatccctaaaggaagggctggaatgaacatgtgtatcattaaagatttcaatcaacaggtagcttgccaatcccagtagatttgcgcagaccgggatattttattccattatctaaaaaaataaaaataaagtaaagatgggctgagatgctcaatgaagataacggaacgcaatacatgttgtattgtatttatattgcattcacataaaaataaagtaaaataattaatacataagaacatccaagatatagaatagggtacatatttccagagctgcctaaccctagccggttacaggatggccagagcaccggccaaccgcgcattgcatcacatgctgcagggaaaatcgacaaaagtttgaccgtgtgcctgtgtacaatacggcgtcgacattggcactgccatagtcaccggtgtggcaaatgggtcgagcgtcaagcgacaagcaatgaagacgaacagcagggctcaggcaaaagggcacgtaatcataaaattagaagatgaaatgacgatcggttgcatcatatttgacttggagcactttatttatttatttatttattttatgaattgttttattgcctagcaggcgatggataatgtgagtggccaatactaactacaacggaaatacatatttgttttaatattatagagacacttttttaaatgccttgtagaggcattttcaaaaatttctcataagtaccttagagtgaattgtctctgtagaggcattttataagatgtctttatgtcttgtggcatttttatagagatattcttttgtctacaagagtgtagaggtattttctagagacattaaattataccacaaccatattaaccaatgtaaaaaaagagataaaaatattttcccttgctattaacaatccttgtgtttataacctcttgggtaaatcatttttatcttccatacactaaccaactcaatttcatgttatatttaaacatttgtgccttatgttatttatatctattacttagtatatattaacattataaaaagtgattctatagagcttaaaatgcctcaaaaaataattttacataacatgcagtttttataagtgccaaaagaatgactctataagataaaattaaataaaatatactgaaaatatcttgatttcaaagtaccaaaagttttctaggcacaaagtgccactaaaaatataactacactataaaactcctgattttaaaggcaattcaaaaagtgtctctacaaaagtgtctctctatgggggttttgttgtagtgactaggagggagttgtcgtaactttgccaaccgaccaaccctgtccaatgggtatatatgtccacctgtgccagattggcacactacatggatacattaacatgaagttaaacctgatagtcagcaaattaaagtgtctaactggtgtttgtctaccggcagttcatttttttaaggcttcaaagaacagatggccggtatttttttattcttgtgttctaaaggagtacttgctaagaaacccacaaccggaatagaaaccagacatatttaaggtccaccccacatggcagacacaccttttatcttatattgcaactttgcaaataatcaaatacatgttttacacttattaaaaaaatcacacccaaaaaatctctctatacatatttgtgaattgtgcgatggctcgaatggagctaacgtagattccttttgtccttattgatcaagaccagcaactatccttctcctcgaagcaatcaatgtttcaatctcgttccttgttgcatctccattaccagatctccgtagagtcgcaatttgcctatcgatgcttctcacctgtatagtacaaataaattaaattcatgtaatcgtgagaaagtatttctcaaagtttaatctcaaacaatattttaaataaatacgccatataattaaaaaataacggttttggtagagtgggatttattctcagtgttatttcttgctaatatatagacgacaagactttacaagtgcacaacatagtgttcaacatatttgtttttcttgatctttgtcacaaaatagattgaaattaaagtaaaatgatctagctgacctttcgatatggccagcgtaatacgccatgtttacgacagatgcctttgagagcagtggcacatatatccagctttttagcagccttggcgatgggtagttcaaagtagggggcaatgtcgctaagctgaagctgcttagttttctccctctagaatagatcaaatttagttaataacagtacacatatagaatagtaatgcttaattagaagtattttttatgtttttcatggttctgatcgattgtgtagataactggaatttcttatagtaacttttggtgttttgccgtacctccatagtgtgttgacaagaggtacacagattaatacacataataaaaaaaaatattatgccacctctcagtaccttctcaatcccctactcatcctagctactcattttcttagagcatatcatatcttgatatactttattctcgaatagatgaaatgcatcttaatattttttttacggggaaaatgcatcttaatataactgtagtaaaacttccaaatcttaaattattaataattaatgtaaaagtgttaacatacatattggggtatatgtgaaaatgatatgagtggatttgccataaaaaacacttttattcttacgtttaaatactcttttatgaatatatagcttgaaaatgtgacgatgaaaaatgtctattaattgaagactgtgttgatatccaatatgtcgtagatatacagcatcatttttttctttttgtttccctcaaattttgataaccattatttcttcagttacccagttaagtaatagagtgaaaagagtatcattagatctatcatggaaagaaaagtactttaagaatgcctaatatatgtttgtctatctgcacaaatatttgtagagaaaagatgagtagttcaataaattaaaagtgtcaactctatcatatatttaaaggcaaaatttgctacaggacatccgagaaatatgtaattagctatgagacatcgtaaagacgcgactttgcctgtggacactccaaaagtatggtaatttgctgtaagacactagatgtattaaaatataatattcacccaattgatgattgagaaataacataaaatgacagttttgccctattcttattctccgttctctctcggtcttcttcgacgctcctctcacactactacaggattgattttcttggacgccacccccattttgtttccatgcggtccgtaagttagaccgcacggaaaagtggggcgagcgaagccaggttctcgcccgcacacgaaaatcaattttcgtgtgcgggtcacttaacaggcccgcacacgaaaataaccctattttcgcatgcgggcctcctaatccacccgcacggaaaaatagcgtccctcccatcctattcaaaataatttaacttccttctcttccccccggccccttctctcctctctctctcccttatcttctcacattccttctcctccactcattttcctctctctctcaccttcttcttgtgcctacttctccacaggatggacggcggtgagctcggcggcggcggcggcggcgcaggcggcacgggcagcccgtggctcctcccctcccctcccctccccggcgagtgcgcgggcggtggatccggcgggcaggcgggtgacgacgggcggctgcggctcctccccggcagcgacgggagtgcccgtccctgcccggatccgacggccagccgccctccctccgccatggatccagcgcaggagaccggcgggagcggcggggacgacctgatctagggttttctgtttttttctgaaattttatttttttcgattttttgtttttgcatgcgggcaatataagcacccgtttcgcgtgcggttgcgccaccgcacacaaaaatagcgattttcgcagacgaattgctctagacgggccgaagttccgcacgtgaaaatccaaatcgactgcactggaaaactatgtgtgtagtagtgtcatgtccgcaccctgctaccagtgaaatcgcaagccacgcccgccgccacggagagtcctccctgacacggtggaaggagagcacgctgaggagctagctggacgtaccacgcagatgcggcgcgcctggcgccagcactcgcgccaagtcgccagtcgccatagggcgcgaacgcgacgtcgcgcgcggccgtagcgcgcgaaggcgcccagttcacgtgcctgcataaactcctcgatcggccgcggatgccgtcgtccgagtcggagcagcagctagcatcaggccgtgcgccgtggcgagggaccggagcatgcggcatgcagcgcgccaagtaggtggaggcgaccgagcagcagcaggagtccccgcgcggcaacgtgcagcaaagcgtttgtttgcttggttgtagccgcgcgcgacagcaggctcgatggatggctggggcagcacgtagctgacacgtacgtttgttacgttatagcctagcaactccggccagcaaatgggagcaagtgaactacgtactccatccatttcataggcaactgagaagcatccaaagaaaaccgaggaagggagaaaattgttattttatatcgtttctctctcatcaattgaatagatattatattttaatgcgtctagtgttctgcaacaaattatcattcttttttaagtgtctttaggtaaattcacgattttacgatgtcccacagctaattatatatttttttaagtgttctatagcaaattttgccatatttaaaagatagatcggaggtactatattatacgtacctggattgcaagtgcactcctggtagcgagatggaagcgttgttggacgtgatgactggtatgacttgcttgggaaggccctgcaaatacacaaatgtaccaaacatgcatgatggggttagccatggcaaagctagctaggtaattcaactccagaactgaattttaatcgattcatgaacgattatttagcaatgtgctccctccgctccattttagaagatgctttgactttttttttctaaatcaaacttattttaattcgataaaatttatagaaaaatatatcaacatttttcaacaccaaactaacatactatcaatttccagggtttgatttttattacactacttccaatcggttgcttgaaagaacagtaattggaagccaaaacttttttagggtggaaaccaaaagaggttattgtgcccaaagtttgttatattattgtactttgcgtgaaatatatgtgatgtacggcatgaattgaattaaaactcaattgcacaaattatagaaaattatttttttgctaacatgaaaattgaaaagttattaaaacaaatagaattaggttcaatagaactaatctagtgttataagagttactacattttcctataaatttgataaattttaacataggaaaaagttaaatcaacttacaatacaaatatataatataactagctaaatgtctgtgcttaatttgctatggataaaagaaaaatcacaatattttctaaaataaataaaacacattttccataaaaatatgttatccacattttttggaaaatgtggctaccaacattaattttatatgcgactatccatttagatttagttatttataatattaagaagtgcaaggagtaataactaaaaattgtaataggagtagatggtatgacagattcactatcattggagctagcctttaaatttttgaaggagtatagattaagatcacgatcgaaattgcactacgtacatgtgcagaatgcaacctgatgctggcggctggatagcagtagtgtctaggacgacgagtcgacgatcaccactgccattgttgttagttgttgctgcttgatctgctgccacaaggcaacgtgatgattctagcattggcaggacggcagcattgtggacgacgagttgaccatgatcaccattgccattagttctttcttctgctgctgctgctgctgatgacgatgctcttctatgtgcgtcgtcgtcgccgacatggctgctgcaaggcgccatggtggtgcagagggcgtcgtggaacgccgacagcgagtcctgcacgacggcgaagccgccgccggctcgccggagtgcgtactccgtcaggtactgcttcacccagtcgtagccccgccctctgaaactgcgattcattggatggatatatatagtggattaatcaatcgatcagcttgcatcaaatcacttgcatatactacctccgttttaattagatgataccattgactttcgaatacacttaaatttgatcatttgtcttatttaaaaaatgtacattggtatcatttatttcattgtgagttgttttatcactaaaagtattataagcatgatttatatcttaacatttgcacaaaaaatttaaataagacgaatggttaaacgtgtttaaaagttaatgaagccatctattcaaaaaatggagagagtataagatttaatcaggacaagaaatctagagaaaataatgtcattttaggtattactttgagttaatcaatttactcgggtgatgatcttacttgatgatggagtgatgtgccagcgccggagccggggccgaggcgctgacacggtacacgtccagtattgcatggtagaactcaccactagcgacgccgccatgaatgcaaagcttcgtgatctccaaccctagaagttcataataagaacaaccagattaaagcgaagtatctcgactaatgtttggtacatatcattagcattttttttaatattaattaatgctcatcccattatttggcattatttgttttcatccatgatcaacatcgagaagatttaatgtgatgtaccattggaatgcactacttctcttagcacttggcaaccactgcaatagtcctcctgcggcggcgccagcgccggagcggcggacgacgacgtcgacgcgccaccgtactcgccgtcgattttagagcagttattaccaaacgcggtcgaccagtccacaagatcgtcgacgaaggaaccaggcttattaatccggccgccgccggctccgtccacgctcatgtgcaccggcgctggcgccggcggagcgccgtcgtcgtcgacgtctccaaggacggagagatcgagcagttctaacacgtcgaagttgtccaggagcggcgacgggaagaagtcgagttccaagtgctccccacctccatcggcggcgccgttgccgccgtcgcccgccatagccgccggcgaccagcctgacggccgcttcgatcaccttacgaattcgatcaagggcggccggaacggcggcgcgccgtgcgcgagggagcggagtggagatagagatttgagggggcgcgagggcgggagtgaaatggcgggagatgtgtgtagagatgagaaggggtgcgacgcggtggagtttttttttagcggttctgacagttatttttgtcggcggctatcacccgttaacggagatccttactgtctagtatgcgctattctttttttttttgactttgtattaggactgataaagtagggacattctattttttttctttgtattggtttgtgtgagatgggtgaaaaataaacttactttgggatggaggaagtaacaaatatcaccaaagtcacaggaaaaattacacatatactttaaataatatacacctatgtgtagtgttaacctcaaattcattttattttaacttagagaaacaatattacttatagttttaatagtatcaatctatcaatgtttttttattgatgttctctatgtatgaatttaaaaattggattttacaggtagatgtaatactattgaaagtacatgtacaatattttctaaaattttatgatattgttgttgtatttgctagttagtgtgtacggtatcacaaagatttgtgtgtataggatactttttggacatacactcaacatgtgtgtttattgaagtgagtgtatgtatgtcgtgagtgcttacgatttattttgttatccatgtccactgaaaacacaaatatatattcccacaatccccagaattcccggaatggctcacacatttcacatctattcacgtataattcacaatcacataaattccaagcctaagtaatttgcaagtccaatgaagaattggatgtctcacacttagtaatccaaatgataccaacatacacaacacatacataggcatcaaaaattgttttgcacaaaatatataaacaaatttcacttaatcaacagtttttacacaaacatttaaaattgtgcccctatcttgaacggatggtgccttttggattgatgagttcatccagcacaaaggcagcggctattcctactctaatgttatagaagttgtcttgagaaatattcttaattgttgcttgtaatagaggcatcaagttagaattataggcgcatcatgttagtacgaggaaattttttggcatgatatagatgaatgcctatcatggttatggataccacatacccaatagtaatcgactaagctcggtgagcccaccatataccaagtcttatacggaaccataccttgtatatagaaggaattccgaataaggaatgacacacagaattctacatagaaacgacaggaactacttggattgtatccatattggtctccctagttcaacttagatatggggacatctattggtataaatacaagacccctaggaggagaggaaaaagacatagacacacaagccagaacaaaccaatacaccgccaggcatcgacatcagagataagcttagacagacccaatatggtgcctgcggaggccaacaagagggatctagtgtcatatctgatctcgatgagttcgtactcgaggaggaagactaacctgtcgtcgactacgtgttggttatctatgccgccaagtcgacgacaactagataggttatttcaaatattgtacttgtgcgattctgatgaatatagagcaaaaccggctttagccaacaggagtagggctattacctatcagataaggggcccgaatctgtataaaaatccttatctccatctctgtacctcaatctcgaatataccctagtaccaacgatctccataccatgcaaataccgttgttgcgacctcagacgtcgacaatgcctttgtgacgagaaattggacattgtgccactgccaaaagagggtttcgctcaaatgctactacgcaaattggtttcgttaaaaagctactcccaaccgatgcccaacccgttgttttgcgatattcggcatttcacatgatttccaccttttttt

SEQ ID NO: 62207 - DNA, 21003 bp, Oryza sativa
  unsure (1)..(21003): unsure at all n locations
cttctaaaagcaacttgtaatttgcattttgcagccgaaagtaaatgcattcagatactaacttgttaaatatcatattatacgcataaatattgatcgctgttcacttttattatttttcatgtaattcaggacaattttatgggtcttttaaccttgtacagtactggtgtattgtgttattagggtaagttctacttagcattttgcactacaggagaagtgatctttactgggtcggctgattttcataatagttttggttctaacaaaaaatgtttttagtcccagttaaagaaaaattgatctttaatcccggttggtgttcttcagtcccggtttaaatttttttgatatttagtcctggttaaaaactaaagatgatatttagtcctgattcatcccctgtcagggggccgaggagctttagtcccggttgataccaaccgagactaaagatcaccactttagtcccagttggtactaccaaccgggattaaagattatttagatctttactcccgggactgaaaatccatctttagttccggctggtaactctaaccgtgagtaaatatttctctaccatatttgttcggttaagtcccagacgagactttcctcctcaccaaaatatctagataagattggatttgagagcctccaacacctcagatcccttcctcctctcgtcccctcccctcctgtcatccgcggcagcgggcaggcggccagcggcggtagggccgcgcccggcggggtgagcagcagcaggcggtgaccgtggtgggcgacggcagcccgcgtagcggtagagggaggcggcggcctgtgcgtggcgggtgacagcggccccgcgtggcgacggcgcggtggtagaggcggcgggcgcagggagaaggcggcgcggatgggaggcggccgctgacggatttgtggatttgtggatgattttgtgatgtaaatttgtggatgattttcagatatttctatgaagttacaaatgaatctgtgatgttgaatgattttgtctgtgtggatgaatttattattgacttcagtgcaaaatcaatatgaaagtagcaaaaaaaataaaaaaagaaaagagaaagagaaagcgctacgtggcgcttttatttttactcccggttggagtctccaaccgggactaaaaatccatttttaatcccggattttttcttccggttcgttacccgggaataaagggggttacgaactgggagagatgtgcatctctccagcagtgttggctgagaaaaaactagataagtcattagcgtataattttaatcaaatattagttattacaaacttaaaattagattaatataatttttaaagaaatttctatataatttttttcacacaataacagtttagtaatttgaaaatcattttaaagaataacgagtaaattatcgtttcaagtcactcgaaacgctaggaccacgatttggccagacctaacaccttcacctgttcagtccaggctattagacttctccctcagtcccacaaaatatcaaaccctataatcctaagaaagtagtggagagtaaaaatgaccaaaatacctatcattattagaaaaagtagtaatagtgataggtaggtatagggtatttaagggataaaacttgtcgttttatatgctgagagtagatagagtgttagaagttgattttttatgagataaaactcaaattccagaagttgagtttttttaggacgaagggaatatctctggagtcgagtcgatttagaccagcgaaaacccatagaactacctagtcttttctgacccacgtgatacaaccaaccaatcatatataagggcttgttaactttgtagccactttttaccctactaaaatttgccacatttgtacattatcaaattttaatactgttggatatgtttagtttaaaaccttacaatttgagggaattttcaatagtgaaatcttgtaagggcttgttcgttttggaggaaaaacaaagaatttggattcctaaagatcaattcttatgagtgtcattcaatttatatgattgaagtataagaaaaccaaagaaaaaaaattccttttctacaagttatatagaggaaacataagaattattccatccagtcaaatctcttagaaaaattccaatagattgatgtgtacaaacatttatattccttcatttttcctattcctatggattcaaattcctccaaaccgagtaagccgtaaagttaccaaatattggtaagatagcattgctatatatgtataagttcagttttttactttatcaaaagagtaaattacacccacagtacaacacgttgatacgtgggttctatttaggacaagaagaatgtgacgtctaaagtgcaataacttagcaagtgggtgcactttaatacaagaatttgataatttaatattttggtgcaataacttggctagatatgtgctaccttggttaatgagtgctatgtaagttttttcacgatgttaatatgtcatcacatagcaattccgtagatataattaatcttataatgtttgatgtaatctgtaagaatatattgttcacctaatttgcaccattgatttagatttttttttaccatctcaaatatcaactagaaaatttctacacagtaattttttttacttttaaatttttttactcagacttttagttactagaatgacaaagaaaatatgcttgtacaaatctacataagtttattaacaactgggtaagtaaaaactgtttacatatagccaaaaatacataattaagtttttacaccacttctcaagttattgcatcaaaatcacacccacctttcaaatagtcgtacccataaactcatttattaagttgttgtactacgttgcatccacttagcatgttgttgtcatagcatgcttatttctcaaattccttcactaaattgcaccaacttactaagttgatgtaccgtgaatatgcaatttactcatatcaaaatttaataggattggtagtaacgtcaaagtaagcaagcccataatccctgaatgaacgtatgcaaagaaaacctacggttcaaccgaagacctgaccgggtcaatcactggtcgggggataacactgcttatgcagatgatttataattacctgaaaattgccaaatgaaataatcaacatacaggagtactaaatatacactcgtaactagagaacctatcatatcggtgcttcattaatagcacataaatattaaggcaaatagttggtacagaaatactcaaattggcctctgtataatttctggactgtgaatagttctcactatggaaaagtaagccataatgtgaacattataatgaaggacgaagacgaatacaaataatacttccatgtctatcgaatatcgagaaggtaaatacaaaatgattttggcatgttagaacacaaaataatggaaaaaggatggtttgcgatgatataaggataatgtgagaaaatatatttttgatgatataagtaaaagagaaaaaaaggcacattttgtacctcaattatggtccttgttttgttcataataataaaaaagttagattatgggcctgtttaaatcccaccctaaaatattttaccctatcacatcgaacgtttgaacacatgtatgaagtattaaatacaggctgaaaaataactaattgtatagattgtgactaatttgtgagacaaatcttttaagcctaattgctccatgatttgacaatgtggtgctacagtaaaacatttattaatgacggattaattaggcttaataaatttttctcgcggactactggcagattttataattagtttttttattagtgcccgaacatcccatacgataccctatataatatacccgatgtaacacgctattacacctctagtaacgaaatcatatccataatgcttaaactatctaaattactgcacaattcacgaggtgagatgagttgtctgaatttattgactgagctatcagtctcagatgtctgaagctggaccataaggctataaataagaattcagaaatgtacacaaaccattagttcatcaaagaggatacagagagatacaataaatacatggttccaactttcaacagacatatcaataataacagaagtaacaccaataatgatgcaggatgctggcataaggccgacacagcaaacaccgatatgagatgtcatgtacccaaaaggaataagtttattcgaggtcccttaacttacaccgaatacgattttcatccttgaaccaaaaaaccggaaacaacacatccccaatttacaaaactagtgcaaacgagatccctcggtagtgctgaccccggttttggttgacgtgatgcctacgtggctcctttaactaagtcttcatccaacgtggcaaagacgtggcaatgtgatctggaaaataataaaaattgtaggcccacatgtcagttacaacaaaaaataattaaaatggaggggtccgcgtgggcccaacatgtcattctcactcccctcctgtcacatcctgattttcgtttcaggatttataaattatttaataaattattattagaagttatattaaatgttcattaatttacaagagaagttaaatgtgggaaataaaattttctaaataaaaagcatggctggatttaatttctattaaattctccatggttaattatattctctggaattttttcggatttttcggagctcaactcttaattttaaccatacaaagaacatttcagtaattattcacatattaaattaatcattaaatggtctgcttataatttttttaagtactttgagtgtccaagtattttcaggatttttcttgaaactatttgagcattggaagtatttttaacaattcaaagatcatttcagtgattattttaattggaaagttgttaaatcctctcctaagccgttgggctgatttcagcccaacatctctctccttcgcgcgcgtgctgtgcagcccaagtcggcccagccgagctccccttctctttctttctttcctttgtttttcagccagcccaagacgaaagtctaattgcgtcccgtatactgttcatcttcaagcttggacagaagcccgagctgccgtcctgtgctctagccgacgccgcttcctccaccaaatccgccgcatcccatgctccgcttgcaaaattagttgaggggaaatattcctcttatcctcctctatcttttcccccaagaatcggactttatcccgaagaaatcaacgcggaatcgaattcgttttcgagtttatctctccaactaaccctcggtttttccggcttcgattcctctcggttggagtccgatctcttcaatccaagcctataaatagcatcccctggtcgtcctctttcgtttgccccaactcccgagctcccccgtcgcccgtagagccgccgccgccttgctctagccgccgccgttgccggcgatcctccggccgcgttgcgctgccgcggtagccgtcgccgctgccgtccgtcgccgtcgtcgggtgcgcacggaggagaggaaccccgtccgccccttcgcagccgccgaagaccaccggagcgccatcgccgccgtcaagccgaaccgtgccgccattgaacctcgtcgccggccgtcgttcgtcgtcgtccgtcgttgttctttgcaccggtgagttcgcgtcgtcgtcctctacgcgtaggtgtcctcggatggcccaaccgagccctcttttgccggtggtcgtgacaaccgtgccatggccggcgatgatgacgtcagtgatgacgtcataaatccctttttctaggttttctttattagatgaaaatcgattaaacttcggaaattcataactaaatcatcgtaactcggattcgagtggttcaagttgctaaattcatctaaaatcaaaatctacatgttaaaaatatccacatgtactgtttatgcttgttttgtactgtttatttggtttttcttagtctttttcttcgttttgcgtgttagcttgtcgtttccgtcgttgcgaaggttcgtgagtgcgtcggaagtgttcaagaagattaattgaagaccgattattgcaaggcaagtcacacagatcctaaacacaatcctttgagcatgttgattctatatttaaattctctatttattttaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatgacaattaaggaccggttcgcgagctactgttgtgaaacattaaccgtaccaaccacaagccagcgtgggcaacggctttaccttttgtatagcatgattcattgcggggcatcagactgagaagcggcgagaagtccgtgggggtcgctggggagtccatgcctctggttatatttatagagggggtgattatgattcaggaatggtgcactgtggtgagttgtgttgtgcagggggtattgtcacagcctctattcgggtactttctagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacatctcacaaataattattgatgctataactggtaataatttgtttagctcctggtttggaggtttgatctgtacgaccggggttggttgttcaggtttggttgggcctgtgcagcattggggtgctattcagtgttgattaaaattgatgattaattactctactgttttacttctcttaaatgtttgctaaatgttgtcttcgcaaatgaaccctatattatgccatccttcggaatccttgtgcacttgcatatttgctgtgtggcttgttgagtatgtcatatgctcattcttgcaataatcaatcaacctcaattaaagaaaaaggatccagaaggagaagacgtttggcttataccccagttgagctgcctgtgggagtggagctgaagccatcgctagactgttattccgctgctgttttcttttcttttgtaagtatgtaacgttattattatgatggatttgtatattaaattatcagtttgtgtacctcggctgattcctggacgaggattttatgcacaaattagttcggaaattattagtgaatttccgggcgtggcacctcctcttctatcgcctctgtcctggcgggcttcttcctcctctatctccccatctcccctctcttcatctctctcccctctcctttctcttctcctctctctaggcacgacggctgacgagcggcggggaaagggcggtggccagtggggagaaggggtggtgcaaagcggccgttaggagaggagcaagtagagacgatgggcgtcacgcctagagagagaagacggtcggtggccaggttcctcgatgaggagaggatggaggtgagggagagggagctgatgagcttgagcgatgcatcgtcccatcttggccgttgtgttcttcggccgcaccctgtcggtcgcgctcgcattgatggcaacctctcttcctcttcccttatacaagcccgagagcgtcggtggcgcgatgcccagacaggctccagctccgccctcaccgtacgtcggaggaggcggaggaggggactgagccacgtcaggggccacaaccagaagtggatgggggaacgaagaggggaggagggggagcaaaagtgcggccctcactcaagtctagggcggtggagttgtgttagcggtcgtcttcttccccagtcgtcgtgcccgccttccatctcacggtgagtggctcgcccacctccatgcctcccggtgccacccccgctcgccagcctccccacgcctccgctatcgctcgctggcatgccggtcgatgcatgtgcctgccacatctagggaagaggaagaagttgagaggggatgaggtggaggaagtggggcccattgacatatgtgccccactattttttaatcttattatttgactgacatgtgggcccacatattttgttttatttattaaattgttaaattttgctttatgtgccatgtcagataaataccgagttaaattagccatgtgagcaccacgtcaactgaaaccgctgtctaaactggcttgagacttattttccactggttttgtatctggttttccggttgaaggacggaaatcagattcattgacaagttaagggacctcggatgaacttatttctgcccaaaacaaccttactgtttgaagaaaaataagcagagaagcccatttgtatggctggccttagccctttagttggcaaaagcccaaatccgtgttggatcatatacaaccagcttttgccaaaacatgttgtttctcaaaacatagtacgtattttgttctgtgtgcacgcttttcaaacatgttatttctcaaaacatagtacacattttgttccgcgtgcacgcttttcaaactgctaaatggtacgtgttttgaaaaaaaattatatatgaaagttgctttaaaaatcatattaatttattttcaagttttttaagttaatatttaagtaatcatgcgttaatctattgctctgttttgcgtgcagaggagagaggtttccaaccctccaacagaacatcatgtatataaacctaaccgttaatttggcatgttccttctacagcatgtgagcatcaagatagggtttctagtcagatggtatataaagtagtatctttcaaacttaattttttttaagaatgtacgatgctcaaaacacgtagataaccaaaggtcccccgtcatcaaacctagtaacccgtcagcggtatattcatctttatcacatactgtattaaaaaagactcttcggtcacaaaagcaattgccatttactaaccatctgaaatgtaccattgtgtatacagttatgaaatgtcatgccgtttagcagttaactacaccttggtatcaaaatatagtaatttttagctatatgtctgaaatgcttgtctagataaatagctataaattactatattttgaaacagagggagtaacattttgctttgggcaaaactgtcagcctgataaaacaaaattaatacttccaatgacatgacaggaaggatttttgagttttgaagcaatagggcattgcggaagcaaaagattatggttctggaagaaggaatgaggggaggggcggggcatcacttacctattgttggaggaagcgaagcgccgcctctgggtgaggaacaagcggaagatgggcgagttttcacatcatagatcatctccaccgccatcgccgcggcggcgctggtggtggtagcctggctcgtcgctcgcttgtctctctccggcaaccgcgaaggagcaagcagactgagttggagacatcggaaagatgatcaactagttttggtccgggcctcggggccgtgggctcagtgaagcccagggacaatgtcagattaggattgttgcatctgatttagttttttttttgggggggggggttgtattgagggaaagtgttgacgaaaaaatcgaacacaccggcctgggagatctgcttaactccagtgcaggtccaaatatgatgagatgcgggcgtgccagtcagtttgatcctgcaactgacaagttgcagatatgcaaatagtagatcaaagcagccaatcggctgacaagccgatggagtagttccagccgatagccgataatagctgatgccgataccagccgatagcgatagggtttaggcaatcggctatatgtacaatgtggataatgatataaaggcaatcggctgatgatgatgtaataaaataacaatataatccaatataaaccaatcggctagcaatgatatgataaataagcatcgatccgaaggttaaatcacacatcggctggaggtccgatgtcatgaaatccacaagattagattaaacagtgaaacctttgttgtcatcggctcaatacaacttatatgtatatgcaatccttatgagccgatgcaacgtccagataactcaccggctgaaaccccgatgaaacccttattggcaatcaagaagtaggctagagattatggttctaagcatgacttactagatcaaacttaactgatgcaacactaagtatgaaaagaaacatgatatctagacaatcaagccgttgactgagttttcagggtggtagatgtctaagctaatctaatctagcaatgcgatttagccgataccggcagaaaccctaaaacgagaagcagccgatagagctaaattgatatgctaagactagattaacagagacatatgataaataggtaggaaaatatatcatccaaaccagagcaatccaagaggtcgaatgtactgatgcagccttgaacgacgccgacgtaaacgatacaattgcctgggccggcggaacattggacttaccccttagctggagatcgaacaccgatgcagccccgcatcaggtgccaagtcacgccgaaacataaaaacaaaagtagaaatggtaaaaggtggcgatgcgccaaattgtattgatcgtagcgatagattacatagaccccgggtgtacatatttatacccatgggttgatacaagtccttgtcagacaagaaagaaactaacctaaagataaaaggaaaatgtaaagtccttatcggacactaaacacactttcctaaagataaaaggaaactaacaaactattcctaattaatagataaactgccatgccgcatcctctttaaacttggtcacttagggataagcttcctttagtagattgattttcttaaccgaatatagcaggaatcttactattggcgacttgataactcccatcggctgattccgagatgttgcagccgataatgattataagccgatgacgtctttgccgattaccaaatttcactgttaacagaaagagatatctttttagtcacattttataaactaaagttgtaatttgcattcttaggtcaaattttaaatcttgtagtttctaagcaaaccattgcgacatatttcgcctcttcttaatataatcaaggcagatctcatgcctattggttcaaaatacttttttaataaacttaattgtatatattttctttcgatgcttttcattgattgaaaatgcttgaatttttgtgtattggaataactatcctagaagtaataatgttttaatacaatatttaaatagctgaaatgcttatatcttagtatagagggagtattatttaacttcccatttgtacaaaaagaagttagatatttaaatttgaagacatgctgaattcaaaaggataactagaagaaaaaaggaattgctaaaatactcagatctttgccgaaaagagctataacttgattatacacttcacttccaaaaataaatagatgaagggagtgtctctagggtcaagcgggcttatttgtcgtccccagccctaggggcgatcagaacagcgactctacgtccactaccaccaacccccttcctcctatcctctgcatcaccatcacccgaatggcccgttggtaaccgtgcggctgcaaggaaggcagcggtgaggctctctcttctactctcaagggtgctattaggctagggctctgaggcaatcgtgaagacagaggtggcgctgccggatccgagtctccatggctagatccacacaaggtgaggccagtggacggtggagggccgagccaacacatgctgtgattgaggatggcagagtaatggtcatagaggtggcggtggggatgctagatcaacatcctattgggcagatcttatgtccttctagacggatcctgtgtgtctccagtgagaggtacagatccttgaaagcaactcttgatgacgacgagaacgacgtgggtggtgggcatatgctctgcagacatggcgtggtggccggtagtgatatggagagaggcgtaaaacggtgtagccacggtgtcaagggtggccgtgggcattgaaggccgacgtgcagcgaggaggcagggtacctggagtttgggcattcagcaaggaggcaccatggagtggcatgatacagaagtcgacagcgtgtggtcatccctcttgggtgaagttggaagaaggtagcagtgcaaggcaatggcggtgggacttgtaagctagtgaggcccatcggtggtgtgtggggaaactggaggtggccagcgtgttgacggcttgatggagtctagcggtgagaagggcacattgttctgtctcgggaaggggcatcttgcctgatggccaaccgacggtaaagtgttggtgcggtgattgtgagctgaaggttgttggtatttcttatggtcacatataaattcgcaagcgcacggatatcgctatagcatttcacccacgagtactcccaagggtatcgtatttgtgcttccacagcgaagggggtggtataaagatatgtttttttatatctcttaatcaacctttaattaattcaccatagtctaaatagtggttaggataataaatgataaggtagtggacacacacagaagattcacctctataagaatatctagtagggacttatcattaggaaactacgattcatatatacttgaatactaatcatttctagtatacacttaacatatacatgctaacaacataggacttagttctaggcacacagatactaccgagagaccactcactactagtctgccagcatggttatggcatttatgcattcttacgtcatacttgaatgtgtaggaataaaaaggacggacatggctatcaccacctgccacctacctcactttccgtggaggcacacccggatccaacaacatttatttagcctatataccatgcttgtgcaagtaaacaatatcactaactcccccaagactctcaccctacggatgaataagttggagttaaatcaatctataaaggttattggaccgttaccgtagcatggaccaatatacaaagtctaggatgaagcatatatacaaagtatatactattcatagaacatatattaaataaagaaatatataaaccatgagcataaataaataaagaagataattctattaattcaactataatcttacacaaagagtaaagtactagagacatacccagaactccaagaagactattggaccgaagattctaaactttattcctactagaaactgaatacaaagcggaagaggggatttcttctttgaggtgtgtattgcaagtgagggagagctccttttatagcactcttatgatggttatatgacggttattggtccgccagccgtgcataactgccatcaggtgcgcaggaggaggtgacacgtggaggatcaggctgagcggtgctagccaatgttcggttgaacacctagttcggtcaaaccaggaaaaccgcctttggcgagaggctgccatgtgggccccttagtcggtttccaggtggttggccccactttgagtcgatttgaactgacttgtgagtcctttaatctgtgtgctcgcacgtgattcatcggaagtgtgtttcttcacatgttgtcttcatttctccttcactttgatgtatattctctacatccacatttgtttcccaatcctaatacaactacattatttgttgttgatatacatgtaacatatgctaatttttcctttattcattgtactggttggtgttcaaaatttgtacttaacaatcgtcaacaaatgtgctttagatagtaatgactgttgttttctgttttcgatagggactcaacaacaggttgaggtaggaagattgctaggcgaaagcctagcccgttctggggcggcagcgatgatgctttttgcggtagcccaacccctgttagggcgctgttgtggcatatctcattcctcctgatggttttgttgggagaaaatcacgccctgatcctcaagacgggtgatggtggtagtgttgtcgcatcataaccttcttggaggcgttgtttgatgatccatttcctaccaattccatctccagacagttgtcctcttctggtggcgcttttagccagcacgatggccacgttggcgggactatgtgggcgacagatatattctttctcgccctcgccttctccaacacaaagcgtggacaaagttgagcttgtcgggttgttctaagctcctgttttttcttcaatacgtgtttgtgttgtggggttcacatccactgccattagaggtaaatggcagaggtaaacagtaaaacgtgagggatggtacagtgttttaccacagctacagttaaaaacctctgtacaaacaatgtaaaatacctaccggtagtacggcattaatttactgttaggtactgtagcgatcgatctcatccatccacatctaatctaacggctgaaaatggctcatggtagagagtactatagctgtctgccattctagtttcaatggtagaggataagttcccaatgttgtgggtgagggcatggtgctttttttttcctttttctaattataattaaccttccaggattatgttcttatataatttttttagggcctgtttggtacagttccaactcctaaatattgcttcaggagttaagtctggagtggagttgtggagctgcctaaacccagctccacaactctagtatattttgtgagagagctccacccaactctgcttccagttttggtggagctgaaactgtttggctgagctccagctccaggaggtgtggagttggagctggagctgtgctaaacaggctgttactgtcatattgacatgaaacttcgtaatatctacacgggtcatttttttttataaaacaggtgattgactatacaccatacaactagcactctagcagtcctaattcccggcggaaggaatattggccagtccaaaaaaaccctaagtatgttgctacgtacttgagctactatatagtttcacaaatggattttataggaatttcatatggattatattagtacttgagctactatatagttccacaaatggattttaaaggaatttcatatggattatattaggcgcaattcaaattcgtgcaataatcaaggaaaaaaaaaccatggaaactacccaaaaaaacaatggaaacacagagaaactatggaatgcatcgccaatctttggcaacgtacgaggattcaacccaaatcttgtttgactcgaccaccccaaaatcgccgtcccgctcgttagtccgttacaaataccctacacacgcggacacgcctcgcctcgccgatcacgccgccgccaacccgttccccccaccgtcttcggcaatggcgcctgacctcgacgacgacctcatccgtgcggaggccgaggccgcgctcaggctccaccgcaacggccgccgcgacgaggcgctgtcccgcgcgatggacctcgccatccagcacaagcggtcctccccgctcgcgctcaacctctccggtgacctcaacatggccgcgcaccgccggaaccgccgccgcggccgcggcgccggcgccgacgacaaggcgctggcggagaggcaggcgaagttcgccgccacctgctacaagatgtcgctcgacgccgtcccggactgcgtcgagacgttcgccccctatgccgaggccctcgtcggaccgggaatgtgaaagccggcgtgggacgcgttcatgcgcgccgcgcgatcgcccaccggccngacccggcggcgcaccgcctgggcggctacggccggagcgcggggctgacgaggggggagagggtggagatggccaaggcgaggctgcgccgcgccatcgactgctactccaacgcgcgctgcgaggacgccgtcgccgaggtgctcgcaaccgtcgagcaccacggcgccgcctccgccgtgcacggcgcggcgaagctcgccgaccgctacccgtcgtcggcgcgggcgcagtgcctcccggcctacgtggccgtggagctagctcgcgagcgccgcggcggcgcggcgtacccggcgacggcggccaccccgaggcacaagacgctgcgccgcgcgctcgccacgatggacaccgccgcccgcaccttcgaccgatcgctcgtggtcgcgctgttccgcgcgaagctgctcgcctgcctccacgactacgacgccgccgaggccgaatgccgccgcgccctcgccgtcgataaccccgacgacccggcggcgcacgaaatccccctcggatctgcgatcggagaagagtacgacgacatggtgtcatccctcaggaaacaactctgtgatcttcagaagaagcttgtcttgttagccgtacacgattgggcatccatggaaagcgagaagcaatctcagatcctctccgtcagcatcgacgaactgcgcgaacactacagcaagatcgaccaaatcgcggcgaacacagtctccgaagcgcggcgcttctccaagacacacggttcatggtgtttctggatttgcccgcgatcttcgggccaatgtgcaggcaagaagttcctggacactgcatctttgctggaacatctgcgcaataagcacccggacgatctatgggtgaatttgaagtcatttcttgacacaaaactgtgtggaaaatttaaaactgagaatgcatcacaggatggctattcatgccacgatgagatgttacagtttcagagcatagatggtatgatcgagctagtgttaaacctacctcctggtggaatgaaatcagagaccctgtcagagatgaggaggaggaaatgcagtgaattagctgagatccttgacagaatcaagaagaagttgagggcttgtcctaaagatttatcaagctctgaggtctgaaactttgagcatcgtttcagtttactgttctctccttgtgttcattcttgttttgacaattatatgctctaattatcacggtttttttgcattgcagtttgatcaggttcgttctgaaatgcaagatctgtggctgaagtttaccgagttgtcggttttcgattaccgtgaagcagtcgtgccccttgcgaggatgtatcaatgggttagcttttatctgaaattcttgtcttgtccaactatccaactgtaaaattgcgcatgccgtgtgctcgttgattaatttaccatccgtgcagaaagagttaaagaaacgcatcagtgaagatgggagcattattgctgcttggagtatcgatgatatatttggtgatgttcctgcagaacatgcctcccttgatgaaaaagttggccatcaaactggggagaacaaagtgacaaataaatcagataacttgaaggttattcgtgctacttgttttttcattttacgaaaaagcttttatgtgacataactccaaattaatactatgtgttaacatgtttgcttatcgagctttttgaagtcggagtactaatgtatcaaattctctgcttctctgcaggcatgagctcccaaacaaaaggctcctattctccaacacaaagaaagggccagctgcgacgcaatatcccgatctttttctacattatattttataaatttgaaatcttgtgtggcactatgaacgagtgggacatgagaatagtttgctagcttttgaagttagctagttagtgtcacggaaaaaatgagaatatcaattagcttacgattatttaagtactcgctctatttaaaaatataatgcataactatttttttaatgtttcataattcaatgcatgtgacatatgtaattaactattatatttatgtaatgtattaattgggatgattcaaatggggtgataataattgtttcttttatctctagtttaggatggaggaagtattaactataataaatttgagaaacaaatttatttgtttttttaaaatacatatataattttttttttcaatttagccgtttgataaatgtgctcatgataaacgagaaattattctaacccaacgtaaccttaggacgcgcagttaaaaccttagaggagaagcgtgattggacatgacagcaagaagatggagtgggggagtgatagtggagggcacgagagaggggattggtagcgatggaaccctattttcatgtaaaagtaagagtaattattttacattaggagggaagtagggcagggaaagagaacgggacaaggtgaagcacgggaatagaatttacaaatttttggtggcttgctatagtggatacattaatatgattcatactaaggcccccttttattcaaaggaaattcataggaattttagagaattttattcatataggaatttttcttacaaagttctttgaatcaaaggaatgaaccctatagaatcttatgaaatttctatggaatgcctcttctcatataagttttggaggatttttaacaagaggtggaacctcatggaagaaatccttagtctttatctctcctcaaattcctgtgtttttcctgtggtccaatcaaacggtcattcctatgtttttcctgtgttttgcaatcctctattttatacttacattcctatcagaatattatgtttttcatattcctccgtttttttcattaacacattagtttttactagcttttcatagcaacttaagaaatcagtaatatctcccccttgttcgtttacgaaccggacagagacttgaagagtttgcaacgatccgtgatatccaacatgtagtagtaatacttattcagtcccaaaaaatggctcttatccgagacgaactacaggccgacatctaccttaacttctccatatatttaattaactgaaccctaccaacgtaccttacaaacaaatcgaacaccaccgtatgttgtctgacgacccaggtgccatcgatctcatggcgccaacggaggaggatgtcaccgtgtcgacggtcagcaccacggcgaccaccggatgccatatgctcaagatcgacggctacacgcggatcgccaacatgcacggatggtgggcaacttcgtcgagtcctccaagttcaaggtggccggccacacctggagcatcctctgctacccaaacgggaggacgtgtccgggtttcgtctctgtttccctcacgctccaccacatcacccaggcccaggccgaggtccggtttagcctggtccctcaacaccactacgggctgacgctgccgttgggcgagccgcacgagaagaggttcacgagggtattctactccggggtcacggaggggttcgacaggttcgtcgttaggaaggagctggagaagtcgtggtacctcaaggatgacgggttcgcgatccggtgcgacatcgccgtcgtcaataagttggtcgtgaaggagcccgtggttcggccggccgacctggagaggctggggatggtttgcaactgcaacgacgatatgtgcacgctccaccataccttgagcttcgcccaagttgccaagctcaagtttttggagtttttcttagggtgctttcctctatgagagtttatcaatattcaatttattaatccatagttgatattgtattttgattttaatttttttatcaatgacgaagcataattgtttttcttttctctaagatccgcaaacatatatagagaatatttcagtgaatcacgaataacaaatccataatattagcgccaattgtatgtctattctaattttatgacatttgaaaatatgaaatcgcttgatttatgtatattcgaatacaaataaggcatactttgcacattccactacgtatgcgacatacccacgagtgcaccttatgacacacgatgtaatagatcgagcaagatctaaatcactattctcactaaatttcatttaaaaagtcaccatagtaagtatattattcgtacaggctgtgacataaacactgatgggtggagtacacatgtaacaccctgaaaattcgatcgacaaaatcaaaactctaaaaatacggattttcaaaaactttttaaactaattgcatcatgccaatcttattcgtctattttatctggatttgatctcgaagattattaatcgtgagtaaagaatagttaattaggaataaaccttaaaaacaaattggtaaaataaatataaattaaaaataaagattgggtgtggatagtaataaataaaatattatcgcgatcatatttggatcaattaaatttaattacgatggaataagaattaaccctaattaaaactcaaataaattatataaaaataaaatatgagtaatattaatctagggtgaattcattagttaagataatacaaatattgagtaaaatacatatatgtaaaattaggaattgtagaatcaaattcatatggaaaataaactaaaatcgggataaatagaaaaatacactggtcattatggcgtaagtgttcgatgtggaccctagccttccccctcctctcccacctatgtgctaacccgcccgagcccagtccgcgcgccgtcattacggtgncaccgtcaacgcgcgtagccaccttgcgccg

SEQ ID NO: 62208 - DNA, 15782 bp, Oryza sativa
ccgactagagggggggtgaataggcggttttaaaacttaatggcacttaaacaaaactaacctaagttgctaggcaaggtgaggtgcaaggttagctaagcaactaagttaagttttgcaaacctaagtgatatgggctcaaatatgtctctatgaatgtaaatagcacaaatgtaaatgcaacaaataaatgagacaagagataaggaatttttcaccgaggttcggaaactcgccggtttcctaatccccgttgaggcgagcccaactccaccgctcaaccacgaagccaccgcacggccccttcgtcaaggggtgggcaaggcgggagccggcccacggagaggactacccaagcctcgatcactcggggtagttcttccttcactccgaaggtggtgaactccaaaccactcacaaacggtgccgggcctcctccacaatctcctcggagaggtcaccgggcaacacctccacaagccgtctaggaggcggcaacctccaagagtaacaagtctaggatgcttgccgagtatgatcaagtgccacactagctataacaatgaagcaacgcacttggattggcttaactcactctctaacacctcactagataaactaagtgcacaagggtgtgagagctcttgcaagggttcaagataatgcaatggagtgccaaaaccttacccttgctgctggggagtgggtatatatacccccaaccaccaaaactagccgttggagtcgaaatacccaactctgtgctccgccggtcagaccgccatagagtggccggtcagaccggactactatgtaacggctagaaaactagccgttacagggcaatcattgagcccactcaacctggccggtctgaccgcagtgtagtggccggtcagaccgtccacggctcggtctgaccggttgcggctctgtatcgccaccaaaaaccagaccagtgcaacagaccagtggggccggtcagaccggccttaccacgccggtcagaccggctaacagacccggtcagaccggcctaaggcccacggtcagatcacaggtcacttttcagctcaaccgaccgttagtaaaacggcgatatctcttgactcgggtctcggaatttggcgttcttggactctatggaaagcttattcaaagggccatccaacccatgaaaaatccatccaagaaacacaacttaagtcaaggataaaaggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcacaagatcatccacaagctcgcttcatagacccctcttgatagtacgacgtctatctagcaaatccggtctacaccaaacaccaagaccgggaaaagactaagaaaacattcttagctacattatacctttgccttgctccatccatcttggggtcaagcttgagccgagatcaacacttgtgaccatccggttgaaccatgtttatgctgaggtcttgtccatcctttgtcaagactttattctcatcacaagcttgacttcattcttgccaacatgacgatgtccttggcttggtgaccactaacccatggtgtcattcattagcctcatcgtagtgggacctattccttttcacacctcaaaggagaacattagtctcaacaaatcggttgtcatccttcacttgatgatcaaacggttgcatataaaatatatggatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtattgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaatatcggtttatcatttatcaccaaagtaacaattacacaaattgtttaatccaagatctttcaatcttttctttctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaatccaaattaaggcacttgaacttacaccctccaaaaccttcgacggagttaaattgctctggttttaatagttgtggtcagtagttaaggaacttaaactagactattcccctaagaaatcgtcaggcccatacaacgaacagcccagcgacagaagaaagcgacaacttttaattggcctataactcctttcctcccttctcttctgacctagtcgtcgacccccgcgtcccccttcctctgctgggttcgcccgcacgcccgcccgcaccgccgcacgccgccggtcgcccctcctccccgccgacgctgagcaccgccggtccccgtcccgctaggcagcggcgccgccgtcctccgaccgagcccctcgccggtgagcacccgcgcgcagaccctctttaccattcctctacacccacgcgctttctccttgacttaaccttagctttcccttgtaaataaatccgggagattttctcccccttgtcttaaccctagtgctaatggatgtttgggggggttcagatgaaacccccatgcgtgacgttggatccgccgctgcgtaggaacatgtaggtaggggagttgctatgtgtgtggtctagggtatgagccgaataaaccagcggaaatggataatcggcttgttaggtccgccccctttgcataagaattttgtaggtaggaggtgctatgtatgtgggtctaggatatgagccgagtaaagctgcggaaacgattaatcggataattaggttgggaaatttcatagtttgcgatatcactttaggatacgccacagcgcctgttttctaaatgttgaaatgctacctattagtttatgatagctctatgcaagatattttccatcttcaagtagagggattttgatgttctcatgcaataaaatggcaaaacgcgatccaaaaagtatcttgatattgaagcaaaacatcaagaaggccagcttacagtgggttctaacaaacctcaatgcgcgctaataaaccctagacaaacctctacccgtgcgccttccaagatcatgaacaaaacaggtctcctgcggggatcaagtgatgcaaccaggaactaaccaccctggactcgcccccttcaccaaactgtagagtggtagaggcggcagcaatcttcaacttatagcagatggaactggcgaactgccatagtgccatctatctttgtactggggagacatgcttgatgacagccatgcaaaaacgaataaaacaaaccctaggctacaatagttgcagtatatatgacgcaagccctagcgtcttcagcaagaaaaacaaactgcgaatcgtaacataaacgtgtaggacctcctaataaatccattctggttttatgtggtactcacttttgtacagcggctctagtaaaccaactcgagttagttcatgtaccaaggacatgcactctatttaggaaataaatagataaaaggaaacgacaaaagctaaccaattggataactactagacacaactcttgtgccttcctatcttgcgcacgcagagataggatctattttgttcgattctgctcccagctcacaaagatatctactgcatgatcacctttgtgtcaatgcgtgctacagctcctttattgcgcatcaaaatagtgtggtctgtatactcagcccttggattgtcaggcacatttagctcaattcaccaaaataggaagaattccaacttgattaaatatgaaggtttcacatcaagtttctggtatgctagttcgattatctacgccttgcgcgttggacagaccacttggaccttagtgatgaggatgacttagtatcttggcctcttgggacctaggtgaatggaaggttggtgatgctgcctttcgccagtggcaaaatgtgtacaccaaacttgccatttgttcaaaagagaaaaatggaagtggaaaatattttgcaaagatgcccaaagtggcataccccagggctttgatgacaaaacactagacagtggcattttaacaattagaatggaaacgatgggttgatggcatatcctagaccgagaggctagaataccaaagtgggtggtggaaaatcatgaagtttccctattaggttgggtttttggattttgaagtgataggtgggtgtagactgagagcagggcataatccctagctcatacttttaaaagagtaaaggcgtattcaatcctaatagttggaattgtggtttttttatgttgaggtttgaaacttgcaggttcctgctcctattgctcaagccattaggttgcatcgaaacagtatgagctctcatgattttgcaagaagggttccgaagaggcggcggactaacaagttgctttcgcaacttcttccggacctgaactcactcccagctgaaggagctgatgatgggggatcaccttccagtagtgtgctcgtctcacacgcccagacttctgctgtagctgtggctggaacctcgcagtatttggtgccagcagttgttgcggggccgcacattggaatgagtagttgtcccattatcgtggatgatatcaatgatgatgttgtgatttattctgcaagctcgttccctcaagtatgatccttgtgcttggttcttatttctgcatgcacacatatttgttttcttgctcttttattttattatatgattgttcaagttcagtatgaaagaatcattgttgcgctgttgcttcctttatttttcaggtgaggcagcaggctccaaggacagaacctgttgtgaccatagaagatgattctgaaactacccctggacaagcaggtaccccagcacgtccttttccccgtccatattgttggcatttgaacggaactagttattcataccttttgttttctatagtgatcagtttctctcaaataacattatttatctggcatcagattagtgtgaattgttatgctagttacattgtgtgtatccaacataggatagcaattcgtacccattccacattccctagcaggaaattcctcttttagggtatggagatatgggatttgttgcctcccaacattatgctatctgggaatagtctacccctgttgggtgagtcgtggtggtgggaacgtccccatattccatatccctgatccccacttgccccccattaaactcagcgtggtagcccatgtaattgtacaagcatctaaggtatgagagattttacatctatggttagtgcgtcttccacttgttggtttctgagcatcaagaattataacagttacatgaataactgttgaggctgttgccaacttaggtgcccatttgttatgagcccctgcaagaatggaaactagccaactatacacaatattcttgtacagctccgcactcctatcagaaccaaagttttatacacgcgctatttggttgtaagataaacagattcaggctgctgcttgatattgcccattgactataggatataaataatgtgtaggaactcacaccaccgcttgagattgccttgtgtggtagtggggagaagagtgccacaaacacaaagtagtctttctgacttcagaaagttcagttttcttacaactgctatctgtagatgtcactgggttgggtcattagacatagcaagttaccatgtaggattcattagcagaaaaatcagcactaaggatcatttattttattctaatgcttcctagcctttggcaaagtgtgacttgccacctcccccaccccccaaaaaaaagtgccataagagggctaaagctaagcctaagtatgaagctctggcacatggaccatagtggaaaaaaccggaccggtgagtgacccggaggacctctcggttcaccggtccaacggtctgaccagggaaccgctggttgaaccgcggttcaataacttatgtaagcaatgtgtattttctttatcacacaagtgaaagaacggtgggatggctagagccaagcgctctaacctagtagaccctaacctagtagaccaaggttcgagtcctcgcgcctgcaagtatttctctgatttttgtaaaaaacaaccgcgtgggctaggactgggccttactggagcccatgtatatctcctttaccggtccgaccaaggcggtttaatgcccggtttattcaaaacccggccggttcagccggttcaatccgggttggatgcatgtccagtctttcagctggaccgaactgtggagacttctggttccggttttttcaggttgaaccgccggcccggtccggttttttccactatgacatggaccataggaattgaaaaaacgaggttctgtgtaagtcaaggttgtgagaagtaaccgaacacctgtcaaaatgtgtaggatagttcaagttaggtgttgcaaagatgttttaggtctctttgagacatgtactcttttagtatgccatattgccatggcttataaactacaagctggatatgataaatgctattcaatctcacagtatctgccaattctcctcaaaataaaccataggcactaattctcgcagcttttcttctttaaagtttcccgcatgtgtttagaccacattttccatttattaatgtggtgtgtgttgctttgttccaggggatgcagttgatgagcatgtggatatactactatctctgactctgggcaggtatcctaggcatggtcatcagagatcctccaacatcagcaccagccctgtgatacatataattgacacacctagcaatgtactcaaacttgaatttcttcaatacacctatcaggtctgtgatgttcagttaaataatgcagcgtttggtggtaatgcaggcactccctgaacccgagaaggccgttccgaaggaaccaactttcaattgccctgtctgcatgaacgagctggtcgaaccgtcatcgaccatctgcggtcacattttttgcaagcagtgtatcaaggcctcaatccaggctcagaagaagtgccctacctgccggaggaagctgaccatgaacaacttccaccgcgtgtatctcccttctgcggagtaagccggtttccaccattctggaaatcagcgtccctcctcccaccctgactctcgccacattggcgttctgatgattgtatctgaaaatgtttgacaggcttgctagcataccgttttgctggagcagttttaacaggtgttgtactgttgttggatccgttaaaagaatacgattgtatgtcctgtggaaatgatccatgctattaaaggtctagattttgtggggaaaacattttcctttttttatgacacctaaatagtcaagaaaatcttttaaaaaaattgtgatgatagattgatgtgtaatatatcagttcacaaacatataattcaaattcgaattccgagttatgagttgtagttagattttaatttttttaaaacatgtagaagtttaatttgatctggggttgttgtggagtgatatatatcatattaatctatattgttattttttaaaaacctttttaataactatttaaggacttattcattttgttgagaaaaattaatcttaccaaaaattggtaatgtcaaaattttggtacactttaacattaccaaagttttggtgttagttacgttaatttgaagtcttactaaaatttaggagaacttttgtgagaagaaacttccagattaccgatgtttggtagggtagcaatgataaagttacgtttagtttgttaccctattggcactaaaacaggggtacgttatcttgagggacaaaattccatcgtgcttgccctctaggctccagggaatataggaagcatttctgtgctctgctgctggcgtttgtctcttgaggtcatgggctcgcggcggcagcaggggtgggtaattggtcatcattggtatttcggtccaattttttcgatctttaaaagcagaaaattgagaaaatatttttaactatttatcactcttagatgtggcaatcaataatttgtcaccgagacccgtatattatttcacacataaggatccacgtatcgttaacacatagataacaaatagtaaacgtcaaatttaaaagtgacaaatagttaaatgccccaaaatcaaagttatctacataaactcatacgaaccaacaattcggttaaccgatatttcagcctccggtttttgatcctcggtgtttatacccacccctagcagcagcagagtgaccatctctggcgtgtgcgaccgggggaggtctcaatcaacgggttgccatctcgttagcccgaagcaaggggcgtctaccacacgcgcagcagcagcaacaacgcagtgcatcatccacccaacggcgccgttcaacacacacgtctccattccgttgacgccgaccacgataactagagggcaggcaggcgagcaggaagccaggaagaagaagaagacgtggtggtgccgtggtgggcacacggacgttgacgtaggcgacgggacacccagcgcatacccctcctgctccgtctttccacccatacgccactactagggtaacgcctcccttgcataaatgaaaatccttcatattgcttagctacctccgtcccatattacttctcgctttgagtttttatttgtaatgtttaatcattcgtcttattaaaaaaattggaattattatttattttgtttgtgacttgttttattgtcaaaactactttaagtttgacttattattttttatatttacattaatttttaaaacgaatggtcaaacgttacaagaaaaaaatcaaaacgataagtaatatgtgacggaggtagtactagctagagtaccttgctagtactagctaggcagcaggcactctccttaattctactattaattaacccctagattagtgttatggagctattacactaagtaggatttaaatcctgatgcacataaatattactctctccgtttatattacataagttatttaacattttttcttagtcaaatttctttaaatttgataaatttgtagaaatatatagcaacgttttcaatacaaaacaaatatattatcaaaatatattcaatgttaaatttaataaaagtaatttgatgttataagtgttgctattttttttataaacttgatcaaacataaatatttttttagaaaaagtcaaatgacttataatatgaaacggatggagtattacacccaagtgagttttagagatctgtcgtatggcgtatgtgttagaggatatgtttgtggatgagatatgatgttgcgtgtgtgtctgcaatgcaatcgaagaaacaatatagctaagggtgttaatcagtcaagtaggcggcgcaagacgctatcatatcaaattcaataattagcaaggggtcgccgtgccacgtgtatagtataacatcacgggctcacgttgtgtatttagagagcgtatcctatgcacacagaccctcgcgtgtatacaccgtgtacaccaactaaaaattttcataaaaaattttaggaaaattcatacatgtacttttaatagtattacatctacgtgcaaagttgcatattcaaattcattctacatagagaataacaaaaaagataaaattctgacaaaattgcaaccttaaaactgtcagttttttttttgttacggctaagatataataaatttgacgttaagattttaaccctaggtgtaatacaattgaaagtatgtgtatgattttttctagattttttggtgacattttttagttggtgtacacgtgtgtatacgtgagggcctgtgtacataggatatgttgccgtgtatttaaggcgatggattatggctacagggatggtccttaatctgtcaaattaatttttttccaggattaaaatcactgatgaaacggtttctttttcttctcatgcagttccacgtttatcagaacagtaggctgatgaaatattgatcatgacaccttacgagaataattatgagcactgctatacctactaaatttttattacaaaatttttattaacaatcatcccaaacgtttgatttaggtaaaaggaagttgaaaaaaatctaaatacattcgtagcatgacatatcagtacggataagaatttagtgagaaaaaataaacacgtataacctttttcaataattatatcatgtcgcccacctcaattagtcccagctaaacgcagttgggcttgttccaacttccaatccaacgtcctccatgaccacggcgtcttctggacacctcagtttaggtgcaacgtttacatcggtcagttcatcatcgctaggcaacaactgcattttcaacgttaacgggagtgcaaaatacagaggaaaaaacaggggaaatctgtgacgcgacacatgtcacgcatcccacatagaaagtcttgttcggctgcggctgcggctgcggctacattggattggaataattcatttcaaagttcaagacacgagcgagagacagctcatatccacacaaacaagtttataatagtaatatagttaactataactctaaaattaatcatcatatcatctataacttatctaataacctagcaatataataattttatgctgcgaccgtaaaaccaagccgatcgatcggctacaggctgcagcccaaaaccacacagccattaattaagaaaacaagttttaaaaaaaatcaagggaaacaaaaatcatacaaagagcagctgcttattggggctagctgcagctgctatagctattacgagttggctgctacatcaactatcacaaacgatcagcttaatatacctgtacttacgatgtattggatctcgggctgcagctagttacatatctgtagtttaatttttttttcatgtctcatcttctctcttttttacctaaggtaaacctgatgtgtcaatttgtagagcccacttacattaattattgtcctcgctctttagaaacctagataagttagttgtcacactatgacccatgaggcatagataattataaaaagtgaggtgataattctagttgtcaacaaaagaatatcttcactggatggtcaactatgggtatgtcacaactcacaatcaacttaatgacatacaaaatatttttttcctttttcttcctcttctttcttttatatcattgtgttggttggatttcatctgctgctacctatgctgatctaatgctgtgtagaatgtccaagatatcataaggcaaaatatgtacttcaatgtccctaacgacctttccctcccaaccaaaggtggccggcaaaacaacacagtacaaggcacctaattctgaaaaattgtctcttctcttctccattttttctcctggccctgcctaccaacattggtggtacctcgcaagaagggaaaaataattggagctgctccaaagttatacaaatgtgatatgaagccacttatctccacggcaggatgacctcatactaagcagtttggatcataactattccatatttttagtcatatgcaagtggaagcatttatagttgcatgctttataagtttgtactcaaaagaatgtcatccaaatcgagtggataccttgccatcatccttccaactctaacttttcagataaattttttccttgttttaatggtttaatttagcaatatggttcccttccactctcttgaaaattgcccccaaaaaaatcctttgggatgcagttaacttgattgattttcaatatgaaaaaaagcattaatttctcaagaacacatacaaaatttaatcaaacaataaataaaacgctgatatatgcagaaccccacaaaagttattgtagtttggtgacaataatagcatgttttggttagcagatacagttatgctagttggtgtttttccacatatccatcatttcatttgcctttttattcagaggcacatatatccttttctaaggtgacttgggcttcagtggtggagatagctttctgatccaataaagataagcaattctttttggtttattttagctatacaacttggcaagatcacaactttatgatccaggcatggacaccttttggatgcctttggagcattcttattgcctaccacagtgatagggtattcctctttgaaaatattaaaaaaaaaccttaaactcttcatatgtgagattgcgatttatctactctacaaaaataatctgatacacctagttgcctgaattgtgtatggccaaaattccaaaggctagattaggttgggtttctaactttctattggtgcagcatgcaaggccacagaagatcctgagcatggtggggtacagttaggattttctgcaatgtgtgagaagcagaggaagtgggctccacacgtcgaaagcccctcgtggggttcagattcttctcctgtcagagtgtgggcccttcctagcactgacacacgagcttctggccattcctctcttcatcatacaggtctcacccataataaatgcccctccttttccttccaatttttatcaattccatttttgtttgcggaaatttattttcatattctatgttaagggagcactaataaaaagttaattcgagttgcatgcctgcaggtcgactctccccttcgaagttaaagataagaccaagaaatgctagaacatgtgcggccctatttttctcgatagaaacggagaagaaaggtaaataaggtgctcaaactgccaatccctcattttcagttaccagttagttcgtttccatttttcttggctttttaggctttttttattgccgttaaaacataatcgatgggcaatttggacgtattagcgggtggagaaaacgggaagtgcacgagtgtactcagtgcttccctagaatgttgagaggatgtttagatataggggtgtaaagttttagcgtcacatcgaatattatattgggtatcgtattgggtgttcgggcactaataaaaaaacaaattaaagaatccgtcagtaaattgcgagacaaatttattaagcctaattaatctattattagcaaatgtttactatagcaccatattgtcaaattatggagcaattaggcttaaaagattcgtctcgcaaattagtcgcaagctatgcaattagttattttttaagcctatatttaatatttcatgcagacattcaaacgttcgatatgacatagtgtaaaatttttagcgggatctaaacaggtcatcatgagtcgcatttctcaaaaaaaaatgttgcgtcacataactagtagtatccttttgacttccataaactatattcctgcatatttcacaaaaaaacccatttaactttctccaaattactaattcagaatatagaaaggcaagctctggtctctggtgtcactgtcacacgtagcttttgatgaagttctttgttagtactttttttttctagaacaagtactttatcttctctaatattttcctcccaaaagaatagtacagtattggtttaggaaaaatgacatgataaatgctttatctacctttcaaacccgtgaacaaggggtcaatcatgtgaaaccttcaaaccttaaacccactgggtttgtcacacaatatgaggaatattaggggtgtttttgaaaaaaacgcaacactagcatggaaccaaaaccaaaagccgtgcggggctaaagcactaaacatccctccattactcgcaaccccaactcctcttcgcgtctcccaactccgaattcctcctcctcatcgcgtgattccgttttgcgccgcctcgccttttggattgcgaactcgatttccaatcaaatgatcatctgccgcggttgcggctcgtggaggaattcgtgattgctctcccaccatggtacggccgccgccttcttgatcttctctgtttttttttcctttcatgccttatttttcatctgaatttttgagagtcttggggtatttgttccggttactggagttgattccgatagaggttgaattaaaattcgttaagtttgtggtttgtaacgttcttcccctgaatttacgctgctctgctatctttgctgctggttcttcgctatcttcggtttattccgttgctaaaagatcgaatttctccgggattgatgcgcacgtgatggtttatgatttcaattgtcttctaaaagttaatttttgagttgattcttttgcgattcgaagttctttccatatgtcttttgtttgttcttctgaagtattagctgttctgctttcgttatactctttaggtagttgtcatgcttacatcgcattggtgttgatttagtaacggaattccatgaacttaattgttgatttagtaacggaattccatgaattatgttcaaaggtttgatttttataatcgccacttctcgcacggaatctagctttcctgacctgcggtcctgccattttccatttgttttctccgtttagatttgatactacttgattcagtaactatagttattaatgagccataaattactcccctgttttaattcaatgactagtccaaagttttttattaatatccctgatatgttacatggatcatgtacatatatctgtaaattctccctttttctgttttggtttgtcctgctttttgttcctttttttttctctctgataattcccacacctaatatgtaatctgtaaacctcatttctattaatgaaatgactataagttagagcctactctaccttcttccgtcaaaaatatgttacatggatacctgccactattttctattgccagaatttgtgtcaatctgaatggaacagtcttaaactctgaaaaacatatttctacgcattaatccgattgatttcttgttccatatacattccgatatgggtgggcactgggcagtgccatcggttgcactgagtactaac

SEQ ID NO: 62209 - DNA, 22003 bp, Oryza sativa
ccccacctcctcgcactcccaaacctgaggtggagatcgcgcgagccaaacacacccccatcccctctctccgcgcctcgcctcgccacccgcatcgccatctcgcaccgccacctcctccactctcggcggcgggggcctcatcgatggcgtcgaggatggcgctccggcccaacgacgtcacgctccgcctcaccccgcccctcgccgccgccgcgcggcgcaaccgccgcgccgccgccggcggtgtcagggtctacgccgtcgcgtccggggccgtctccaccaagtaagctcgcccccgctccgctcgccactctcctctaatccctctctatcgacctcgtcgcgttcgggattggttccccgtgtgttgggttgggttcgatgcatcggtttgctctgggcgacgcctcgccgccgctgcgtagggatttccggtgcacctgtccccggattggcgcggcgattcggggttcgtcgacgttgcggcatgaatgcgtgtctctcttacccaggattcggtttttcttctcttcgttttgcttgcctcgtctgggttttgtctcaaattctgcgccgtctccgttcctcgtcgccggctttggcaccggtgccaggaatcgtgagattcatcctcgtccgtgtcgcgcgctctccctacgcgcatggccgctgcatctcgccgctgcctcagatcaggctgcaaagatttgcagcttcgccgttcaatcattcgtgcagcatacagtaggtcggtttcactgtatgaactggcgacctgctccaccacggcttctccgttgcaagcaaagtgaagctactagctcgagttagtccctttcacattcatttttgacgccgcatttcaccggcattaaatttgctgggaccttcataccttcaagcttgtactctggaaccatactctccattaatatatcgctgtactgcacaaggaaaatcggtggtacacaacagtatcgatttgaagaacctctttaggggggcttccatggggactccaaggcgttcctatcgttgtcagcccgatttggtggcccgtggtccacagcatggtgatgttgctcgcagtgtcatggaatttaatttgatttgttcttcgcttgttagtaccactggactcctaggtagagatgctttatggcagctcagtgtcgctgacctgtttagttgacgggttctagagtcatttaatacagtatggcattggaaggaggttggttgtgtcctatcctaggcatggcactgaaatggaatcacctccatactccacccctgtcctgggtttcttgatcggattatttgctccatttctctataaaaatgtatttgctcggagtatttatttagtattgttccattttctgatatttacaaactgataccctggaaatcagattgtttttctgagagggtggatatcatagttactgcttaaaccttacccaaagttaaatttttctagttacttccagtagttaaactggcatgaatgcaagatggcagatttgactgcttggtccaattagttccacctggctgatcttatttctatttctgcacaccctgctgcagcaaaaattgtgttccccccagagatgctgcccatgcccagctacagtgatatgcagggcttccaggctaaaacgcgcaggaaagacatccttgctgtatatcaggatttctttagcctatgcattaatacgttcagtatggggagatcctcgcaccataatttatagagcatggcatgtgactgtagtgtggacaaggtcaatgatattagctagtagtactaacctaactgcattttcgctttgtctacctgatgaactctagagaggccaagaagctaaagcttattgcacacttcagttgttgtgcataatctaccgttttgtcaaaagaacagtccaaccataactgatttaattttaaccttaagggaaaaaaatattaggatgaccatcaaactagtacgattagtcttctttatcttgacaaagctgaatggaaaccgtacaggtcaccattctaagcatacctatacatatattttacaactcaggtgtaatctgtttcttttcttttctttgggagggtgttgcttttaacagtgtcccatcagtgtccctcttgtcaaagtttaaccttgtaaatttgtaaatactccctaaattaatgaaatttggccggcctagtctttggccagcctggcaaatgcctaaagctagaggtatattcatcatgtgtctggtagttgctgaaagtttgtttaatttttgtatcagggttgagaacaagaagccatttgctcctccacgagaggtgcacgtccaggttacacattccatgccaccccagaagattgaaatattcaagtctcttgatgattgggccagagataatattttgtcccaccttaagcctgtcgagaaatgttggcaaccacaggattttcttcctgatccagcctcagatgggtttcatgatgaagtcaaagaacttagagaacgtgccaaggaaattcctgatgattattttgtttgtttggttggagacatgattacggaggaagctcttcctacgtaccagactatgcttaacactctcgatggtgtccgagatgaaacaggtgcaagccccactgcctgggctgtttggacaagggcatggactgctgaggagaacaggcatggtgacctcctgaacaaatatctctacctcactggtagggtggacatgagacaaattgagaagacaattcagtatcttattggctctggaatggtaacagttttcttccgcttctttgctagcctagctatatttaactgattattttgaaattgtcattcatgagtttttccctcaagcaattgttttcctcactggctagcgtatattagcatgatgtttttgaaaaactcttttgagttttgaggaagctagtaactccactaactacatactttaggaataacttttacctggcattatcaattttctaattttttagtcttatgttcttttgctctgttctattctgttctgttcacattggactgtttaagtggcaattgagcagagaaatctgtagcacttactcttttgctgcatcatttccaggaccctaggacagagaacaatccttatcttggattcatctacacctccttccaagagcgtgcgaccttcatctcacatgggaacactgctcgccatgccaaagactttggcgacctaaaacttgcacagatctgtggcatcatcgcctcagatgagaagcgtcatgagactgcatacaccaagattgttgagaagctgtttgagattgaccctgatggcactgtgcttgcttttgctgacatgatgaagaagaagatctcgatgcctgcccacctgatgttcgatggggaggatgataagctctttgagcacttctccatggttgcacagaggcttggtgtttacaccgccaaggactacgccgacatccttgagttcctcgttagcaggtggaagatatctgacctgactggcctatctagcgagggaaacaaggcgcaagactacctttgcacccttgctgctaggatcagaaggctggatgagagggcacaatcgagagccaagaaagctggtacattgcctttcagctgggtatatggtagggaagttcaactctgagcatcagacgccattgcgacttcttcgagctccagtgttactactgtccgtgcttgtcgagacacattttgagaacaataccaggtgtgtcttgctacatagttcttcaggttgaccaaatgaactgagggcatatgttcgtggtatctttgcttagagtgatagagagatttgcgtctgtgttttagctctttttttcttttctgccttttcatgtacaacttctggccgtgtggattggacatgtactgaacgtgagtctgtcgttggccgtgtcaatctgctcgtgtgtttaaactggctgctgttcaggtctgaaaattttgtgaaatctgccatgtcgtcagaaatatcacagctttcaactgaggatcatcatcatcactagtagtgtagctgctcgtctgcagtgaattacatcgtacaactgataagccccgactatttggtgcaactgttatgtctgcagataagcagcatacgattcagcaatcagttcactcggtgatattttagtatctgcaaagatcagctgttgctgtcatgctgtgaatcgagatgtggctcaacgcatgccattgttagtgcatttgcatagcttggtgaagagaatatcccattaaattttgtgcgtgcgaattctgttgctagtgtgcctgtacagtacagatggttaaatatacgaaattctctaccgagatatatgcaatatgctcagcaaatgaaaagatatatgctcatctgttgagattcttcacttcgtatagcaaattagcaaccatatgtactgttcaagttgagactgcctgagattgcttctgaccatccaatcttccatttgcagcatttgaattgaacctacagtcattgcttcattgcttgccactcatttacattctgtttttagatcaagaattgcctgactttgttccaaacaaatggcttaggaaatctctgaacaaatgaaatttctgaagatggtgatgcattaagatttcagcacaatacttttgcgagcaacctgaaatgtattccactttgctgcaatatgagaatctgaatagtgccggggtaaattctgtacaaactgctactgacaaatgggcccacgtgttgttcctggccccacctatcagacatagctgagtgttatgccaaaagaagcaattccatttccaccatagctgagtgtgcctctgttcaggacgaatgctgacacaaagcacgcaagaaatatgcctgcttcatttcaatctttcaattgacacaaaaattccatttgccacctgaaaggcagtaaagcataatgccaagttgcagggagtaatgcaaatgcagtgccaatctgcagctgcattattattcagtggaggtagatcgatcagagtaaattgagctcttcatggaacaaagaactgatcaatggattggaacattttctttttcgttttagtggactgacagtaaacatgacatgcatgatcagatgttgcaactttacatataaatggcttctgtgcgtcagcaaatttgttctacgagcaaatagatggatcatgatcatgcatgtatgtggggattaattccctgatcctctctgcagatcagataaggtgagtgggaatatgtggacgtcgctctttgctttactaactattctgatctctgaaattaacagagaatgtacgttggagtgatttctgaatcgtccatcttaggtaattagcgtgaatgcagtgaaaaagagctttgcttttctctgatctttgcatgcacctgcagatgctattatgctaatccgcttgcttttagggtaatctgtgttctgaatgcatcgtggacaattattttaaggtgtcatgttgcttgtaatgattctatttaccagaatgtatataatcactaaactaatcattgactttgccagatttagttttccaagtaaggcagtgtgtgtcaggagagtggagctgaaatgtttttatagcagaatcagtgaactttgaagcttagctgactatggatagtggtgatatagcaggaagttttgctacatatagaaatgcaacactaatcagtcaacttatgaagtactgtatctgatcatatgtaccatgcatatcccaaattttggaagacagagaatatatgcaagtatgcatataccattgaaaatttgaaatggtatttggatataattcaaatgatttgattttctcacaggtagccctttttttccaaggcaaactcacagatgaacagatgatagactgacagttctattacagaagcgtaatagtgtacttaacattattttgtctcatgcgtctgtaactttaccgacaaaactaattcgtgtcaacaagaagaggaaaatacggtatgcaaaggtatagattccaaatcgctctccaggccaacttatgatctatctaaaacaatgcccaacatcttgttcctttttcctttttgtttcaatatcgatcacaaaatacatacatatatacgcagtagtagtcaagcaggaactggaaaacaataatttggacaacatgcatgaaggtatagtagtagaataaccactgctagctgcatcctattcctttgtgctgatatactgatatatgctttctctctctccactactcgatccatacgtctctctctctagctaagccactgtactgaaggttaatccaggagatgctagtcgacctagctagctagctagctagagcacctttgcagcaatactgacctgaccggccacctgatgttgaaactagcataagcatacagtactatagcattgtgctagcatttccttcaaaatatcattaactgttcctttatttgcgttaagtaattattaccaccgttattccaaaatataagggattaatttaactatgaatttgtattgctaaaatttcttatatctcgagacggagatagtatctaagctagttttttatcgggacggctaaggaggcggccgaccaaattttattaagaaagaaagatgttacaactttaacaatatcgacattaaactgtcgagggagagaacgtgggagaacagagagaagagaacaaaaacaaaaaacacacaggaccgctttatagcggggttcttagccaacttatctaaaaataacggcctccctctacaccaggatctcatctctaatatcattgtatatccctaacactgagcactctaaaaataccagcctccctccacaccatgatctcatctctaatatcattgtatatccctaacaccaagcataacctttgctcaaagatcctggcgttcctctctttccgcataaaccaacaaaccatcatacaatgaagtacggtggtgtttgaatcttctgaagatgaagatgaagataaagattaagtgtttcacgtaaaacaagatggtaataacgtgtgattaattgagttttaattattacaaatttgaaaaattgattaatctgatattttagagcaacttttatatagaaagttttcaaaaaaaaaccgcaccgtttagcagtttgaaaaacatgctacgagtatccaaaatttcatccaattcttatcggagaaacgaatgcagccagttgcatgcgctaggtggagctaagtttgatgaaactgaagagatgttgataatcaaaacgagtacgtcctttcagcagagatgattgtctgaaatcaaaatattttagacgacgacgttggttcagagattcaattcatagacatatatactagtaaggtaaactatagattcacgtataatatacatgaacaccctgaaactgaaaccgaaagctagctagtgatcagaccacacagatgatcactacttgcctttcggcaacggtagtcacacacacctcaagaacacatgcttgcttgcatatagcattgccagtttgccactaattgcatgcagtctccatcatcgaagcaaagcaaagaaaaacacacacatgtacacacacacactctctctctctctctctctctctctctctctctctctctctgcacgcgcgcgtgcatgcatgcaaagatttcaaataatcccaagcgcgcgagagcgagaaagcaaaaaagcgcgcgaacaagatcccgttaacctaaccggccgtcgcgtcaacttccaaccccccactaacactcacactcgcactcaccaccatgcagcaatgtcatccgaatcaaaattaccaagctagctaatccaccaatcctccccagccgttcgttcggatcgatccgacggccaccatcccactctgatcgatccatgcatatattcctccccagtgactagctcgcccccgctataaagcccagctcacactacacccactcatccacagcgatcaaccgcattacacttggttaattaattaattctccattagcagctagctagggttctagggttaatttagttgatcagttcgccggaaccggagaagaagaagaagatgatagggtggggagacgtgtacaaggtggtggcggcgacggtgccgctctacttcgcgctgttcctgggctacgggtcggtgaggtggtggcggatcttcacgagggagcagtgcgacgccgtgaaccggctcgtcgccttcttcgcgctccccttcttcaccttcgagttcaccctccacaccgacccgttccaggtgaactaccgctagaaacgcccatggtcttctggctagttccatgagatagtggactagacgatctgggttcgaagcctcactccttctaattatttgatgttagatccttgcttccctaatattcgcgtcttttttaaggtgaactaccgcgccgtcgccgccgacgtgatctcgaaggcggtcatcgtcgccgtcatcggcgcctgggcgcggttcatgagcaagggcggctgcgccgtgagctggtccatcaccagcttctcgctgtccacgctcaccaactcgcttgtcgtcggcgtgcccatggcgcgcgccatgtacggcgagtgggcgcagcagctcgtcgtccagctctccgtcttccaggccattgtctggctcacgctgctgctcttcgtgctcgaggtcaggaaggccgccatcgggatgtacgtcgacggcgccgaggcggcggcggcggccggcaaggacgtcgaggccgccggcgccgccgccgccgcaggcacggtcgtcgtcgccgccgccgcgggcaagccgtcgctgtgggcgctggtgaaagtggtggcgcacaagctggcgcgcaaccccaacacttacgccagcttcgtcggcatcacctgggcctgcctcgccaataggtacgttatgtatacaaattaatttattattacatgtaggctccacatgtcagtaagataagatagataaagaggaacaatttaatttttgcgattacatggcataaccacacaaaaacacactactccacacgtaatatcctcacacatccacaaatgtgcctcctaacacacgctcaaacagatggaaactagtgacacattttatggttacgtaaaaaatatacgtcatcgtgtatccatgagtgtatctgagatcaattgtaattaaatattggttttattaaactcgtagaaaaacatatataggtatgtatgttatatttaaaagtatcaggattaatataaaatcatgcacatatgcacaattgtgcactgccaacgtatcacatagagagatcggtttatgccggtgtgtaatggtatgagtgacaaatgtgtggtggttagctaaccatctgacgtggagatcaccctgacatgacagtagatgcacgtagctaagcatcatgcacgagaggctaatgctattggtagctccacacactggtcatagattattattcttgcaacgtattaattgcgatcgactgtccaattaatatgcgatcgattcgttgtgatggaataccattgatttgttcttccttttttcccctgaactgcaggttacacatcgcgttgccgagcgccttcgagggatcggtgctgatcatgtccaagtcaggcacaggaatggccatgttcagcatgggtacgtacatacatacataagctcgattttttttttggtgtgaagaatacgttaattaattcgattgtacattaggtttatgaagtaattaactagatcacaagttaattaatcatgtacgtagtagtataacaagggcacttgttagtgaaattctacactgatcgttagtattaattaaccttcctttttgtgaatgacttgtatccccacactacttgttccataattcgtatctagtactccagcaagtaatacatattccactagataattacccaaaaaaacacaccaagaatcctataccaaataaaagaaatggaaaataaaatcagcagtatcttcacgaggaaccgttcaaattaaaggcacaagttctgcacgtctgttgcatgcagagagcttgcgatagctagcacgaaaggaaaaaaaaaggggtagaagtatgcttttatttttatttttaaaaaaactctctctgatagtaaatatttgatgtttgagacagtattcaaccaaactttggatattttgatcaattttatacggtgacaagtttataaaatctgataagtttatgacactaatactttctaaacaaatctaattataccatcttattttaattaaaaaagcatacgataatttattataatttgttgatggttggctaaatcttatcgtacatatgaaaatatttatgaaaaagaaaaagaataggacaatagaataaggaattatttgtgttcttgtgctgatagttgcttgcatacagcagcagcagccataagagcaagtttaatagtatagtccactattagctccaaatcatctatagctaatgtaatagccaattcatacaatagttgtttactatactatttcatctgtcatacacacattatgtcttggagtccgtgctgcagctggctacagatttatagcccgctgctcttctctctctttatttatctctttaaaatatgtttatagctggcttatagcatgctattacacctgctctaagtagctatcatttttatttttgattacacgaaagatacttaagaggggcgagacgtgtgtggttttgcatggatgcaggattgttcatggcgcagcaggagaagatcatcgcgtgcgggacgagctttgcggcgctggggctggtgctaaagttcgcgctcggccccgccgccatggccatcggctccatcgccgtcggcctccgcggcgacgtcctccgcgtcgccatcatacaggcaagctacctataccgattggatccatgcacatctctttctctcccctttttgttccttaattctacgcgcatgcacacatatctcacttgctttataatactcaacacgtatactcgtcgttttagataagggtgaggtcaaactttaaaatctttgattatgaatctttttaaaatatttgtccttcaaacatgttgactacatgtatagattgatcttaaaaagtactttcataaaatcatatatttgttaacacttttatacatatagaaaaaataacggtcaaagatgtttttttgagaccgtgcccttattcaaaacgacaagtattatcaacccggagggatgtaccaaacataagttgcactaattgtgtgcaccggaggttttgagctacttcctccgttccataatggagtataagacatatactacgaatgtcgaatttagataaacttccaatttagatttttagtattataatatatcctattcggttcgatttcttatgtttcggtacagatggagtaagcgctaaggcaaggtaatgtttcctcgtatttaggtccatgacatacaaaatacacctctatttcaaactaaggctgtgtttagttcccttcaaacttttaatttttccgtcacattaaatatttggatacatacatggagcattaaatgtggacgaaaaaaaacaattgcacagtttacatataaattgcgagacgaatcttttgagcctaatcacgccatgatttgataatgtgatgctatagtaaacatttgctgataacagattaattaggcttaacagatttgtctcgcagtttacaggcggaatttataatttttttttattattagtctacgtttaatacttcaaatgtgtgtccatatacgtcaaatattttttttttttgcaaaacaactaaacacggcctaaacctaagactacaaagtagaatggcaacgacgtatagacgatgctgggctgatgtcaatctatcagcctttcacaggcatgcaacttaagccatttgattttaccactttacaactaaatgttgaaagcttacttttgacccaaaaaaaaaactctagctgaagattcccacttaacttcccattacaccactagctgatagcctgatacatgcatacaaccagtgcttttagcccttgctgggttcctttgtgtatatatatatatatatatatatatatatatatatattaaccgaacttctaaatgccaacaaagtcatctgccataattgcatttcaccgacattagatcccttcagcaccaaagtattaccgcccaaaggtttttgtctagatatgtcagatgccacacacatagtgcaacactaatggagataaaaaggaattgctagcttaagtacagggctagcaatgtccggaaacaaaagggaagaaaagaaagatgcttgaacaaatggaggaaaagagaatccattgtgaaaactacacattccactgctattcctacgtgagatttgagcttagtttgtcagcacggctcagcaccacactaatcttgaccactgggtgctttaagcctttaaggttaatgttgctcgcagagccacaaacatgaaccgtatttgcacaaaagaaaaggcaaagcatgcacacgaaaggcgcagtagcagattaattatatgttgcgtagtcggtgtgcaagtgcgcattccaaacgacagaactgaattcctgatcagtactaatataatcttcttggaatcttggtcaccttgaccttgcttttaagcaatcagaccatgacgaaaaatttcggcccagcactatatatataccaggcttgaacctcttaccctatcagtgaacatgtaacacgaactggtatccattattgtctgagaaacactcaccatcactttagggcagtgtcttatccatggaatagattggtcttcaatggggcggttcagcttctgttttcatgcaaagaatagtgcatgtccctattgcaccggcacattttgacccctgcttgccaaagagcaaagatcgttgaaattggtctagagatcagatgtgcttaaagtaaagaaaagtttaacaaaataaagtgaagaatgagcatggcacctatgtggaggatctgttcttggcatgttctagagtccgtccccacatgaatgcagtcatccgctaaacaaaaggacaagttaaaaacagcaagtcattagagaccactcattcagatgcttatcgcataatgaatcgaactcaagtgttagttaaacaccaggacccatacaataatatcaagagtctaacagcataatcatgttcaaggttttaaaaacagttagttgctatagtggagtcagcactaataagatgcacaagggaagtcctactcatcatgtcatctagtgcacatttcattcaagagatgggttaacctcgtctgaatcaacagtgggtttactttatgggagaggcaaactagtttttgatgtgcatcacagttataaaactgaaagaataattatcctctttgttccatgtcatcccttaataactgtctacacagccacttctgttcctgtgtatagaattaacaaacattcgaaagtggtaggggctctgctttggggtgacagggcactcctgaatattaaggtaaacaatgtttcggtttacaaaactagagttaaacaggggaatgttgctctgatagtggtccttggaacaagtgtgaactgaattattgtctacaagaatttgtgatcaaagggggggggggggatttggcttccactgaccacccagatagtttaattcaagacaatgtgaaggttatagctttgtacgtgaagccaggactacgcaggttagatctcagacgtcaaatacagtttctctaaattacaatgcttattgtgctctaaagattaaaatgagtgcaaagaaatgacctttctgatttgtcttctaatataataatttttcatatatattcaggtaatttctgtcgacattttgtatcttcctgaaatgatgaaaatgtgcctcaactaacattcgtttgaattcttcaggcagccctacctcaatccatcacatcattcatatttgcgaaagaatacgggctgcatgctgatgtgctcagtactgcgtaagtattttgaactgactacaaactacatattgtcaaaggcatatgtttctgcggacagtgaaatcaaagtttttctcataccattttgttgctcaattttgcagggtgatttttggaatgcttgtctccctacccttgttagtcggattttacatagttttagagctaattaggtagacgcagagccaatggtacatcaggaaaacatagtttttccttgagaattccaaaacatacatactgacaacaaatgttgcaaaatatctcctgccaacattcctcattgcataaaactgtaatgggagtatcgagttctatggaatacttttaacacgttatgtaacaagaatgtatacttattctgttattcaaaagaatgtgttacagtatttcattattgtcgtatcaccttgatacagccatttcagtgatagtaggcagtaatattcaatatgtattgagaactatatcagtattcagagaagaatctgtctcctttggaaatgcaccttagcccgtaagttaaaaaaaaaagaggaaattttccagagttaccttagaatacgtttgactagcttgcctagctcttcaccacggtcctcctgcacatggtgccctgcctgcatgataagtaatgacaccagagaatggcaatcaatgcaatgaaaagtaatgagaaaaaaattaggcacgtaggttacaagtaatcatgaaagaaactcaaaacagcagtgagatattcttgtttttattttactctcttttttcatggaacagggtaattttgaatattttttcccctggtgaggacaagaggagggtgggggtggggtaaagacaacaaaccattggcagttctaaaattttgtaatttgcactgccacaaaaatcttcaactccatcatagttcagccaacgatctctcaagccccaacatactgtcgtttttgttttccatgaatcactcgataatatattcctcatggattcaatgtaaacctgtaataaaacacgccattcagatcatacaaattaaataattgaaaaggccaggtgatagacaagtaagctaccttaaggtcctttttcatagctctactgattgcgttcaatgcaaaaccagaagaaccagagacaaggtatggccttctgtataccattgcatcttcttctttcatcatgtatgggccactactagtcaaggccttatcactagctctgagaggatcctgaagggattcgagaaaaggaattttaatttcaaagcacaaaccaaaaagttacataatgtctaagttcatttcacactatgcctgctaacctgggaaaatatctcacccaacaagaaattgctgaaacatgcaagggtggacggaagcttcgcatgcttatccgttatctaaatataaaagcatttcgtgatcagtctatgactctcaagatataatgaagctttacaagacaagattgcgtagtatgtagcacacaaaaatatcagagaaaacttatgtggctactaataaaaaaaactcaccggtgggttaactaatatcaggtggttcaacttgtcctgatgttcattagcatatttgattacaattggagcaaagtacccctgcaagttgtatgtttgcatataaacaaggatcctagagattcataataggcatatccaggatggctaatgacaagtacttgaacaacaatggagagcttatcaggagcaacagcattgatcagagactccaaggacgatgtatattctggaaaggaaatagtagtttatgttattattagttgaatacacttgttttggagacacaggatactatgtagataattttaccatcaagagtatagtcaaaaccataatcgggttgaggcttatctgagaacccaaaacctgcagacacaaagttctttgttttcaagttaggcaaatatctacatgcttactcctacaaactgagcagcagcattaaccaaaaaggcatggttgttcagtacgatggcacaactttacagaagattataagcaaagccacacaaattatgactcttacgttcttgagtattaatgtcaaaataagatgataataggtactaaagatggtttcctattctaatttgtatgatcagcacgcatagactcctggtcataatgaccagtaattgcaatacattttctaaatgtatttttttcccaaacatatgaatgactttgcatttttctgccaacttaattaaatagtagttttgcatttgtcaagcatcaaacaatgtgcataccactgcaactcaccgagccaatcaaaagcaatggcatgataattgtctgatactacaggtagcacatttcgataagagtatgcctgtaaccaagaaagtccaaaggcatatattcagtattggaagacttttttgtagaaaaagaagaacataggcaaaaacctagtcaaaatcccacctgagatggaaatccatgaataaaaagaacaggaggattcgaagaactcccagcctccacacaaaaccacctgcatcacagtaaaaaagaacacacaagagcaattatcatctttgaagaactaatatacttatcctaaaggagaccaatgacttgaaaatacaaggctaaatgccgtcactattattgtacctgacaccctgctaaccacttatatagctcaattcacctgaaaacatcatttgaagattgtgattcagctcccattgtgagcccaaagatgggatcttttgccttccctttgttcccgtatactggatgagcttttacctgtaatgtaagtatcatcatatttttgactagcatattggaacaatcctactctcatccacatgaagaatatgatgaaatgaaaatgctcatggtgagacagtgcattatcaagcaaaaggcacacggaaaatctaatcactccgtcaaactctggattatgtagtttagatatcaaacagtctgcaagtgatgagtgcacaacaacacatcaaaacagggagtgatcacattataccattctcccttgagcaaaccactcatcggacttgctcgggccatccgtatacttccctgcaccgatcccccgcagaataggaacaagttagcgaataccaatattgacatgatgtcagaacccaactaatgtggactaaaatttgcagcctctgatccgattccccaatgctgaaacaaaacctaactcacccccactgaacgagaagccgtccccgatggactccggcgcatcgatcaagtagtaatcctgcaaaaaaaccccaccgaatcaaaaaccaaatccaactctcaaaatcgcaagccctggtgtggcggctggtgcaggacctcgtcgttgggccgggcggcgcggcgccagcaggggagcttctgggggcgggtgcggaggcggaggcggaggggtagcgcggcggcgtggaagcgcggcgcggcgagcggcggcgccatgggaggtggtggaggattgccatgggggatcgaattccgctggggttttggagggaggaacgaagtggggatagggtttggttggttggcgctcctcccgccacagtttctgaattccccgtgtgggtcccactcgtcagtggctggctcccatttctcacttatttttttgtcactttgtattcggcaaaatttgataagttttcccaattcttttataaggaaactaccaccaggtcttacccagtagttgaaatcatattaaaggagcaaaaaatgttataaatatacaaaccaaaaggaaccgaattacaaggcttataaccagctacaaactgaaaatatatactgaaaaaaataagaggttcattcatcctatataggtgtagaagattttttttttgtttgaaacacctaagccaatcattaacatcatcaggaacagcattctgaaatatgaaagcatttctttatttccagatgtgccaacagactataaacattatttccaaaaacaccttgcttcgaaatctgattctggctagaacaatcatctgaaaaagctctatattatggttccaaataaaaccaatcatctcccagcaagttctccaaatttttgtgtgctgcaaaatgcactagacctcgacaagtactagcatgatatactatctctgaacttgacacctgtacttattctgtttttcttggaataatctgcagccaaattccagctatgtacaagtaaagatgcaacctcacatacatgccaaaatttgattgatcgatatatttcttttttaaaaaactattgtaattacatcgtctttgattctgacatttgcttattctgacgatgagagaaacaaatctgtacatcaagaagagaagctctgtatctatcatatctcagctactcaagtaactagccgtacgcccggtcccaccgccatcgccggcgacgagctcggtcgccgtcgccggcgggctacgggtaggggtcggtccagcacacgtccccctccgccgcggccttccaccgccggttgaatatctgcagctcggtgtacgaccgctgcctcacggcgagccggtcggtcgccgccttcgtcgccgtcgacgaccgcttcgccgccggcttgccgccgccgtcgccgagcgtggggatgccgcggtggaggacgtactcgctgtcgacgatgccgacggcgagcctccggtcgccgccggcgcagtacccgagcttgaagtcgaggccccacgcgtagatggggtcgttctggatcatgtgccacgcgcaccgccatgccgcccgcgagaacaccggcaccatcatctccacccaccccgtgcatggcggccccgtgctgttgtcgtcgcatctcccccctcccctcgtcttgtagaatctcctgttccaaataaattttacggttctcaacaaaaacgaagctgaaattgtcgtcgattcgggggcatatccactctgtgtgttttttttcctactaaattcaatgcaaataaatataaaaaatgataatgtagagtagagtaacttttaacatttttaccaaaaattaaattcaaattcaatctacacattaagaataaaaaagacaaattccgatatactattcatgccaaaatgataagttgagtttatacaattttgtgaaatggcatatatatggtatgaattatcaaacttttttttaaaaaaatatataactatgtgaataagtttttgacaaacgaaaaaaaattgtcccctcaagggatcaagagagtttctatcaatttcacatgaaacagcttgatttgttacctgtgaacttggcctttgcgggcgcggagtgtgaggcggtggtggatctgggagcggtggtcgagcgcgggctgggagatctcgaggcgttcgcggcggacgacgcggaggtagcggatggggtcgaagccgtccacctcgatgtcctcgtcccagaggaagatgtactcatactcggccaccatgtccgggtgtaagaacctcttcccgaaccaccatttcgtctggtccttcgccgccacgtgaatcgcccggtccgaccacccgagttccctccacccgtccatctcgccgtcgtagtggaacaacatcaccgtgaacctgtcaccggggaactgcatgcacgccaaccattgtcgccgacgagaatcagctcaagtttaagtgctaccaggggcggatccagcatgggagcagcggggtctcgagtccccaagctcccacgaagacctcactaaaattttttaccatatgtagataggtgggggactgtaactctatctagatagattgggaactttaactttgagcccccaaactcccacgaagatctcactaaaattttttaccatatgtagataagtgctatctaaataggtaggtaactgtaactctacatgatttactcagatcatattccgccactgatgctggcgttgaaggaaggaactgaagaagaagatatggtattggtaccttggagacgagcttgtcgacgacggccttctgctttatgccgacggggatggcgaggaggctcttcgccggccgggcgacggcggcgcgccgttcggggttgccgccgagcggctccatctcgaagttggacttgtcctgcacgatgcccttcggcaatggctcgctgcctgaaggcctgcactgattctgcaaacttaacgagcagtttagtttgttcggttcattgcctgcattgtttgcattgcaggtaatatctctgttcttttaggttaagtacggttattaagaattttgataaaatattatgattgactaagaagagaaagtaagcagggaatttgaatgctattttctccgtttcacaatataagtcattttagtatttctcacattcatattgatgttaatgaatctagacatatatatttatttagattcattaacatcaatatgaatgtggaaaatgctagaataacttacattatgaaaaagagagagcataagtttatgattggttgaaaataaaatgcgtgtgaaaaaattgttatattttagaggagatggattctaatttcctaggtagatgtccattcgtttcttgatgtaaactaaatagttacaaaaacctgaaaaaattataggtaatatattatttcataaacatgtaagttcgaattcgacttctataaatttaaaaaaaataataaattaaactctaactagtatacgtatattcagttaaatttattatttttgttataatatatagaagttgaattcaaacttacatgtttatagagtaataattcttatctttttttgaaagtttttcataactatttagttgataactatttagttgatatgtaagaaacgtctatctaaatgcttaaaagagtttctcatattttataacaaattttgaaggctcttgttatatattggaatggagtgagcatctgttctgacctcgcagatgctgctgccggcgagttccgctcgctggacgccgccggcggcggcgccggtgcctgcctcttgcacctcgctggtcggagccctcgtctccgtctcttgcacctcgctcgtcggagccctcgtctccgtctcgcttacgaccatttctctcggccgtaactgaagaattgacaaattctgcagaaacaaattcataagctttcagaattcagagaattgattttatcattcatctatctctgtgcttgatgtaaagaagcatcaaggtgcatacctccttgtgatcaagcgtgacgattgcaccgccggcgaacaccagcacgaagaagatgagcgccgccggcggcgcgacgccggagaaccgcttgcgcggcgagtcattcggtgcagctggaccctgtgcctgtggtaatccgtcagaaacagaagcaacttgtgagctcatcataatcgcacatgtgttgcgaatttagtttgcttcaagattgaacaaggtcacagccatgaagcaatctctgaatcaatctgtctgctcgaactagtcttgatcagagagataatatcttcaggtaggaaatcaagaaccggaggagaaagcaaaggcatattccctgaaaacccaatcgaggaaggaagtctattatagcttaggtctaaaactccccctgaattctactgcaagggtgcagtagaagcaaagaaacgttcactatggttaaaaactgagaggtttaaattatggaggagaagaggttcttccagatcaagaag

SEQ ID NO: 62210 - DNA, 5767 bp, Oryza sativa
  unsure (1)..(5767): unsure at all n locations
ggtgaccggagcaactaggttcagtggtagagagaggaggaagggagagaagacgggaaagagagccgaaggaggaggtcctggtagtggaggcaacgagccctttcgccaaatcatccgaggagcaatccgccgccgccgcccgagaagaaagaagttgagccagccgtaggggaggcgctaaccgccgatgctgccgccgacaactccccacccgcggccattgtcagctcctagccccgtggccgccgttgaggaggagagcggcgccgcgggagctcctggccatgtagtgtgatgccttcgcagtgtccctgtccacgcagcttgggccgccgacgaggaggaggatagcggcgccgaagtgcgaaaaatggtggaaattctgtgaaatggcgaatatggctaaacaacggtttggcatcattgggagtggctttttaacgaatctaattcacggagtggcatttgagcgaaacccttttggcagtggcacaatgtctaatttctcctttgtgacatgccgctggcctctattataatggatcgttcacgatgcccagttgtgtactagtcgagtgacaatcggacaattaccattttttaaaaggaaagttgggtttaattacaattttaatcggatggaatattgaaagattaaattgtgattgatttggaaaaccttttttcatgtgtattctttaccagtacgtcttatataacaactcgaattttatggcaaacagtcgagtatgaaatgtgtaaaaacccagactttttttttttacagaattcgatttgaacgtagctataccgagatgatgatttctgagcttgaaaaaaaaggatttgtaaaatgagaactaaaagaaattgagaattttctcagagtacaattaaaacttgtaaaccaggaaaaatttaatgttattaattcgaaccagaaacctgattaaaaaattaggaatttagagagaagggaggaccttcgttactgggccgaagcccctatctaaagtgagggaccttcacatcctctgccaatggcccatgctacagcactgtgccgttgagcaatcttagcccttcttttctaatcaacgttatagataaataatagatttttattttgttcttcccgttgaatttcatttctatcatttccttcctcccacgagaaagagctgactctttctctaaacttcccacaaaaattaaaatagcgattaattagttgaacgcaacatatacaaaactagaagatttttttttagctcttgcaacctgtctacatgaattcattcttgatttccgtatgaaagaaagcaagacagagatcaaaagggggaagaaacaagcccatacgtatccagttatccacgatgaaattggtaattaacaccgtaaactggaatactcccttcattgtaaattgatttacatatttattaggtacaccaatatcaagaaaatctaataactctctcatactatatttactctagcaacaaactcgatgcatgcaccattcccactattttctagccaataacaaatcaagatattgcatgtgggttataaatatttgtgtgcatggatgcatgcattaatgtccatttactccaatgcacaaataacgaatagactcaatgaataaatacaaatatgtagataatttaggaataacctaaaaaaactatatgtagatcaatttggaatggagggagtaaaagagtacatgactgcagacattacaacagcttgatagcttggagacataaagatgcatgagaaggatttgagcttcttttgcataaacttaatcttgtccgttcgttccgaaagagcagccatgattaccccaacggcactagcgccatagcatggaccaacggcagaggatgcgaacccccaaagtgaagcccgtccctccgggcacagattgttatggtccttgtggcccaacttccccaaacattacatttgataattacgtttaaatctttgtaaatttgcaaatatattccattttggacacgcaagatcggtctctatatatcatccgcactgatttataaaagtataattatataaatatactagatgaaaccctgcgcattgcagcgggaatttagtatgataacaataaaaaaaataaataacatgtaaaatagctagataacatcagattaagtaaattaatgtggtttatgataatttaaatttaaatagtatatagaatggtgattaaaatgtaaaaagtaaggtggcatgactttatagaagaagaaaagtagagagatagtttggaccgtagattaatcatctaaaagctaaaaacaactgatgtgatatgacttaattagaggaaaaaaggagaaagataattcggaccaaaatcatttaagcactaagtgaggatgaacaatataagtatataggatatcataaaaacataaaaagatatacattgaaacattatgtaaattatattggatgataatttaacatgtttgtatttgaaaatatcttaaattataaaaactataaagatatagcatgtttgcatgatgtttaaatgtgatgattgttagtgaatgatgatgtggcatcttgttaattagtggatgatgatgtggcatcttgttagtgaatgatgatttatcatttttgcatgttaagcttaaggagttagttagaggaaaaaaaggagaaagataatttgaaccatagattaatcatttaagcactaactaagtgaggatgaactatataaatatgtaggatattataaaacatagtaaagatatacattgaaacattatgtgaattatgtgggatgataatttaacatgcttgtattttaaaagctcttaaattataaaaactataaaattatagataatataacatgtttgcatgatgtttaaatgtgatgattgttagtggatgatgatgtggcatcttgttaattactccctccagtttgggtttatttgtcgtttcggacgtgatttcaaaaaccaagaagtcgttaggtagggttgttatttcctatttcgtccctattaaatacagttatgtgtagcatgcaaacaagcaactactactactctctcagttgggttagtgcattcatcttggtgtgttgggtcctgagttcgattcttgctctagacacataccccattgatttttgtcttggcgattatgcatggcaccatgcatgcatgcatgcagcccatgcagcttcagtgcagatagcacgcgaggcggcgagggcatacgaaaattaaaccagccaattttattcaatctgtgcttatgcgcgcgtttttccgccaaaagttttcgtttctgcttatttgccacgctaatttgccgcgcgctgcgcgtgtatttatactgtatacacccgtacttgtagacacaccaaaatatacgagtccacatcaagcaggttgaatagagaaatggatctgaatatggagccacagaatgacgacaattttactgatgagatggaatacggtatgaagcattgtcttttttcttcttttggcgcataccagcttctctgccgtgtacctacatgttcttggcactctaggtgatttaaacttggatgatggacttgatttcaatttggaagatttgattgatttcaacttggaaccacacacagaagatgttgatggtaactagtcttttctttcatcttatatccgtagagtattcttctttgcatcacacctacatgttcttgtatggtaactagatgatgtcattctggatgctgaatctgatgtcaatttggaagctgagattgagtttaacatggaaggtgggattgatttgaacttggaaccacccttcactacaagaaaatatacaattagctaccgtatatttagttaccaagaagtttggtgcctagatattaatcaatagtaaccaacatgctaataccttggttgctgtagttgtcagcacgttacttaagttaaacagtaccaattacctctacagttaccaagttactggccagtacttggtcactagtcacatgacaacatatagcaaccaaggcatgtacctgatatttgaatatgtggagtactggagtgcaaaacacacttcctcttgatccccatccagaaacaaatcgagaggcaagggcaaggtctgcggctggcggcggcaccgtcgacggagttttgcggggacgacgacgccgncgncgncgacgctcggtggaggagtccttcgcggcccctgtgctagcgcccaggaatcggtggtctctgcgacggcagcgcccgagggatcgctggtggtttagctacaacgtcgtcggggcaagcagttgattcattgcaggcagcaggaggagtctccactttgattcaaggtaagtggttaaattctcctgatattctatgtttgcacacaaacaatttgtttaactggatgtgtcttgaacctgatctataacccaaatgaatcctgatctataacccaaatgaatgtttgtaggcactattattcaatggtttttgtgtgagatttgatctgctataacatgagtgtgacttacaaatctggttgactgcactaatttgattagcacacagtatttctaagctataaagaggggaaaataactaggttaaagacacatgacttccacctgcttttgcagcgaatacttccaattggaattcgagggtatttgcagaaagacatttgtgatgcactattacagttaggtagcttttttcgtcaactatgctctaagtcattgaagcttgatgtgctggaaaagttagaagaacaaataatatttgtgttgtgtaaattgaaaatgatttttccacctgcattttttgatattgtggtacacttagcagtctatttaccacaacaaccaagacttagtggacctgtacagtatagatgaatgtttttttattgaaaggtatgtgttgattaggatccttctctttgttctataattttgtcgttgtactgtagtaagtgtatattattggtatgtaggttccttggtactttgaaaggcatggtgagcaatagggcacatccagagggttcaatcgcggaagcctatattatgaaggagtgctcaacattttgctctatgtatctcaatggaattgagacaaggttcaatagggaagagagaaactatgatggagagaggcaattcgctgatcgctactcaatattttcatctagattccgtgcttttggtcacaaggatgacgtaatcctaacacaagatcaatataattccctgtgttggtacgtgctcaataattgtgaagaactgcaagggttcctatagtaagtaaaataaaatgatatttcagtaatagttacaaataattacatagttacttgtactaatatatcacatgtcgcaacaacattttagtgagcatgaggacgttttagaggcacaaggcgtgggaaatatagcaaatagacagcaacaagagtttgctacatggctgcgccaaagagtaagctcacacttggcttcacataaactatatgtccattgtttgcattagctaacatgcattatttttggcaattaggttatagatttgcgcaaggatggttcatcccaagtatctgattgtttatatgcccttgcaattggaccatacaaaaaattacataaatactctggatgtattattggtggagttagatttttaacaaaggagcgggaggaaggtcg

SEQ ID NO: 62211 - DNA, 4319 bp, Oryza sativa
ttgcagaaccgggactaaaaggtgttacgaactgtgaagacgctttctccagcagtggatgtttcaaataagcccaaaatacctccacagacagaaggggtctttttttttttgaacattgacagaaggggttgatgactaattgatcctacactcctattacaggtttctcttcttttttgtgtgttgtatttgtgcattttttaactgtttcaaggtggttacacacaaattttcatacctttaagaatcccacagtaattaaagccaatcagttgccatcccatctaactctctataattatggtctcatttgggcagtttttagaaaatatattgcagactattggaatggagcagagaaacaattaacaaacttgatctatattaggtatagagacaaattcgattgataatcgttgaaagagagaaaacactttcatagaccatggccatgcacaaccgacaacagattgctagcaaagatttggttaaaggttcaataactaaaggggagctctatggttaaaactacagagtacattgaattctatcgtttagtatcttgcaactatggccattaagtcaaggcaggaaattaatgtactaaatggtcatgcatgcagtacataaattagttgatttggagtacgcaagtcatccggcaaaaatttctgcagcgcaaaagtaccaaagtgtacttgtaattatatcatttaatttaccaaagtgtaccctagaccccaagacaactgccagctaagatataattttcgcttacagcaaaataaagacaaccgcaagtgaaaacattttttggattttaaaaaaataaaaatcgtgctcctcaacgccatcgtcggcgggacgaggaggtcgacaaggaggtgggtcgccaattccagatatgcttcccctgtgccatcgccgagtgttggtatttcttaactatattactagaaatataaattcctagcaatagcgctagaaatggtcctgatatatatatggttacagaaggaatccgcaagcgcacgaatatacgattatagcattttacccgagtattttaaggtatcgtattatttaatcccaaaagaagattgtaagagagaactatcactactggagaagtgctcatctctcccggttcgcaaccccctttacccccgggtagcgaaccgggagggagaatccgggactaaagatggcggcctttagtcccggttcaaatacctgggagtaaatctccatctttagtcccggttggtgacaccaaccgggactaaagatggctgagccacgtggtatatataggttcaccgagtttaaacgtgtacatgaccagagctgtttcgataggtgcgtcctctagcaactgctccatacttagtcccgtatctttcaagaagttgcatatctctagttgtgccggttctacgactaacggttcaacctcttgtcacggctgttgccccagctgagggacttcctttccgcatttcactactgaaggcttggctttaagagccttcctcaatgttcgatcatagtcagaaactttgaccggtttgcccggttcggccatcttaataaagtgatcctgaacctctggggctatagggatcttcttttccggactacgtggcttcaactgctccctaactttcgctctaacggcttcatcgagctcctctggagtcaagtcgtacgcccttttcttgagagcggggagccgtggctcgtcagatctggctttcttcttcgcccttgatggtgcgggttcatatgggcgggaccttgacggtgtagacttggcagcaggtgcacgcggaggagtagttgcccgcgggcccgacggtgcagacttggcagctggtgcacgcggaggagatggtggtgcaggggaaggagccggaggagactgacgaggcggtgatggcggaggagactgtgcttgcggcggggaaggaggagcgggtggccgttcttgcccaggaaacacgatgtacttcttacgccagagtatgatggcgtgggctgtgtctccaagtttcttctccccgtctcctccggggatgtcaagctcgagatcctcgtaggttcgttccaccagctctatctcgaccttcgcatatccatgtggaatgggcctgcaatggtatgtactcgaagggtctgtgggtatggccatgcctgacgcgaccttcacaagaaatatagttcattaattactaatcaacatatatatgtaacaaatttcgcatttcgcataccttgatagacaagttcctgaatggagtatgcatatcgcagggtgttcgctacgtgacatcatcaacggggaagtgggttgcttcgtgagctgccactgcctcaatgccctctgatccaacttggcccgttgatgcgcagctgctgcggttgcccgaggggctcaccatgacgggcgcttgtgtttccattccgcgctgctcagccaggcgttggtccacttgtcttgtcacctcctcttgcatccttgcctcgtaggtggacaccctgtactcaagatcgacgatcttagactctgtatccctcttgctcctcatccgactcctatacgtgtggatgtcctctttgaatccatatttccaaggaatgacgccttttcctcgcgttcgtcctggatgctcaggattctgtagtgcaagggtgagctcgtccttttctctgtcgggctggaaagtcccctgcgtagaggcttcaattgcatccgcaagtcggcgtgctgcatctcgaatctcatcgccgaatatgagggagccatcgcctggattgagcgatccaccgtgtgcatagaaccagttcctcgatcgctcaggccaattagccgtggtcggctcgataccccttgctatcaactcagcttccaacttgtcccacttggggattgcctttccatatccgcctgacccaagccggtgatggtatttcttcttagctgcattggctttgttcttttctatctgtgcttgcccttgcgctccagtcttgtatgccacaaacgcatcccagtgatccctaagcttgttatgcacgttgaaatcaggtgtcaagcccttgaggatgtatctcttgtacagatctgatttgtagctctggaatagttctgccattttcttcagggtccattctttgcatctaggacgatctgcctcagggatcgtgaatgtctccagcatggtggtccacaacatgtccttctctgtgtcagagagaaagctatcttcatcccctcgtgacctagttcgacgccagtacactatgctgatggggacgttgtctctcacgacccaaccacaatgattcacaaactttcgtcctatacccgccagggctactggttcgccgtctggggcaatctcagtaacgatgtgccttccctcaagcttcttcgcgggacctattttcccgcgtggcctcttctgtccggccgacggttgactatcagtcccctcctcggtcccctcctggttagcctcctggttaccctcatcgttgccctcctcgttcaggtattggttgggatcctcgttcccctcatcatccacccagtactgactgctgccctctgcgatcgtgtctaacaggaattgttcgtcatcgcggtctgccatttgtgcgtgcaaagaaaaaaagacagtgaggtcatggacatcaacatgtacagctcatacgtctaaaccctacaagtatacatgtataattcgctaagtcgttgttctcgttaagtcgttaagtcgctaagtcgtcgttctcgctaagtcgctaactcgctaagtcgctaagtcgttgtccgtcaaagtcgctaagtcgtcgttcgtgaaagtcgctaagtcactaagtcgtcgttcgtgaaagtcgctaagtcgtcattcgtgaaagtcgctaagtcgttgtctgtcaaagtcgctaagtcgtcattcatgaaagtcgtttagtcactaagacgtcgttctcgctaagtcgctaagtcgtcgttcgtgaaagtcgttaagtcgctaagtcgctaagacgtcgttctcgctaagtcgctaagtcgttcgtgaaagtcgttaagtcgctaagtcgtcgttcgtgaaagtcgttaagtcgtttagtcgctaagacgtcgttctcgctaagtcgctaagtcgctaagtcgtcgttcgtgaaagtcgttaagtcgctaagtcgctaagacgtcgttctcgctaagtcgctaggtcgctaagtcatcgttcgctaaaacgttctcgttcaaacgttccaccgtggagtcggcggtggagtcggcg

SEQ ID NO: 62212 - DNA, 19266 bp, Oryza sativa
  unsure (1)..(19266): unsure at all n locations
cgggacaaaagatgttttcccgctattccaaaatttgtattggtcccggatactgttaataaccgggactaaagatgtgtacacaaaaccgatttatggtcttcttaaattgtcttacaagtcgaaataaataccaataaatccaatataattagcacatggccgatttataaataaatagaaataaacaggatatacctaagtaaatggtctcaaagtataaataaatagaaataatcatttataattaacataaggccaatttaattatattcaaagtgtaaatatatagaaattatcatttataattaagatatggcctacttaattgttttcaaagtggaaataaataccagtaatcagttataaataacatattgcctaattaattgtattcaaagtgtaaataaatggaagtaaccatttataaatatcatatggttgaaaaatagtaatacattacaaattaagcagttgagaataatatattgatccaaattgttcgactttcaatacaatacaaataatttacatcttccatcaaacaatctaggtcactgtcttcctcacgtagtttctcctcactattgttccttcgctatgatcgttgcgtgagtacggcgtgtcctcctttgatagtatgatgctcgggtcaaccgtcactgcaaacggaggttgctcctcaaacagatcgtaattttcgtcagtcttatcctcgactccaacgattttcctcttgcctgggagaatgtaacaccccgattttcgttcgggattaaaaatcattaaataatgcattttgtagaaatttaataaaagttaaagcaatttaatcaagtgaaatattgagggaattaaaaatttcctttaaaaatcattggccgagaatattttgtaatattctttgtgccctaaatattctctgaaattttcccgtgaattttcggagctcaataagtaattataataatacaaagttcatttaatcaatttaaataaaaagaaaagaaattaaaatctccctttctttgtctttgggccgccccagcccaattcccttcccctcccgcgggccgcgccctctctctccctctcccggccggccttcctcccctctcttgggccgtcggcccgtttcccctctccctcgcgaagtctgttttacgtcccccttccaactctccctccctctctccccgataggtgggacccgtggaccccacctgtcatccccttcctccagctccaactgccgccatggccgcccgagccgccccacgacgccggcgttttcgcccaccttctccaccccgcgcgcgcgcgctcgtccgtgggacctcgccgcccacgtccgcgccgttttcccccacctctcccctccaaaaccgccacccacaccccacgatgccgcccacgccaccggcggttgccgccccgactccgcctctcccgggctcggtccagcctcccctcccctataaaaacattccccgcacctccctctccattttcccctctctcccgagccctcccgtgcacgaaaaccaccccgccaccgtcgcaccttccgccgccgctcgccgacgacccttcagccggtcgccacagccgctcccaccaccgcctttccgcgcgaccgccaccagcggtttcgccgcgtcgtgccgcaccccggcatccgctccatttcccctccccgcctccgaagcacagtcgccacgcgcaccacctctttccactgccgccgccgactccagtcgccgcttggcgccgctcctagccaccccaagtcgcgctgttgccgccgctcgcttcgtagcgccgagcagcacctcggccgccgcttttcatggccgggatcctgccggaacacggttcccctcgcgccggtgagcatccgcgcccgttctcacctccgaccagcgattcatgccgctgggagccctctctccccctcctaacctctctcccatccttcctaggtcctttcggccgccgtccgccggttcccgctcgcggaacgccgccgggccgccgttctgccttcgtcccgaggagcaccgacgccgagctcccccgtctttccccgcccctcgtcgccacgtctttggtgagctactcctcttcctctttgcctccctcctctgtctcccgtgcgcgctgccgcgcctgtggccgccgccggcgaccaccgggccgtgcgcggccaccgttaggtcggccggccggcttgccgccgccccgcttgcctgggccgcccggatccccttgccgcgcctcactgccgctttctcacatgcaccggccgtcgccgcaggaggccgcgccgccgcgagccgtcgctcagccgggccggcctgagccgtgcccgtgctcagccgcgccaccccgtggtcccggtccacggtggaccgattcccttgacccgctgacgtgtggggtccgcctgtcagcgccggcctctttgatgacgtcagcgcttaagctttttcctttgagaaaataaataattattgcgcaataatttggtttaattatagaaatccattaaaatggctcaaaacttctaaaattcgtatctaattcattcgaactccgattgagccattcaacttgtaaaattcatctaaaattgagctctacatgtttgtttagtttttatgtacttttttcttggtttttattagagtttttcctcgttttgcgtgccagcgtgtagaatccgtcgtttcggaagtccgtggtcgcgaggaaaagagttcggaagatcaaagtgaagaagcaaggcaagtcacacattccccttgagcatgttgatcccaatttacaaaagttttactgtttgcaaataaatatgcatgttttgctaattacatgggatcagggtttacctatctgctcgcttgtgccatatttacttgatatatgtcctttgtcaacattgggtaataaatcgactagctcatgttacttatgtgacctagctagaactatatgcttagccatacttaattaccactagctcagttgatgggataattacagtattagaccttttagtatcagaatgagctgcgtgctcgagacatctggccatgcttcatggtcataattatccaactaaaatgtgactgaaaggtgggctgtgggtgcatggttttgctagtcgcacccatggcaattatggaccggttcacgggaaaccctggaagaatttttcgtacttaccacaagccagcgtgggcaacggctgggcttgtagtgtagctttcctctagccgacgcatccaggcaagggtgggcgtgatggagcggggtgggccctgcgacggcctctgtcgcttccggattcacttaggcacgagaggggactgcccgctgccttgcgaggagtgggggtgaaacctgaggtgtggtgtgcttggctagagagggttatgcgaagggtcctgtcacggcctctttccagtatgtcgtggtggcatgtcggcgcacggaaacgtgtcgtggggctgtgtcttgtgggtacagttgtacacctctgatcagagtaaaactattcaaatagccgtgcccgcggttatgggcggtcgaccagattcaccgtgattagtcccaccttaatgaatcgactcaatgcactgtagttcaggtgggttggttgggcctgttcaatgtggtgtagcgttgatcagtggagattcaatattaccttaattactcaacagttttagtgttttgctcaataaaatgttttacaactgcctttatgcaaatagccacaaaccgtccttgtgtccccttgcacgtctgcattgttggtgaggcttgctgagtacggtggttgtactcagtcttgctattattcccccttttcagaagtgtagtgcttctgagctgaagacgaggttagaagaccaaggctcagaccccagttgagttttgcctgtggagtggagctgaagccccgctaggatcgtctttttctgctgctgctgcttttgtttcggtgtgaggactaagtgcctcttctgtaagtattttacgctttatttacgtttggaactgtatattacttgtcgttttgtgtacactggctggtcctggacagggatttaatacacaaaaaggtctgaaaatttgggctaaatttctgggtgtgacagagaacaacatggcgtcttggctcatcgggccctttccccttctttggtttgctatccatgtccttcacgtaaaaaacttgcgttacatcattggctagaacgaatggttcatctgagtatcctaccttgtttaggtcaaccattgtcatcccgctgtcatcaatcgttatgcctccaccagtcagcctaacccattggcaccgaaacagagggaccttcaggggtccatactctagttcccaaatgttgtcgatgacaccgtaatacgtgctagttggaccatcgtgtcctatggcattgatacgaacaccactgttctggttcgtgctctttttgtcttgggctcttgtgtaaaaagtgtatccattgatttcataaccttggaatgtagttaccgagctggagggtcccctagccaagaaggctagttgtcggtcaatcgtctcgttacccaggaggtgttctcgcagccaagcggggaagtatcaatatgatggcgtgtaatccaggcttcggacttgccactgttttctgagcgaacaattgcaaggtgctcatcgatgtaaggagcaaccaacgaagattgttgcaaaaccgtgaaatgtgctttacggaataaatcgttgtctacagtcataattgctctccttccaagtgtgccctttccccgtagtctcccctcatggattgattcgggtaccccgattggctcgaggtcttcaataaaatctacgcagaactcaatgacctcctttggtcaataccccttcgtgatgctttgcttccgacgagaacggttacgaacgtacttctttagagcgcccatgtacctctcgaaaggaaacatgttgtgtangtacacaggaccgagaataccaatctcttttacaaggtggctcagaagatgcgttattatattgaagaatgacggtggaaagatcaactcaaagctgacaaggcattgcaccacgtcatgctgaagggcggctaaactttctagatcgatgactttctgtgaaattgcgttcatgaaagcacaaagcttcgttattgttgcctgcacattatcaggaaggataccacgaattataacaggaagcagctgtgtcataagcacgtgacagtcatgagactttaggtttgtgaacttcttatccttcgtgcttattattctctttacattagaggagtatccggacggtaccttgatgctctctaggcattgaaacatactctccttctcttccttgcttagggtgtagctcgccggacttaagtaatagcttcatttctcgttcggttccggatgaaggccctcgcgctgttccatatgcttgagatcattgcgtgcttcgagtgtatctttggacttcccatatacacctaagaagcccagcaggtttatgcaaaggttcttagtgaggtgcatcacgttgattgcgtggcgaacgtccaagacctcccaatagggtagctcccaaaaaatagagtttttcttccacatcgccgcgtgaccatcttcgctctctataggttggctgctaggctcctttccaaatactactttcagatccttcaccatttcgaacactgctttcccgttgcgatgtttaggcttagtacgatggtctgccttctgttcaaagtgcttgccttttttccgtacagggtggtttgcagcaaggaatcgacgatggcccatgtacacaaccttcctgcaatgcttcagataagtactttcagtttcatccaaacagtgagtgcaagcgttgtaccccttgtttgattgtccggataggttactaagcgcaggccaatcgttaattgtaacgaatagcaacgctcgtaggttaattgctcctgcttgtcctcatcccacacggggacgccctctttcctccacagcactttcaaatcttcaaccaatggtcttaggtacacatcaatgtcgttatcaggttgcttcgggccttgaataataatcggcatcatgatgtacttccgcttcatgcatagccaagggggaagattgtagatgcacatggtgactggccaggtgctatggccactgctcatctctccaaacggattcattccatccgtgcttaaaccgaacctcatgtttcgtgcatcctcgccgaagtctttaaatgttctgtcgatatttcgccactgcgactcgtcagcggggtgtctcagcatcccatcctgtttacgttcttctgcgtgccaccgcatcattctagcatgtgatttgttcttgaaaaaccgcttcagccttggtattatagggaaataccatatcaccttagcaggaattctcttcttcaaaggctgtccgtcaacttcacctagatcatttcgtcttattttgtatcgtagtgctttgcaaacagggcatgcttctaggttttggtactcaccgcgatacaggatacagtcgttcggacatgcgtgaatcttctgtacttccagacctagagggcagactgtcttcttagcttcgtacgtactttcgggcaattcgttccccttcggaagaatgttcttaacgagtttcaataactcgccgaatgccttgtcacttacaccatttttagccttccattgcaagaattctaggatggtactcaactttttgtagcccttctcgcaacctgggtacaacgctgttttgtggtccgctaacatgcgctctagtttctgcacctccttttcactttcgcagtcctcctgtaagacccgcaatatttgaccaagttcatcagcaccgtcattcccttcaacatccagctccgcctcgcccattgtgttttcttcaaatccgccatactgagccaagtccggaatgttctcatcttctacttcatcttcttccattgcaaccccaacctctccgtgcgaggtccaacaattgtagctacgcatgaacccccactgaaacaggtgggcatgaatagttcgtgtggtggaatactccttctggtttttgcacttgtcgcatggacagcttataaaaccgttacgcttgttatcattggccccacccaaaaaataatgcacgccatcaataaactctttcgaccgccgatccgcgtacatccattgccgatccatctatatgaaatacatataaatcgtaattatacaaaatccaagatttacaaggtaattacataataatacaataattgaattaattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacacacactttctctctcatcatcttccatcacattttctagagggaaaaatatgtaaaaaaaatagctccaaatgtagatggtaagcaaaacaaagagtaggatgaagttgctaaccatttgaagacctcaaatttatatattaccaccaaaaaaatttgcttaaaattttgacagcacctccctccctcaaagcttaattttgaagcaatggctcgggcgggaggaggaagaaggggtatataaagctatgcaactttagtcccggttggtgttaccaaccaggcataaagatctcaaatcactttagtcccggtttgtattaccaaccaggactaaagatatgatctttagtcccggttgactaaagatcccaagccccccgacagaggtctgacatgccctgtcaggaggcgaaccgggactaaagatgatctttagttccggttggtaccgggactaaaaatcccttcgtcccgttgaggtaataaaccgggactaataagccactttagtcccggttcgttttggaaccgggactattgtggaaattggccgaccctccaaagacctcttctccagtagtgtatgctaatagtgtccacttgtatgatcagggtataagtagggattaatatatttataagagtagagtgatatagcaaagaactcatatctctcaaaaatcaatcctacgctatgcagaagaagaaatagaaaaaaaaaatcaattcctatactagaagtatacactcaatgctagtttacatctgctagtatacaactatgtagccaatacccctaatagtgccctcctggtgtttcgagagaccacctcaggttgccgcgttccttatgacaacctgtcatggccgtccaaccggggctaaatatagaagagtaccttccccatgaaagtttcttaggaatatatactatctcggaggaatacccatactgagctatcaccatcagtggcccacctcgactggcctgtagcatatatgcctagatatgatgcttaataatctagacaccatgtcttcattattaaatactactctatatcccccgagatgacatagagcaaccgagcattcggacactaaaaccacaccattgcacatctgtggtaggctaactacacaactgtaccgatacagatataaagtaaagccaatactcagataaactaaagtactgagagtatataaataataaaatttcattgcttccgaaagccttacaaaagtataaataaaagctactacagccatacccaaattcctctgaagactccgagagctattctattatactccacttagcactagaatactaaactaaagtatagagagaaatgctgagcttgcttgagtgtgtgttgagatgaattgagctcctccttatatagccttccaataacggttatggtagttggaattgtcggaaatgcctcgcaactgtcattgagaatgcatcacaagcgtacgcgtggaggaccgagctgaggcggcgctgccagggttcggctgaacccctgcccagcagacctccaaactttccagggtcactgacaggtgggtctctatgacagttgtgacagttatggtggttttcgggacggttacagctaacatgtgggcccatcttatccttaagcttgcttaggagtgaaatgtgcacgagaaacttgtatgtacgtataggatacgttgccatgtttctaatatatccatgatgttggagatgggatgatgtttcagaaaagcgtaaaatgccttcactgacagaaggggttgatgactaattggtcctgctacaggtttctcttctcttttgagtgttgtctccttgcacatactccctctattccataaaaaaacgaatctaggattgtatatgacatattctagtataacgaatctggacagaggtatgcccagattcatagctcctgaggaggtagctgagtctagcctgggaggccagagaaggaagaagatgcctaggcctgatatggaggaaaaatgaatttggatcttttgtgtgtttatgcagaccttaatcagatttttatcgatcatgtaatggtctgtatttgggcaagaacttttgtgtcatatcagttaaatgttccacttatgtacattttgaatatttgggatgctcctttattacagactggttgtgctagttctgtttattccagtctcttctatcaagtttatcatgaataactttaaatcttggaatgtgctctgttggaatattcgaggaatgaatgctgaatccaagttgctctctctgaggcagaaaattgaagatagtggttgccaggtttgttgcattcaagaaactaaaaaagaccactttgatttatctgatatcaggaaatttgcccctaagaatttagatagtttttattttgccccctccagtggagcttcaggacgtattctgattatttggtcctctcgagtttttgtggggacagtgatagaggttaacctcttttcagttaccattgattttacctcaaggcactctgcccagaaatggacccttacatgtgtatatggcccttgtagttcccctaaaagagcaaattttgtttcttggttcagaagtgtgcaaattgctgaccaccaaaattggattttcttgggggattttaatttctatagatatgtgcaagacagaaataaagatggtgcagatatgaatgacattttcatctttaatgatatcattagcatccttggccttctggaaatccctcttaaaggcagaaaattcacctggagtaatatgcagcagaatcctcttcttgagagattagattgggttttcacttcagtctcttggatagtggattatccaaacacattagtgatgcctttaaccagaaacatccctgatcatgttccatgtgtagtgaaaattgacacaaaaatccccaaatcccctattttcagatttgaaaattattgggcagagatggatgtgttttttatattgttcaggcagtttggtctttagatcctggtttcgatgatcttgccaagtgcatttctttcaaattgaaagtgcttaggaaaaagctccttgcttggagtaagaatctgtcaaagttgatgggattgctaaaaaactgcaacaaagtggtggactttctggatttagtcgaagaaaacagaatgctatcagtctatgagtggaatttcagagaaacagttaaggtacagattttgaaattattggaattgaggaacatctattggaaaaaaaggtgcaccaatagatggatgatgttgggggaggaaaatacaaaattctttcagtcaatagccactgaaaggttcagaatcaacactatctcacaaatgcttgatcatgatggacagattatacatcttcatgagcagaaggcttctttgtttcatcacagctttaagaacaggatgggtgtttctaattccccacagatggcttttgacttggactctctttttggcagacatatagatttgaacagcttggttgacatgttttcaactcaggaaattgatagtctcatctccattattccagctgacaaagcaccagggccggatggtttcaatggttttttcatgaaaaaatgttagcatatcatagctcaggactattatagactggcagctcattttcatgctggaaatgttgatttggaaatccttaatagctctttcataaccctggttccaaagaaaccctccccagagactgttaatgatttcagacccatttctcttatgggtataagtctaaaaatcttaactaaattgctagccgacagacttcaaggggtaatttttaaactagtgtgtgataaccaatatggtttcatcaaaggaaaaaccatacaggattgtcttgtctggtcttttgaatatattcaccaatgttagcagtcaaaatgagaaatcgtcctcttgaagttagactttgaaaaagcctttgataccattgagcattctgcaattctttcagttatgcagcatatgggttttcctccaaaatggattgagtgggtacagatggttttctctactgcttcttctgctgtgttattgaatggggtgccagggaattctttcaaatgcagaagaggagtcagacaaggggatcctctctcacctctgctttttgtgttgggggcagagctgttgcaaagaataatcaacaaagcttttcatcaaggccttctgtcaaaaccaattgatgaaagcagtggggatggtttcccaatcattcagtatgctgatgacaccttgatattgttaaaagcatctcagaaagaagtcttctatttcaaggctattttgaatatgtttgctcaatccacaggcctcaaggtaaactataataaatcaactctgtacccacttaatatgcctcaggacaaagttgtcttactatctagcattttgggatgtaagatcggttctcttccattcacttatttggggttacctttgggaaccaccaggcctagagtggtagactttgctccgttggtagacagggttgaaaggaggctgacatcaagctccatttgtttacctcaaggaggaagattaactttgatcaactcagtcttgtcttctatcccaacctactacatgtcctcagtgcagctaccagttacagtcatcaaggccattgacacagctcgtaagaattgtttgtggagagggaataaccattcttctacaaggaaatctctagctttctgggatagggtttgcatgcctaaggagaaaggaggcttaggagtgatcaatctgagagttcaaaacacagcccttcttctaaagcatatggtcaagttctataatggtgctgatttaccatgggtgaaattaatctcacaatcatattatgattctaaagttccacacttgatgatgaataagggttcattttggtggagggacatcacatctcttgcagacatatttagggggatagcaaaatgcgaaatcaggacaggaagaacttcccttttctggaatgatctatggaatgatgattttaagtgcactagctaccccaatctctttgctgtgactatgtataagtctgactcagtaaaggccatgtgttcaagacccctagaagactcatttgcccttcccctatcagatgaggcttattcggaattcttgcatcttcaggagggacagtttgactttacaatcagggatgggggatgcttggaattttatctggggctcagataagtacacagctaagaaattctataagctaaattattctgcattgcaaccccctagacccatgatttggctatggaaaacaaaatgtgtcatgaagatcaaagtctttgcctggctaatgttctgtgataggctcaatacaagagatatgctggatagaagacattgtgccaaagaagatgatgatctcacgtgtgttttgtgcaatgcgaactacagagagacaaggcttcacctcttcttcttatgtcctttcagcatcaggtgttggcaatacctaggaattgagtggaataataatttggagtttttccaaatgatctccctagcaagaatcaaacttgctcagaagggtttcttggaaattttctttttggcagcttggcacatctagaagcaaaggaatggcttcatatttcagaacattcagccctccttccaggcatggagatctctttttgtcaaagaagttcttctgcatatgtgcagaatgaatgatcctttaaagcaaactgtttttaattgggtacaagccttatagtctttctgtgtgacccacttgtaatctctgtaaccttgtaaatattttctttatttataaaattacactgatgggcaaagccctggcagttttcttgataaaaaaaagatgtgtcacatctagtactatgttgattttttatgggacggtggcaatatataagtgatgttcacactcacacatatatatgttttcaatatttgtgcatgttttaactatttcaaggtggttacacacaaattttcatacctataagaaacccacagtaattaaagccaatcagttgccatcccatatctaactctctataattatggtctcatttgggcattttttagaaaatatatatgcagactattggcatggagcagaaacaatcgacaaacttgatctatattaggtatagagacaaattcgatgataactcgttgaaagagagaaaacacattcatagaccatggccatgtacaaccgacaacatattactagcaaagatttggtaaaaggttcaataactataggggagctctatggttaaaactacagagtacattgaattatgtcgtctatcttgcaactatggtcattaagtcaagggaggaaattaatgtactaaatggtcatgcaataaatatatttctgcagctcaaaagtaccaaagtgtgtacacatgtaaatatatcaaatatatatcatatgctcaactgctcgtgagtctgtgagagagcaatgaatcgagctaggcaacaagatatcaacagctccagatgaacaaaacagacaacgccatacagaaagttgtacacacattttcagttttgtgtcaaatttgtcgccgagtgcgggcaaaagaacttataaagattattctttctgtattcgtaatttgacattgcttgtgatggctcttcgaaagcacattttcctcctacttttggtagtactccctccatacttacaaaagaagttgttttggacagcgacacggtctccaaaacactactttgacttcttatttctataaaaatatttattaaaaagtgatatatgtatacttttatgaaagtatttttcaagacaaatctattcatgtaatattcagaaaacctagacaacggtatcctgttggaacgggatatccttctatgagacagtacctgatacctgatacctgttatggtactgactgcatgttacccgatacctatgatacttgttacccgatatatgtgatacctaggacctaatacctgtacctgtgatactcgtgcaagagaatagttactatgtctatcccgttgcaacgggatccagttttgtagcagccctctataatgttttacattttcaaactcaataacttaagagttattcatgatttatatttccaatatttgacttaaacattgtcctaaacgactttctttacgagtacggagggagaacatggtagttagatgaagcatatatatatcttgctcagagatcgatgaattaggtcatgtccaacgggcgtacccctagcctcccaagtctgatatgggctaaaaaggcggtgaggaccatgcgtgcgcctggatcaatctacagactacaggcaccgtgcatccccgcgcgagacgccactctgagttgcgttgcgttgcgttgagcaggatagggcgcctgtgcagctctcacttggtgcagctttaaattagaccgggcccatttaaggatattgtatccattagggaaataaggtctttttgtatggcctaggcccacatagcaaacgggggtatggcctgcgttggccatagccttacacccatggtctttacatttgggatatatggaacatataaaaataaaaataaaagcagtgtggaacaaagtccaaatataaaataaactaagcaagcaagaaagaaaacacaaaatacaagctaagggtttgcaagagagagaaggttaggaacttctcttctgcgcacgtaaaacaaaatggctctttaacgcataattaattaagtattacatatatatagaaaaacttgaaatacaaatttgcgtgtttttaaaaaacaactttcttataggtttgtttttcttttaaaacgttgtttagtggttcagaacgcagtgtggattccctcaaaaaaaatccctaaaaaaaaaagaacgcagcgtggaaaacgagtaggcagaagtgaggaaacatgtactccctccgtactcgtaaagaaagtcgttttgcacagcgacatggtcttcaaaacacaactttgatttcttgtttctataaaaatatttattaaaaagtgatatatgtatacttttataaaattatttttcaagacaaatctattcatataatttttacatttttaaactcaacaacttgagagttattcatgatttatattcctaaaatttgacttaaccattgtcctaaacgacttcctttatgagtatggagggagtagtatacaacgcaccctagattataccctattgctatttcgtcatccaaagtgaaaaagtcatcagcacgcgttcgacttcaaacttttacgcaaccctcctgctacacgaagtagtccaagagggtcccgtaattgtataaaagtggagacacaaagtttaggggtgagactctctttcactattcaatcctccaatcaactgtacaatgagtagccccctcctctctttatatagtgcaatccaatatatagaaagttcggtgatgggcccaataagtgtatttgggccaggccttcatgggccaagcccaaagtttcttaacactcccccttgggcactcaccgcgtgatgtccatgcctcattaaaactccataaaaacccagtgggaaaaaattggagaaagagtacatagcatacgcatgtatgtcgcacagattgcctcattaaaaaccttgataagaaactgcaggaaaacttatcaaagggaacaagagtacaatccatccaaattcttgtatcgattttcttaatcggttttgggtacttgattcttcagttcaagcttttgttgatagactggcagaattctccccctgaattctgtatctctttaagtgtgaaccatcaaaactcgttgcacatatcttttcaaaagatagttcgagtgatgcttcaatggttaaatcttacatgatttttccataacttatagagtttgtatagtctattagtgctggtgcgacacacatatcatttatcttcttgataatgattttggggtttggacaaagctcgaaccatgttacttgctagaaatggtgaactatatccaaggaacctatgtattttcacattctgatatactatggttcacttcttcatgtgttgtaggttttcgggcctaagcaacataggtttctacctattttatctcaaactcgttcggagggagtgagctttctttctttatgcgatgatatgcggatcatcaacttggtttgggacttgatgcttgtatgcgagtgccctaatccaaaatttctttaaccattcattgtcaactatagaccatctttgcgggttgatcttttagttgattttcaacttcaggttgactgccaatgatttgctgtatgaagagaacattgcccatagcaggtctcataccaattcctattggttgtatgtgacacttatgcgagtatccatggatctattctttggcatgggcatgatcctttcattttaccggcgttggtgtgcactccaactgctggttttcttcctcaatagaaagatgtggtatgcctattctgaggttccataccatttgccagctctgaactggctcccactcaaattctggggttacttttagtgactatgagcttgagagttcctttttgtcccgttttcaccagacgtctccggttactttagggatttaaggagccgaagttcttgtcccattatttttctcgaggcctctggacaagatgaggtatacctttgcattcttcggtatttcatcctcctccggtgcattatattcgggtaatgcaactgagtcatgctctccgaatcacaaaagtgatagacagttatccaattcttatgtgtgcttttcatactttcattcacacgtgcttgattaaatgtgcatccatcctttcatttgaccattttccctgacatttatcattttaagggttatttctccccctaaatgactggaaataatccttcttattgtcaaggagtttaggctacgttcgtacctctgttaaaaatttccaatttttctgagggagcccttacggtcgtggagtatgtacatgtgtcaagtcaacaccagtattcttttaagtggacaacacatttcgaatagtccagatattgataattcgctgtctttggatctacgagtccattccagtggcgggaatttcaataacgatgaagtggacatttttagtcctattcttgtggacatccggtacttagtgctttttttaatatgctgatgccaacatgcatgatcttgcaggattggtttggtaagagcgtagtgtttattagacaaattgcagctttttcataagcgcaatatgtatcggatgatccattaaaaagggctaaatatgcatgtgaattcatgtggtatacgagaattcattacgatatacctttcaaggtatgtcgaaattcatgtggtggtcgatgtttggcacgcatccgatgttcgatggtatgcgcgaccagagtgaccacggggtatgtagccagtgcaactatggcgcatggtaggagttgcatgacgcgtgttgacgcggcataattcgtccagtccgccagcacaacggggttgctagttggtgcatagtacggcatgtagagcgcggcgctagtagcggccttagtgcgcgtcataatgctgtatgatgcacgccaatgtctggcgcaagtctggcgcgaggcgctcagtgcacgtgacaaatgtctcatcgctgcaatactacaggcgatgtggcattgtttgtgcaatattcatttgtaagatactaaattctaagaactgactatgaaatagtctactttagcctacatttcttagtgaggacgttgacctcgcatgcttaggtgatgagtatgcttctctcattttttagttcctaacagggaacttttgtgcgagagtttgcaattctcaagagatttgaggtgtaatcgcttttctacgggaaaaacaatatcctttacaatcattgcgtgcggttgtgaaggtagttcacgtctttgcatagaccgaacttgtctcatgtctctcaagattacactttgtggtgcttttgttccacaatgttcctcttcatcttaggctatacatattgtctatgagaataaagtaaaacatcactatgtcaggacaaggagtaaactttatcatagagcaaaatgcaacaaaatattggaaataaagtctagccatgcaaggcgaatcacgaaataaatgttatgctctcatagagcttacaaaaccattattcaaattgttcctaatgcaacttagttcatgaaataaagtaggggcatcaaatactcaaatggaatcaaccagagtatcgagctctgcaaagatatgcttctgtgtgacatccttttcatttgttgtgcctgctgcagctgcaggggcgtcaagtggagtagtggtgaagggagtggccgtagtgtgagcctcaaccatgtgtgcttctacggacgccttggccttcctgctggcctggtaagcgtcgacgacatgctggggctcctcgcagatacggctctagtggccccaaatgccacacttgtaacatgtctggtactgttggccatatggcttgtcattgcgaggtggcttggcttccttcttgcccttgcc

SEQ ID NO: 62213 - DNA, 69460 bp, Oryza sativa
cgattccattgagaagaaaatgtgcccagcactacacctagaatcttgacagcattagacacggagagatgtgaatgtgcatagcctgtgtatatctttccgacagtaacgtcttaggcgaccaaaccctaaaatctcccataaaaccgtggctaaaaacattgcacaggaacagtgacaggtaccactctaggcctgaaactgaagtgccaaactgttcaggtaaagaaacgtatcaacttttatcgaccctctgattttcaaagccactggtaagttcagaattacagaagaagcatgatattgtcttaactcctagtccatggtaatatcttctgaactggaattatacaaggaaacgtatgcacttcatctcaaactttttctcactatagatgcaattggtaaggttgttgctggttttttcagatctgccgaatgaaactgggtattattatgctatctaagttgaagcataaaaaaagccgcatgatggagagtatatgtaagattgaaccttttctttgtcacaactaagacttggaacaattctgtctgaagacttgaaaaattctgtctgaagctttgttaatgtatgtctgaaaactcaggagttgacagggaaaaccaggcgaacaaaccgcggtatgattcagatgtcgcttcacatcgaattcagatcagcgcgcaattcattcaaaattaagtttgtaatgcgacatggatggaacagccgtgatgtagacatcattagttagtattagccttaataacaatcatggaccagttagtactacgtagttactgttggtcaaacgaaaaaaaaataacagatcactcctgcacgaaccaacggccgtgcgttttgtagtagatggtagcagttgtttggacggcaattctttttatgtttggagagatgacactgccgtcatcatgtctggctacacttgaacagttttgcttgcactcatagtcctctaattaaatactactacatacatggaaaaagaaaagaagtcttcttaattaaatgacattagtttgttagtttgagatgtgccattcgcatgtttgatcttatttgattagtggtaatggggcacacccaatgaaaatgaagtttcttcatctgttgggtgatgcagctctgaacaccactcattttgcaaggtagcttaaccagagaagattggataacctgagggtttatgtgggccaattagttcctgataacgtagtatcatctgcagatttgtggctggaattaaaatttgcagtagtactgaaggcagcaagcatgtgtgtgtgttaaattactttctttattttgctctccacaaaaacaaagattttatttgatggtaccactgttctgaagctgtactgtgaaatttacttttggtgtttggcaggagcagagaggatttggagtactaagtcggtgcaaccaattaatcaggatcatgcaccgacctagcttgttttgttcatctggcaccatatcatgagcaattaaatttgcaactcttttcacttttctttgcaagcaagctagtagaacatttcacactctggcacataagtttgctttttgtactacatgaacagtaaacatcactaggtagttttaaaactctaggatcctttttccttttttgactctggcaagttctttaattttcttgaccctgggaaacgtgttgttaagctttttaaacggtcttctcattttcaaatacattatcactacatttggtcgggtagcaatcagtggatgggcaatgcttttgtttcaccctatctcattgagattaactgcatattcaaaccttgaggtagaatcttctttccccaaaaaacaaaacacacacaaaaaaaatcagagaagtgaatcagtcctgagatcttatcttctcctgcctgaaggctgaagcagagtgtagttttctttgatgtaagcatggtataagaatcacacttttcttgttgtaacatttgaaatagttgatgacactttacaatttcttcccctcaaagaaacactgccctgcatcttgcatgtcagtgttgcaatgtaccgttgcattttaatgtatgatgttattgactatcgaacttatgtttgataatttgtcttattaaaagattacgtaattattatttattttgttgtgatttattttttttattgtatgtactttaagcatgagttatatttttatatatttgtacaacatctttaaataaagcaaacaatcaaaacgtatctttaaagttaacaatatcatacattaaaaaccgaagagggagagagaggatatactactgttgtgcaggattggttacaagtcagcagctagaaaagcttccctcctctcagtgggcaacaggtcacacaaatgctccatccactagggcaaagaagatcgaaccgatgcaaaagaggcctaacatgcacacaactgcctagtgcttagcacttagcagcagtaagtaggtcgcgacccagtgcagtgcagtgcaaaccatcacggcatcgatcacaattcacaaacctcctccctatggccgatcgatcgattcttcgctagtggcgtacgacgtcgatcgcgcgcgttgcgagcttgcaacaccagcaatttttgagcacttttctttgttgcagaaaagagaccgtcttgtggttcttggatggatagggctggattctagcttgattggtgcaagggatggaggagaatggaggaggaggagaccccagctgatgaacagcggactgactgatgcctgcccgcgtgccaaccggccaaaatgatgaataaaaacatacatatcgtcgtcgtttttcgtaccccagatctgtgacagatcaatcgatgcttatgcagttagagcaagtacaatagcaggctatacgctagctataaatatattttaaaaagataaaagaagagagagaagagcagcgggctacataactgtagctagttgtagcacggactcacaagacgtaatgtgtgtatgatatgtgggaccagatattaatattataataagcagctattgtatgaattgcctataaatgatttgaagttagtagtgggctacactattaaacttgctcttatactgtatgtgattttacgtgaaaaggtacaattcagatatagatggacgtgtaacgtataccggtttgacaccggtaacataatttcatcgtctgcttattagcttattattggcgacaactaaaacttaaaattcaaaacttaatttagttcgagcattaattttaaaggtttttttatcgcagtctatttttcactatcagcttttaaagtttattacaaacgacacgtggattttcgcaggatggacatgtgggaaaagggttgacaagtggtgctgcgtgtgtgccctacacacgggcccccggctcggccaggcaaagcgagaggagtcgagtcgtcggtcgttggaggagatgagagacgagaggccgagatggcgcgcccccgcggcggagtcgattggcgggcgagatctcgttgcagattgggtttttttttttcgcccacgcgacgcgatgaggcgcgcggccgcggcttatcgacaattttctccgtaatccgtcgcgcgatccacacacgagcacgatggacgggttgggctccacgttttggccgccacggccgctcctttttttttctttcccacggtggtcactcgcttctccgttccacatcggccgcgtacgtgcgtttttttgcgtatgcgtgtgcgtacgtgcggatggtgcgaggggaacaggaacagcaatggttttttgttttgttccttggcctgcaattgggcatgtgatagcaactcgcagttattgctgtagttttgtgcagtttttttttccgcagacattttttcgatagacagagaaagaaaaacagctttggaaaatactactccatccatctacaaaagttacacatattacttgtgtcaccaagatcaaggagaaattaaatcatcttctgttacaaaaatcaagaagtgaatacaaacatgcaaccaataaaatatttagatgactccttgagttgtaatcaaacatttaatttatctcttcatgtaagtcttgaatgcataaagactataaataagaacaacttatttggaacaactcaaatgtgaaatatatctaacttttgtggatagagggagtacgagtgcagtagtagtacgtacatggtccatgcttgattagtcgtctacagacagagaaaagagtaacgagagagagagagaggaggtcatctggtcagccggggcatagtaacagtaactcggcctcgtcgtgcagtgcagtgcagcgcatcggaatcaattcgatctcctttcgccgggacactactgctccatagcatggcagtgcaggccgtggcgcccatccagtagtagtaataaatcgaatgaatgcgagctgcgaaaaataaatatggggcgagccggcgagtcagtcgggcggacggaataaagaaggcgcggtcagaatccccgcacgcaaacggggtgagaagaacccgaggcgcgacacatggaaatcagtcgtatcgatcaatcgttctcccccacccgcgcacgccgcgagccgcgagaggcgcgacgtacgcgagagaccgcgaccgcgaaccccaaacccaaccacaaaccaggcggcaaccactctcccaacgccaacaccaacgccaccgccaacgccaacgccgccccgcatcatctatcaaccgccggccgaggtggaggtgagttcacccaatgcgccgcgctatgcgtcgtaggcgcgtcgtggtggatgcggcagcggctgacctgcctcgccgctaagtttttctttcgcttgtcgtcgtcgccgccgctgggttgggttggtggtgcatgtggggtacgtacgggtgggagtcgagcgccgaatctacgacttgcgcgcttactatcacgtgccgcgcgtcaccagaaactggagacttgttcacgttcaaggcgatttcttcatctcaaagactatatatcatcgttcgatcgggtatggtttcagagggagtgactaatgtagctaattaagatcgatcggccccaaggtaggtagacaaacacatgcccacacatcatgggtgcatcgtttgtttgtttgttgatcaggttggacgatgaacttgagtcaaaccacttcaagtatttttcttggattcattgactactccaaggtcgtaacaaattcaacttgcaccaaattttgccaaattcacaaatacggtctatttgtctttatgttgcttagagaaataaccagccagcctcgtagttccctgctctaattaaccacctagttcctcatatcttcatatttgtaaattgtaatcagacttattgcttctttgattacctgatgtaagctctgtcgaggggagcttttgtcaattacaacttctctagctttctaaacagtccagattattatcggattctaagaatacgttattaagaatttaaaaaataaattagaagccaaaagctaataatcccatcttttttcatattttcaccatctagctactcactagccgctttatcaaaatcttagggcctgtttggggagcttctagctgctgcaacttcttccagaattagaagctccccactgaaataagaattgtgtcccataaaactccaataccccctttagccctttttattagatatcttttgtcagaatttttaacagttcacttaaatctgtcttaaacgctttttttcgcgaacatgcaaaaagatcacacgtcaatatattagaaaaaaaaaggtttagttacacaaagcaacatgacagaaccgaccactgctgggttacaaggaaaatgaatgcgggggtgaagaaaaaaaaatgtaaaattgaagctgaagctactgctcctatataaaggtagagaggtggtgaaggaaccccctatatatccggagatttttttttgttggaatacacaataaaacatcactggtatgtttgtgttaactataaattgtgatacagttgctctcaaatagatatgttgctaggtacaatcaaactattctagtgttaattatcaatttttttaacatatgcctggacaagaatatttcttcatgtaacattatgccattctgttatatatacaataaatctgtactcccaacacgcaaaagattcgagtgtcaaccattttcatccaaaattatgtcacgtgaggcctggtgccaattttttatatgacctggatatttatgcaaatatatttctggtcctaccaatattgagactacccagtagctggaagtgttaattatacttggaaataaacgcattgcataaaaacagctagtattaccactaacctttccatctccaaaatcagtttaacatcgcctaatccacgtcggtttaccgccatatccgtttaacagttccctccgaccttttagtacagtttagaacaatcaataacgatgcgatatgtaccaagtactaccatccatccacaatatcgttactgaacaacgtaaaagccgtactacacgatcaatacgaaagtgaacctgtccttatattttctagtagtatttttttttcttccaaaaaaaagctgcctttcaaaagcccagcacccggtgtttccccctcaaaactaggttattactcttactccctctatttcaggttatacgatgttttaactttggttaaaatcaaagttttttttaaattttttttaatccgagataaatttattgtaaaaatatatttaattattaatttaataaattgattttgtgatgtaaatattactatatttgactataaacttaattaaagttaaagcagtttgactttgatcaaatttaaaaacatcttataaactgaaacgaatggaatatttactatttgcattattcggcaggagaccaggagaaagacaataacaaaaccgactagataaaaacacgatataaaaaaaagaacagtattccattctgggtcactgacatcgtgggcccacactctgactctctccgcatcggttatactacgcgcccaacctcctatataaaagagtctccgcttagctatctctttaacacaaagccattacccaaacccgcgctccgctcgctctccaccgctcgccgcgcacgcctcaccggagaccagcccgacggcggcggcggcggcgtcggcggcagcagcgggagcttggactgagatgaggacgaggagtggatctctctaccgcagcggcggcggcggcggggagacggccatggttgggcagaagaggaagaggtcgtcgttgccgccgcagtacgccaccgccggtgactgctgcggcggaggaggccgccggaagaggctggccggtggtggcccggattacctcgacgagctccccgacgacctcgtcctcgccgtgctctccaagctcgccgcctccgcctcctccccttccgacctcctctccgttcacctcacgtacgctcgccgcctccttgtctcgatcgattttgcctttgcccggaaaacaccttcgtcttccttcgaattacaaacgagtccttccgctcctctcaatgctgtggaaagagggaccgatttgcaatttgtgggaagttgtggggggtgaatgggggataaggcgaatgaatgaatgaatgatgatggccactaaccgaggcgtctcgtctccctatctttttgacgacggcttgcaggtgcaagaggctgaatgggctggggcgccatgacatggtcttcgcaaaggcctcgccggcgtcgctcgccgtcaaggcggcgtcgtggtcggagcccgtgcagcgattcctcaagctctgcgccgacgccggcaacctcgaggcctgctacattctcggcatggtacggcgccgagaaccctagattagacgtgtggttgagctgtgccgatgagatgttcgatcgaggtgctgatgggtgttttgtggctgtggttgcagattcggttctactgtcttggcaaccggagcggcggcgcggcgctgctggcgagggcggcggtcggcgggcacgcggcggcgctctactcgctggcggttatccagttcaacgggagcggcggcgccaagtcggaccgcgacctccgcgccggggcggcgctgtgcgcgcgcgccgccgcgctggggcacgtcgacgcgctccgcgagctcgggcactgcctccaggacggctacggcgtgcgccgcgaccccgccgagggccgccgcttcctcgtcgccgccaacgcgcgggagctcacgctcgcgctcgccgccgcggcgtcgcaccgccccttcgccgccctccccctcgccggcggcgccgccgccggcgccatcggctgcccgctcctctccgacttcgggtggagcctcccggaggcggagccccacccggccaacctcttcatggccgactggtgggcgtcccgcggcgtgcaggcgacggccaagaaacccggcctcgaggctcccgctgccgccaccggcgacagcgacggcggcggcgagctccgcctctgctcccacgtgcggtgcggccggagggagacccgccgccacgagttccggcggtgctccgtctgcggcgcggccaactactgctcccgcgcgtgccaggcgctggactggaagcgcgcgcacaaggcgcagtgcgtgcccatggaccggtggctcctcgccgccggcgaggcccagtgactcgccgccgccgccaactactcccttagaccaatcggtccaccggtttaacgctggaccgggtgtagccaaggcaagtggcagagagaaaaaattgaggaagctttttttttctttttttttcttttttaccgtttccatcgatgtcgtcttgtcagatgtacgtattccactagggaagaagagggtagagatgctacggatgctttttactcgcattattccttttttttttctcattccgagtaaactaaactctaaattaaattaaattataattataattataattccaacccctttaaaagacacagggggtttaaaactaaatcaaagaacttaatttttttgtcgtcttgtggtttggatttatgctgctgtgtggagggtacggacaaaggcagttcgggctgatgctgttcattaactcttaatgagggtgattaaccaatcttgattagatttttagattagcggcagccatggatgggaagccgtgcaggctgatgctgctgcagccgtttttaattttaatttaaaatttaaaattttctttctcgagggttgagacaggttggagttttctccatggctggttgtgtagttggacttggagagaggatcggaaggtggtggtagccaggtggtagccatctaggctaccgctaaagtgacatcaagcttttgtttttatttctaatttaattttgtttcctaggtcatggaaagaatacaagatggaggtgtcctcttttttatcgacataattaccacgtatatttgtatattacgtagtatatactaaggacagatatatacgttgtaactacttcctacctggtcgttcgttcgaacgatcaaaatagatggttatacaaaatacaactataaataataagtagatggtttacttctacggtgccttgaagatgagccttcttgtgcagagttggagtcaaagctgaagagagtagtatgtgattatccatggattaattaatttaactaataatatgaggataattgtagtagatggtgtttggttgtagtcaaggccggcctgatccgacggctggggtccaacactagatccgatctaagctaccacgcggagtggctcggagtagagtactcgtcgccgactcgccagcagctcaactgaatttaaacatggcaaatcttgcatcgcctcatgatcaatgcttgcttctcctgtgtgcttttatacactttgaatgctgatatcgtcaatttctacgtatttttctgtcctctgtgttctaaatcgtacgtttttcatattcatgctcgaagactcgctaaagcagggatggataccgtatttttcctatttctatattttttcgagccgcttagccgtgctactattatttttaagataataaaataacattttgccctttactcaacgagctacagtgattattacaaagtctatatataaagaaattcagcacacactgacatgatataaagaaaacacaaactaaacgagataacccaagatgaaagaatcttgaattactggattctatcattgatggagctttttggatggagtttgttttcgtgggggcatcgtgcgacgatggtggcgccgtttttattaagttgtagcgtgttccaattagcaagacaaggtgtgtgcatgaatcatatgggggctcttggctaatcggatgtgttcatgtgtagtacaactacatgtacatggtcccatgctgaattcagaggttagtttgcccggctgaatttattagtggatattgtgcaggagaagcaagctgaactctattattttgatcacaaattgatcgcaatcccagctgcattattcacaggaaaaaaacaaaagaaaagttggtgatgtccctgcatggggcaaacccttgaaatttccaactggggcagaagctgagactgaccggtagtacattgtgtctatagttgacacttgacactgcctctgctcaatttttcttccttttctcccatgcatgatgcgctcatcactgctagcttcgagtcaagagcccccaaagggacagattaattaacatctttgatactatcagcatccgataattactattttgtttgcactaatggtcaatggctaccaagggacagcatctcttgagaagtgtgtgtgccggttgccgtctgtctagttcttgcagctgcaaattaacctctccccaaaacaaatctgatgaaatgcgaccggaagcaaccaaacatgtagtttagattttgcaggagctgcacattaattgtgcctaccaaactgaagattttgtatctacatggacagggtttctacgagggaatcttcagagaaatggagcgcatctgcgtatgtgtatttgcaatggttgggccgtacagcagctacggttggtacctgcacaaaatgcttactgaatttcctcccccaacagtgtctcattagtcctaattaaccaacttggagtagtacttatcagaaattcagaaaattcagaatgggacacatggaacaggaaacccactgttttcttgcagtattagcttccaaaatgtcaatggtttggagaaaaacaggagaatcatatattcatatcacatgaggtggtgtggttgatagtatcgtatcatttttgtgagagatgatgagcaagaagtggatgcaaattggagcatgttgaggggtttgaccaacaccactcatgtagggtcaccttctccatgaccatgatccatacatatatactccatggcttatcattgctcagctgcagctttggcttctctcttccctcaccggcctctgtactttttgatgacacacttgcatgttattagtagcagttagttccctcatcacccatcaaggatcaagaatacttccattaatttcatgttagagttataccctaatggcttaattacaagctgtaaaatcttcaacctagtgagttgagaaaaatactttgagatccgtagggtaaattaatgcgatatgatcatcattagttcgtgcgatgaagctgggaaaagagaaaagagagatggggatgcaaagaaagaacaagaagcagctgcatacactggaataaagctgaaaagaaagaggctatatgctcatgctcctactactgctactcctctcgcctttctttctctccttttcaagctctgatttctacctctctctctctctctctctctctctctctctctctctctctctctctctctctctctctcttctttttcttcccccctgattcctgtgcatttgcaggtttgttgcaggcaaaagctcgcgtccgcagcgtgtgcgtggctgactgtttttgtgctgatcaacgatgctaaagcccgggaatccaatccaaacggcggtgtcggtatgtactctatccgtcgcaaaatgtaaaaacctagtaatacctaataaaacatatcaaattaggtttatctaaattcttaataaacttttttttatctaaattcatagcatttaatattaggtttttatattttatgagttgggacggggttagtagctcagtataggagtagctagatacagtcatttgaatttgtgatagatgcttagggttgaaaacggttcacggaaatttcggatggaccgagcatcgtttcggtaggtaaaagtcgaaccgttctcaatttttttcatatatagaatttgtatttttaatttctttcagtgtcgtacctgtacaatcgctataaaattgttaaattggtaaaaattgatcaattcgttccggaacattttcacccccgtcagccaacttgccatgccctggccggccgacatgtaacattattgccgagtttatttgctgtacgaacagatggatcgccatggcagaagtgcagaagacggttgatgaagtagacgttggagtgcaggcagcaagaggagttcgttcaactaccccagtggtagtatttatgacagcgatcgatgcacagttactatacctgatcacgggttcatatcctctacggtaacaacactcacgcaaaataatactaagataatataatccacgtattagtgactgtaacaatagtgataatatgatagaggattctcaacccccgatcaccactgacagcatcaggcatgacactgttattacttctagctaggtgactactatatattttatggaatctattgaagtttataataataataacatgtttttctcgtggtttagatgtgttaataatccatgacgatggaaaaaggtttgaaacagtgggcatactgagattcaagaagggtggtggtgtcgtgtgtcgtgtggcagaggcatttaactttggaaatgacgggtttttcgaaagggccagaaaccgtagattttgcagaatctaacctctagtcagatcagaacagcggcgacgactacgacgacaaccaagcgtgacacagacgcgcgggcaatgcacaaaatcaacggccacttttaatactccatctgctacataatctctcaaagaaaacctcacgaaaagagcacgattacgcacgaaaagacgagggaaaaaacacaggaggcttcttgcacatgctctctgaataattttctctgaatattgtttccgtcagagctcgcacgaagctgcacgagaggcgtgatacgctttaatttgggcactgattaaataaatatactatactctatagattagtgtggccttttcactgtttcaggtagtaattaattagctcagctatgaccatgagggtaatgagcgtgagtgctagctagcttagcttagcttttgatatcttttggcaacaagtgcactcgatttcttctcttgatgaataaaacgaagaaattaatggaattacctttgcgtcgcggttaagtcgagcactgagatttgcaaaaaaaaaaaaaaaaaaagggcccggtcaaaaagggacaaggcgaaaatgagcaccaatctgacagtaacaacaacgaacaacaggagtcagttatcatctagtgcaccctttgacaaaaatgactcctgttgcagtgtacatactcatggttcaatctcttggcaatgatgaatctgcacaagatttgcagtggctgacaggtcttgcaaaatcatctactgtcaagccattgcatatcaaagaaaaaagtagtgctagtttttttctttttttaaaaaaagaagaagaaaaagaatcagaaatactagtgggaggagtacaaggaatccaaggctgaaaagaggccaagaaaagcatcataaaatgctagctatatttcagctcacactatcttctgcacacttcccctttgaaaccaagcaggaaaaaaagcttgtcagaaaggaaacgggtagaaagaaattaaagaagtttgagagagtgatgaaaggatcaatttggtaaaaataaaaagagaaagacatttcagattcgattccaacatgacacaatgggtagagcaaaaggccaaaagaaaaggcaggagtagtagtagaaagacagcaaaaaaaaaaattcttggattcagcaaagagataaggcaatgggggtgagaaagaaagaaagaaaaggagaagaaaaggccattgcaccacatatctccccttcttttttcttcttctctttatctggatttccatcccactagttctcagagagcatcatctgctcaaattagtggagtcacattagtggagttgtgacgattgcaatggtggtgttactggtaacattacttgctcctcttgtcattgcacgtgcaagagtgtgtggcttaagcctaagctgctttcacaatccacaagctattgatctcatctaaggagaaagtttctttaatttgttatgtaataaaactatatcaattcaccacttaagtttggttttggaagtatctttttttctatttcagatagaagatctttatgtcattgaataagagaagaaaataaggtagtcagaattgcaaatggaactgaacatgctgaattttcacagttgcaaaagcatgatcagctactgcctcttaaccaaccaaccaaccaactagatatatactagtacaacatgtggtgatgttgatttatccaagtaaaatggattgtaatttgtcaccaaagaaagaacaagaaaaggaacatgctgaattatacacataatggcttgtagcttagcttgtcttggttgcaattgctgctgcagatgatgagatctgttgcaatggaaagagatgacaccaccctctgatgtaccaacaagcgtgttgtgaaagccacaatgctctaaaaaggtttgtaagtgggcgtttactcaggtttggatgatggagaggcagcacagcagcaatgcaatgcaagctgattagtaggaccacttaccactgacctgctagacctaacagtgaaaaggagattaattaagccatccacaagaagcatttgaaactttggagcgagctaatttaaggaggcgtcgccatcagcagccttcggttgattgctgcaacgagcttgagattttggagtaccagcaggagagtaacatgacgtgattaatgctctaatctctctttctctctctctgccttcaattagggagctagctagctacccggccagccaaagtaatgctgctcttgttaatggcaacatactatatgggttcagagattcagagtaggatgctaataggtttgtaattgtgtagtacctcagcacttgaatgctactgccctagatttttatgtttgcatgtacagaatgctggtacatccgattttttttcttttgaatgacctaatctcttaccatttattaccaccaaagaaagagctgctagtatgaaatggtcctggcaggttacttaatctgttgctgaatagtatagcaagagactgggggaaaatggtcctgacagcagcttgcttaatctgctgctgagttagtactgcagcaagagactggaaatggtcccagcagcttgcttaatctgctgataagcactgtagcaggagagtgagaccggccagtgattaaccagcagatgtcgagactgatcatatgcagaaatgaaagatttctgcagagtagctgtgctcatgttcttcagaggagcacatggaatgcagggctagttttcttcagaggtgaatgaaccaaccaaacaagctgaccactgttccacagaaattaatcatgcatggatcggatacaattggcaactaatgctaacaacaatcaccaaattctcatgtgcattttgcaggctatgcttgtgatgggattaaacaatgggagagagtactactactagtaaaaagtagcagtactgaaacagcgagaaagaaaaccctagtgctctgcctgcttgctagctatcaatggcgtgtgtgtgcttgtgtaccaaaaggctgcaaactccttttaaccacaccacaccaacacacaccagcttctgctgcatctgcataatatgcactagttgatgagttagcaaatcatcaagcaaccacacatctatcaacacatgcaaatgcaatctcaatccatggatccatctgcttgttttgttagcattgcacagcttcagggttcatgctgctgctgctgctgtttctctgaacttgtatctgaatctgactgaccacatgaggttggggccactgcaatgtatgcgtcgcatgaaaaactccaaagctagggttggattagaacgcacgaaaccggccatttcgccatcacgagcgagctggctggcaggcctgttttaagggtactactgtttggtgttaaattggacgacgttttagcgagcgattgagctgattgatgatgatggtcctgatcgatctctgcaaataagttttttgttttctcgggcctcacctgtttagcctaattaatgccacttaaggagcaaaaacatacatgctcaaatagtgatcaaattaaaccaaaaggttaaatgttcttttattgattctctgtctcgctaattaaggacagattggtaacaaccaagccgaatttgacttcatcatctcaagtagcgatcaaattaatccaaaagctaatcgaaaacttcagaaagatgtacgtaggtaaccaaattaaaatgccctgcctgcatgcatgtgaggcagcagacatgcatcaagtccaaaagtggtgagaagaggggggttggttgagcttttgtaccaccttaataattttgagaaattttttttttcagtcctatgatggatgagggcccaagcaaactgatcaagtcaagaacatgttgtacctgtttgctgtgagtccaattaatcagcttccttgctatctcagccaaagtgcatgcattaattcatgaaatgcaaatgcaatgggtgtgtgtgtgcgcgcgcgcgcgcgcaaagaaagggagcagggcaacccatgctggccaggccaccaacatgccataactgcttacttacaagtgcaaaaatgcacacagattgtactaattaaaggacatgcatgcagctaagctaaccagctcccaaatgattacccacaaaagttcatcagtctcacacccaagctagctagctactaaaaagacagatgatcgatagtgatacatatacatcatccgtcctaaaatatataagatatataggttaattattcggtgataggatcaaaacagtagttgtgtgttccaatttcaactcttggctgacagaatggctggtgagtcatctgatattcagggatgggctaaatgcaatataaaatactactatgcatgcatgatgcatgccatgcattgggttgctgtcttgctgatctgatgatcacaagctgagattgctgttcatctggatttatttgattggtactgcaggacatctcacatctgctgccactaaacaacaatgcaccagttcagtttgatgcatgaacacagatcatcacaacacactggggtcactggctgactgacacatagacacatgctagctcatgtatgcaagtatgagaagtatggctacagaggttgttggttgtgggtgcagtgcactatggcttagctgtggctggctgccactatcattgtttgaattagggttcatgcaggtacagagagagaggcggcgttgctgtcgatccatccatcgacctgcacgtcttgtagctaattaaggtctctactactctctactgatagagtgagtcctgtgtgttattccaaatgtccatgctggctgtttggttgttgactgttgggtcaacacatggtgcgttgcaccaagcaaattgaaaatcgatcggatcaaatgtaatcggtgcaagtgcaatgcatgcgaacacacggagttgtttgtatcattttcatgagtacacattaagctccgttttaatccagaacagtatttttttatagttttatgggaattaatatttttaaaatcttacaggaattaattgaattgattcccgtgttactttagacgagtgattgaggtttttctgtgaagtttcacgagaattgaactgattcttatgttacatacttacactagatgatcaagtgagtttttttctcctaaatttcacgggaattgaacagattgccatgttacattacacaccctccatcttagaaaaaaaaaacatctagccatatatctgaacatggactatgtataaatacatattgagaaattggtttttgtgtgggagggaggaagtacgagtgagaaggcttccaggttactcaagaatgagggcgacacggacatgggacggcgattcggggtgatgactgatgaagtgatgagtgatacaagaggcatccatccacgagtctagtagcaagcagcatgcatgtcgcggcgggtccggccggccggccgggggcggcggctactgtagcttagctgctcatcactctcacacgcatgcatgcagaggcgtgaggaggaaggaaggaaggcgttcgtctccgtgttccccacaccggcgtcagctgctacacctcccccactttaaggctgttttgtcctcaacaccccagcagctaatctaagctcgccgtttcgttgcgtttgcgtgcaatgggatcgagtgaatcatggatggaggagaccggccggtaccggcagttactacggctttgtttggaggagctttacgaagagtttaaggttggttctaactttttctttttcgattggaggagctttacgaagagtttaaggttggttctaactttttttttttcgattacatggcagacacacacactattacacacgtaacaccgtacttatccatccacgaatacattcgtaatacacgttaaaataacagaaaccaacggtacattcacgatctcaccaagctcatattaaaattttacatacacgtgagaaatattcgtgggcactaggatttaaattagatttggtggttaaagtcatacaccaataatcctattaccacatcactgcaaattctagaaaaatgaattatgggtttgtgtggatgagtttctgacagagtttagattgattataagaatatgtagttacataatttagggagtttttgaggaaggaaaataagaatattgagaagatacgtaaattagttgagtattaattatattaaacttaaaatatattaatatgacttttcaaagcaatgttctatagaattttttttaaaatatatcatttaacaatttaggatgcatggaaggaaaataaggaactaatcctctctattaacgaacacactcttataaaacaaactagtgctggtatgtagaaatcggatattttttgtttctctatattctaatcggctgtttctcataatatctactacctccgaaatatgattggttgagagtagatgatacgtcgagaaagtgtgtatagaaagttatatttggttgaggaaaaaaaagatcgaataagttgttatattttataacaaatttggatgttaaatgttttttttgacaggaaaaagagaatttggatgttaaatgttatatacatactttaggactactacccctcactacctcactagttctgacataggtacggccgggccatcacaaacacgggcccggaggctgagacggggatccatgatggatggatcggatggatggggccgaaacggatggactgttgttagcttttcttcatctcgcaggaaacgccgcccgcacacgcgcacacaagacacatcgtaccgctgctattactgctgcctgccttctacaacgtggtcgtggtcgtggtggtggtggtggtggacgggttttcagatgcaagcaaccgttgccaatcacttgcacaacaaaggagacctccaacagtaactgctgccgatgtttccccacacttttttcgcgaacgcgcaaaaaaattgcacgtcaatgtattagaaaaatagagttttttacatgacgcacttagccagaccagtttacgctaaggaaggaagaaaaacagacaaaaaaaacaagaaaaggaaaaaaaactcgatacgacggcagctctactccaaacagcgggaggaggcagagccactctacactcccaacaattccctaaagaaagcgacggccgctaacgaccacagccggccctccgaaaagatggactctaggaccactgagaccgaagagagcaaagagtcaaagaccctgaagttacgtctaccccacaccccactggcacactgatgtgttcctcttcctccctgcaaaattcatgctggattatcgtactccatctgtccagaaatacaatactacgagaagatggattaagttcatctgtccttgaatataagccgtttttgacaggtatccaaatgcagtactaccgaaacatattacgaatgattattccatatatatcctatttatagcttaattaccagtcaagaagcagcttaattcaagtaatcaaaataaggctccgttagtccgatcggaattttgcttgtaagctaaggctgatgattttacatgttccatcaagactgggagaattgttataagcagggcccaagttaaaccagtgcgctcatggagcggcatagggtgcagctgtgaggcacgccaggtctaccagagtagatcctggcaattcttttggagtgcaggtaagatggcagccctacatcgtgcctgccaacaggattccgacaaactccgaaaagagatgacatgataatagatcgcacatatttttggcgtaaaacaatcaggggtaatgattcaaggaaaacgatgttcccaacaaaaccacaaccagacagtgtgctgattacacaggttcaattctgggattcagacaacagctgagcattatgtgcttaataaaagaaaggatgccgttcaccatacaatagcacccagtgtggcagtatatataatgcagatagcattgataaaacgatcaaaacatagtaataatagtttttgcctcaaaacaataccgggataaacaagtatcaataagtgttgatttatgactcatctaaacctcatcaaagctggaaaaggatatcaggcattgaaaatctgaccaaactgtaacatggaaacaccagttcctctccatgattaactagccactagcaagatttgaagtctgaggcacctaacataggcacgctgccttctgcaggtagtgttggaagacgacccacctcacctaggagcttggggcggggcattagatttggcaagacccacccagacaaccatgccaaccccaagaaccacccacccgaagacatcataccagaagtcgctatccttcttcttcttccttgattgctgcaaaccaccacgttatcagtttggataagggaaagataaggggatcaggcaacagttatacatgctacagaataacgttaaaaatcaaagtcagctagcagttttcatcagaaaatatactcatatacccaaaggatttcagaatcacgagcctgacttgggtatgggttctttgcagggatggaaaatgtaggatcattgtctacatatattttaaaatctaccatgtgaaaattatgccaaatcttctgggatcagatcaatacaatcaaatcaatgtaagtaagataatattacttgggagtatattgaaccaaactactatatcaacttatggctaaaactgaaaacgcttagagtcaaagctttatgctccgagtacacaattgattatgcaggttgtcagaatagagcccagggactaattttcaactttctagcaaatgactacaatgagatgtgtataggccaacaactcaacaaggtagtaagtaccaacacagatatatccaacacaaagagttactgagatccttgcagatagattggctcaattgctcagaacagtaatgacgcgccaaatcaatttgtactgcctccctactactgttaccttattctactagttaataataaccatagtatatccagttcacaattgtatgtggggtgggctgctctattttccacaatacagattatcatctttgttatttgagaaatagtaacaaagccaatatatgctcaggaagaaaatctccaacttacattcatctctaaagagcacataccaatgtaagtgtagccaacccaaaacaggtacattaggaagtaaaaataataatttactaatttgcctactgaaaaatgcttaataagaagatgcatgcaagattcgaaaataggcagcaaacataacaaaaattgatagccatataaattttggaagaaaaaagagtagctgtgcaattcttatttctgacaggtaagagagtaaagtcctgcaatgttaagacagaatacccttgtattcgaggttgaggatgcagcttgtgaagcctgagatgccatttgcctatgaatctccatgtgcagttctggcgcctgagatttgaaacaaatagtgtaagtacagtatgatacaagcacttcttaacataacatctgcatgtattatagggcgtcaatctgtcatgactggagggagtacaaggttaagatgtgaagcagttaggattatgaaatcctttgaaaggtgtagtcagaacttgctgtaatcagagttgttaactagagacctcaaatgttctatttgcagcgtataaaccaatggtagcattattgtaacaaagatcgcacaaatagtgctaaacataaagtgttgtcagcaccttggatgacaaatccaatgacttcctgtaaagatcattcgcaggttcctacaagaaacaggactgtacattagtttccagataaaaaaaggcacttattttacagcaaaagaacatcaggaggctcctgtgacggttttaggccacacaacttcaggactgcaggtcagcctccaccatggaacaaggaaatgtgtttgcggaagcatactagcaaactacacataccacatcaacagccttctggaaacactgggttgccttttcaaagaattcattggccttgacagtgtctgaagtgaagaatccatgagaggtctgtgcatttcccaagcaccaaagcgcatccgccttcatgggatcaattttcagtgcttcctccagcttggattccgcatctataaataaaattaactggatcagtatacttcaatttgaacaaattgagtaacttctactgacatcaaaatacacaaattaatgtgcaacaaaactcataacacatgtgcatgttaagccaccaacaaagtactgttacttcaattgaacagcccagacggcacaagaacaatcaattgctttccattccaatacttgattatgcacccaccatattatcctacttcctagctaaaatgtgatcatactcttaactttaacaaagaatcaacaaaatacatcaagcaaacgaacagctcccagcatttacatataacttgataaaattatgtcagtaggcccaggaaaaactattcagtctgaacaattgggtgaagaatagcattcttctcattaatcatctgatgtgtagtgcactgctggattattgaatgattttgatgaatcccgtcatcatcttctttttttcatcccaaataataccttaaaaaggaaaacatcaaacatgcaaagttgtctaaactcatgaatggatagacaagcaccatcagaaaacagtagcggttcctaaactgcatataatgaaattgaatgcaccacctacgagtgccctaaatgtttgaggtactgaaatgaaaaaccacataaccgtgggtagaacagttatccagtcactaaactaggcagaacaagttgtgattaccttcccatgtcataccagcaggattttatccttttcttattgttaataaaacagcatgacaaattttcctttaagaacattgtaccttttactttaagcaaacaatatattaggtttgagcttttcaattatcatgagaacaaaagtcaatctaattgctaaggattagcttgacttgtagaacacgatttgcaaagatttggcccttccagaccaaccgaatccattaatgctgaataacacacacagaaatctcaatcccattggttacaatagcccctaggaagcatcaactccaacatctctacaagtaaacagtccaaatcaccgaataatccgcacaaccaagtttcgagatctcacggtataccttctaggcacttgaggctctcggggccgttccgcatctgcgagagctcgagcagcgcgcctccccaccgcgtgagattctgcgacgaagaacaacaaagacaaacccaccatcagatcggatcgcgtcgcgtcgcatccaatcagaagcaacccaaaccatcaggaaaagcaagcaagcaatcaagcagagtctcaaaaaggctcgaggcgaggaaggggcttacgtcggcgtcgtgcgggttctgttcgtaggtgaccttggcgttctggcatgccaggtcgaagaagaacatcctctcaggatcgctcatcgctcccatgtccatggcgtcgcgggcgtcgtcgtcggcggcggcggcggcggcggcttccgacgagattcgattcgggggttagggttttagacctctctctctctctctctcgatgttcgatttggggagagagaggaggacggaggaggaggaggaggtgggcgtggagattggtagttgtgggggggggggggatcgcaccgctctaccggagacgctgacacgtgggcccgggtcgatccggccccacctgtcagtgaagtgtaaacccgacgcgtgttacttgcgaaagggtccaggaggaaaatatctcccggcccagcccaccggtggaattgagcccatctggaaagcaatcgtcgtctccggcgagtgcgagagcgagagtcccggcgcgcgaaacacttgtcgcgcgcgaagccattggagaggaaggacatagctgagatcgcggtggcgcctcggaagaagaaggaagcattgcgcgtgtgtggaggaggaggaggtatcagggatgcaggcgaggagggaggtgaggacgaaggaggagcaatggcggggggaggagagggtggtggagagcccgctggggagcgcacggtggagcccggaggcggagatcgggatgagggtggaggacatctgggacagcctggaccagccgcagctgagcgaccgggaccggctcaacagctgcttcgacgccatcccggtggcgtcgttcccgcacacgttcgacggcgcgcaggtggtcgagatcccctccgacgccacgctcgccgaggccgtcgacatcctgtcgcgccaccggatcatcaccgcccccgtccgcaacgtcgacgcccccgacgacgccagctggatcgaccgctacatcggcgtcgtcgagttcgccggcatcgccgtctggctgctccaccagtccgaggccgccgccgccagggccgacgacctcggcgccgacgagctggcggccaagctcggcaccgtcgcgcttgagggcgccgccgccgcgagggcgcccgaccagcagcagtcggcggagggggcggtcgcggaggcgttcggcgcgctgccgtcgtcggacctgttcaacaagacgaaggtgaaggacatctccgggtcgttccggtgggcgccattcctggcgctgcagagctcggacacgttcctgacgatgctgctgctgctgtccaagtaccggatgaagagcctccccgtggtggacatcggcgagggcaccatcagcaacgtcatcacgcaggccgccgtggtgcacatgctcgccgagtgcgcggggctccactggttcgaggactggggcgccaagtcgctcaccgagctcggcctccccatgatacgccccagccgcctcgtcaaggtccgccacgacgagccggcgctcaaggcattccgcctcatgcgcaagcgcggcgtcggcggcatccccgtcgtcgaccacgccggcaagcccaccggcagcatcatgatcaaggacgtcaagcatctcctcgcctcctctgacgccaacagggactacaggtcaaaaaccaaaccccccctcaaaaacatctgcatctcctcgttttcggagtctcgtctttatggtgttgtcgtaggctcggcggcgaccggtcacgcatagcagaagccgttttggtgctagacttcactctcagtgatttttgcttgtgtggttaacgcatggttcttggatgtgctttttgtcgtgttttttttttttacttttatctatcttatacatttggatggtctccttcggtcttcttggggaaaaaaatgttgacagaatcaatcgaattgcaaatttgcaggacgctgacggcgcaagagttcatcgcgaatgcgaggcagagttcaggcgagaagcagatgaacatcgtgacctgcaagaaggaggagagcataaaggagatcatcttcaagctggatgcagagaagaggcagaggatctacgtcgtggacgagcaaggcaacctggatgggctcatcactctcagagacataatcgccaagctggtgtacgagccgcctggctactttggggacttcttcaatggcgttttccctctacctcagaacagcagggtctgaaaaccaaaacattttcattagtccaaattaaatcaggtttcttttttatcacttcattctttcgatccggtccttttgtgtagtatgtgatgtttctttctttgcaatttcctccttttaccctctagaaagatcaccttagtttgtttgtgttacaatgtgactaatgcatagctagcttatcataatgcttccacatgtggaacaccaaggttctattcatgttttaaaaagacgcacctggaaatctggaatgagactctgacaatgccagcaaaattcctgctcatttgtatcatgaaggcaacagaagacaagataccaataataattgatgaaaactgcacccgattacatcagttcatgaattgatggattaggagtcgtagcagaaggtataatgaaattgcaacaccacttcatgatcagagattgacaagtacatgatgataggagcaatgtagtaatttactatggtctccttttttatcagcaacaaactatactgcacataacaaatggctgtattgatataactactggtatgaattgtacataaaaaatgccaagcaccaaccattctttcgatgtcaaacaagtcacgagatgttacaatcaacaaaagatgagaaaaaaaaatgtaagaattacacagctcatggtagtgtccagtgtcctaaatttcatgtcgaaccttgatatagtcagcaccttgatagatcaaaagctaggtatccaattccgattgcttcgcaataccaaaaaattctgtttgcttgcagttcacactgcttcttctacaggcaaaactgatttttctttccatcttcggattatcaaaggtctttgcagatcaagctaccaatatagcgccaccaatgaaattcatgagggagttgtaactaaaatcattgatataaacatccctaaacagaaaagtgatcaggttggtgagcatatttttcaaggaaaaaaaaacatgcctataaaagtttctcctacaaattggcaagcaaaaactaacaaaattggaatattttttttctgctactattaacatgtcaacaatttgcctataaaggacaacatagcatgttaaagccaacccacggtgttagatatcttaaactctggttttcagttaaaatcatattctccaaaaaaactgtatatggaatctatacttctggttcaaaaaaggttgttgtttaagagccattttaaatatgtttatgatgatatacagttatataaatcaaggttgcagattaagaagcataaccaaccatggttcacatgagacattaaaaagcccatcattcagattggtagttcaagagttcctcagatcaatagatcattgcttgattaaattaactaaaaagataacacatatgcctgcagtaattcaatcgttaacaatatgaggacaagatctcatcgaacatttcaagttgtagcagcatacatcccaaaggctaatttgatgtgcagtgcatcactatgttcttgcaaaactaactcccagattaactttaacaacatacaagcaaaaagatcttgactgcaacaccttatagtaatctataaaactctatggaagtgcaatcaggggtttagtactcaccttaaccatcaaacatgactaatcgatcaagcatttggtcttctgccttcaaaaaaatctgagacctgattctccaaatcttcagggttgtactttatataccttgcggaattccttccaccctctagctgacctcggaaccttccaacaaaagaacgatatgctggaaggactttctctgagattgaaatcttcaactcctctcttaattgagggtccacaaccttccatgttgtctgtgtcttgtataactcctcgaatgccaagttaaagttcttgaacctttccttgagtgaagccttgagtgcacttgatgaacccattgtctgtggcaatccatcatctctcagacaagctaataccctcgtccatgaggacctaaggtaccctgtagagtaccgtcttatctgaccacgacgctggcggatccaattatcgccaagcaaggtcttcagctctgaatccttcaccttctgtacaatgtacagcagattgttcatcaaaaatatgttctgaagtgcctcatcctcatacagctttgatttctcctcgatcttggcctgtagatgtgtgatcagtatgagcacacactgccccagtggagtcatattcacgttgtcacctccattttctagctcagtatcccagtccttgagaagttggttcagtgagcggctatagtctgcaagcagtcggacatagttcatgacataccgcgtgagtgggtgaatctccccaccgggcaacgctctccgagatgtctccccctgtattgcatttgcaaactctgcaacggtgccacgcaccgcatccccaagcctcatgagtatccccacagcctcttccttgatgaaatcccttgcatcacctgagaacaagccctcgagctccggcaacacctcatccagcgcctcatacatgccaagaatgcggaacagcttctcggacgatctcttcccgattgcaattgcgtcaccaaagttgagcagctgcaggacacaccccttggctgcctcagtgaagcaatcctcctcggcttcggcatcggcggcaaagatctggttgcagatgcggcgctcctcagcaacaagccccctgacgacgaccttgagcgcctggatccacttcttcatcttgccgtcgaggacgccccattccacgcgctgcacctcctccaggctcatcttgtcgacgccaagcacggcgaggcactccatgagcgtgtcgcggcgcatctcgccgtagacctggcacagctccggcccgtagcctgcgcgcagcatgacgtccgcgatgcccctgagggcgccgacggtgtccggggagatgaggtacggggagatctcttcgtcggagacggaggccctgccgcccgcgccgccggactcgtccccgtcgccggtgtggctggcgaaggaggggcaatcgaggtcagaggcggaggaggcgaaggacggcaccgtgagcgagaggcggcggaggagggaggcgtgcaggtcctccccggcgagcggcgacatcccgcgggccagcaggtggcggaactcgtcctccagccgcgccatcgccgcctgcagcgccgcctccgcgcgcgcgccgcgcgcccccacgaggacggcggccgcgcccaggtaatcccccgcgtccttcgccgaatcgaacaccagcctatccccctcctccggagaatcccaccgctccaccaactccgccgcctcctccacctcgtcctcccgcgcgtcatcggggccggcctcctcctcctccacgacggagggctccctcacggcggcggcggcgggagggggaggcgggaagaggtcggacatgaaggtgaggcggtcgtcgaacccggagagtatccggatcatgtcgtcggcggcgttcttggagttggcgagcgacttgacgatgtgctgcgccgccgcgatcaccttctcctgccctcccggcggcgccgccgccatcctcctctccggttgggatcgagcccgagcgcgacgtcgaggaggttgctgctaccgctgcgaagaagaggaagcgaaggggaaggagaaggggaaggggagaggaggaggcgaaatggacttagtgttagagtcgctaatccgctgagctggagggggtggttttgaatgagtcgctgggtggttttgatgatgccttaatgctcccactaatcctcgctttatcgtacggtccggatttgctcggccggcactccatctccactctctaaggtttatttcccaaacaaaaaaattttcatcttttacatcgaatatttggacacatgagtattaaatatagaaaaaaaaactaattacacagattgtgtgtaaattgcgagacgaatcttttaagtctaattgcaccatgatttgataatatggtgctacagtaaatatttgctaataacggattaattagacttaataaattcgtctcgcaatttacatgtggaatatataatttgttttattatcataatacgtttaatacttcaaatatgtgtccatatattcgatgtgacacataacaacttttcacccctgaactaagcagggccttgagtacaaaggagatggatgatcatgatctcctgtatggattctcttgtcaatgtgttacaaaattttgtcaatatctgtgataacaaatcagttacggatgaaaaaaggtggaatttgagtaaattatgtgagaaaaattgaatagttttaaagaacttagactcatctgtcaagcggtttctcgattcatagaggctcaagaagtctgataactgcgataactgaagcggttaaggttgtatttgttgaccttggtctcctctcctattgtcttgttggtgcttacattttgttctggtcagggtgtgttctttcatgtcaaagaattgaaattaaactaaaacaggtcaggtggacacttggtttgaaattatgttgatgtcattatgttcattgcactaaaaccagccaaagtttggaaggcgagcacatggcctcgtgatcgtattgttcgtttgtcctttggatggactaatcacttacattattccctaaaaacggatcaagactcaagagccaaccaccggtcgcttgaaagaaattgacagaaaaggagtactttgctgtgctgtcttgttctgcatggattccagtagtgaactggtgattgtatgcatcagctctaatccggccatccaggcaatgtcacgctcatgtcaggtttgtgcctttgtgttgatcttgcattattatagttgtaaatgcttggatttgcatgagctggtgtactgcttgctgctcatcagcatagctggagaagtggaaagttggactctgccagtgccagggttagacattctttttttttttttgagatattttgttcatctctgtgatgtggcaaatggtatctgatgttcttcttgatggtcaaccaagaaatgcacatagacagagcagcaaaagtcagtggtttgttgggattatcttttaggtcacgacctcccatgcatttccatatcatagttctttctttgctcaaaaccgcaagaaactgggacaaaaaagaccagtattataataaaagattttggtataatcagcagaacgattatcgatatcttggtctctactggtactaaaaatgatctaagatcttcccctttaagttttgcgcatgcttagtacatagatcaattttgcagtagattaatggaattacagtgcaagctaaaaatatatattaggtatgttccagcaagtcgatccatgtgataagcagataaacaactaaacaaggatggtctgactcggaggaacgttcctttcaccccattttttcaacaacctttacccaccttctaaagtaaactaaaccagaacatcagattagatttgatacttaagtttgtttaaacacaagtgtacctgtgtatgaccccgacaacctgacaaaagtttcatcagaactttccgcaggagttctcatcagaagtcgaaaaccagcaaaatgattaagctatgagacgaaatatttacacataacgaaacttcctagaactaaaaggtacacaaaagtatcaatcacagagaggagtggtatctaatgggaatacattgcaacatccgatagaccgatatgtaacataggtgctttgtgtctttgtattgtcagatgaaaatctgctctacaacattaatacaacttatttgcttccactatatcgtaaaaatcagaggaaaaaaatagttaggatgtcatagaaggaacaaaaaaggggacaaaaatgttagtgcgtcagtaaacctgcgtggaatgagactcggacccattttgattttgatggtgcacaaggaatgaccagcatgacttcatcatatacatcccaaaaaatgtcacttcagccgtcgccccatcgatatgataatatatacacaattcaccaaggttcatccccaccagtctggaatttttaatctcctattcctgtgaatcgcaagattaactgcagggactttgtgcttcacctgcctccatatcatgttcacagcatcacccttcctgggtggattctggaattcatagtgatgagagacattttttagctttgaccagatctcaacccacttcgttttctggatctgtctgagctggttgagcaaataatcaggtcttagagcttcttccactgagaagaaaagggagaactcactgtaatcaatctcatcttcgaaagggagctcaatccgactgctgacaatcacaggaacacaatgactgacaattgcatcaaacagtcggcacgaggaaggagtatccccagcaggatggagacaaaactttgatgatcgcatgccttccgtagactgttaggagtaaaccatttttaaatgtcatgccctcttatgaaaacctcaacaggaaagactttagatcaccttagcacgttcaaaccatagcagaaggcactatacgtttagatgacattagaaaagtaaggtgcaaatgacaaaggccttactgttttaatgccttcacctgttgcaaggctatcctcaaagcgcacaccatccttcccttttagaatcttggcaagtttagcacggatcttcccttcctgaaaaaaaaaaggagccccaaaaaaggtcatgttcttgaaacacaaaagttaggtatttatttatgtcgagagcagttccaacaaaaatagcactgagctaaataggcagattatgatagatcacagagaagggaataattaagttgcatacatctttcctgactgtacgccctcgaaagaaaagcagtgtaggacgatcatcaaatggatcaggtggatcatcgttaaggaaggaatctacaacatgcacatatggagctacaacatctttcctcaaggaagccaattcttttgtgtatcttccaaagtctgcaactataagaatagatgcattcaccatatcacgcaaaaacctaaaagcatttgggtgatgcatgggaatcacatgatcacggcctgcagatcgttgccaatatttagatttccataaaatctccataagctcaacctacaagaaaataaactaaaacaaatcagtgtaattataatgccatgaagttagtttatattatgtagaactagggcacattgacactattatatggcagcatactgcacaccagcaacatgaaaaagtctaaggaggtgatcaaagcataccaattcgtcataaatgatcatcatatataaaacaaccaaattcctgatactcaccataactcagggtagctaattgtcaaacatcatagaaataaatcgatatattgtcatgacagaaaaggaaatgccgcaccacacaacagattactgagcaaagaagagtagacggcatttttctatggtttatcagaatttggagaaaccattattgctaatagcgaggttgatggtgatgtaacaccaactaaatgagagcatttttccaaagctatacagtttatcgcatccacatgtcatctttggtgtgctcgtcttctttgtttaatgattacttgatttttttcccccagtacaattcgcctgttctattgaatgatgtagcatagttttatgagaagcagataaatttggctgctttcagcagtctctcaatccacagtgcataccaaaatgactccaaaaaattaagacatgacagaacaacacaaaatttcgtaggcatgactctgcatttccacaagaacataggccatgccattgcaaacaggattaccagctgaattgaaaggaaaaagtgtgagatttactgcacctggaggaggcggtcggcctcggtctctggatcggtcatgttgcggccgtggacgttgaagctgagcgacgagaagaagggcacgaagaaggcctccgccgcgtcgggatccgtcacccgcaccgcctccctcccctcctccgacgacgacccgttccccccacctcccccgccctgcagcgacgccatcatccagtactccacgctgtgctgccgcctgatcccgcccgccgacggcggccacgcggggaaccccgaggcggaggcgtccatcatgccgacgtggaaccgccgtggcaggtcgtacatgaagaccctgagcggcggggcggcggcggcggcgggcgcgcaccgggcgccgaacggcttgaggttgaggaggaggctcggggaggaggcggcgggggcggaggtgaggtagaggaaggtggttgggacggcgaagacgaggagcaggaggagcgcgccgccgacggccaccgcgcggctgctcggcgacgccatgacgatgccccccaccgccggcgccgccgtaggcggatttggtgaccaaggcggcggcggcggcggcggtggccgcagctattattagtggagatgggaatttggtagcgtcgcaacagcagcttgtgctccggtggttgcgacgccgtccgccatgtgtggtgcgatggtgacgggtctccgcctccctctctctccttgttttttctctttaaaaataaaatcgatcgtcccaaaatataagaacttagtacagaatgtctagatttgaatctagagtatgtttagttcacgctaaaattggaagtttggttgaaattgaaacgatgtgacggaaaagttggaagtttatgtgtgtaggaaaattttgatgtgatggaaaagttggaagtttgaaaaaaaaagttaggaactaaaccaggccctagacaaatgcaaatgccccatccggtcccaagatataagaattgttgtgtttagtttctaaaattagggagatgtttgggggaaagttggtagtttggaaaaaaaaagtagggagtttatgtgagtaggaaagttttgtatgtgatgtgatgtgatggaaagttaggagtttggagaaagtttgctgtaaactaaacaggaccttataatctgagatattttttagtattacgaatttgaacatactataccaaaaatataagaacctaggatcgagtgagacattttctaatactacgaatatgtacagactatgcagattcaaatctggacaaatgtctcatctgttcttaggtcatctgttcttactcgagtccatctagcataatgaatctagacaactatattgttcaggtagactccacctagtttagtttttatcgggacagatggtagggattgagtttgtcgtattagcagtatccgttttcatgacagaagatcgtgctgttactgctgcagtacgatcacgataatcttccggtactttgcttgcattagagagtgagatcatatgcttgcagaagtagcaagcaaagttcactcgaaggctcaggcaaatattgatccacgagaaccatgacagatttgggtagtcatctcttcttcatggcagaaacggtaagaactgtattagtgccgagctattactccattagccgtagatggaccttacaggttacagctccctgaatccccgtgatcaagtttcttttcttaacataaaaattgtttaacacaaggccaacgctacagactgcagcaagaagccaacaacgcgtagacatgggcagattacgttagaatttcattacctctcgattctagtgcatactttgctcctccaaagggatctcaaagccccaaaaaaaatgtttatcgagacactagttacagaatctaggataaatgttatcattagctacgtaactactgtctcaagaaggcacaaaccatatatgcagcacggagtaatcaccggttattgttcaaaacccccacgatcaaagtttttccgagggtttttctttggggtcaaaatcgagctaaatcatgttcaggtcttccattccaaatttccaattgggatttgttgtgttgtttctctgttggaatattcgcttacctatgtagggtcgggtaggactcgcccatgataagaacaacaagcgaagtccatccagtaaaggacctcgcacccttaccctttcctttgttcttctggtcatagttttcccagaagaacccagtttcatggtaattcttcacgatgttcctgtaagaagcacaaaagtagcaacagcaatctattaaagaggctgcaatttaactattttattcagcttagggaagagagagggatatacctgatcaggtttgatcttagctcatcatacagttcctttgccctgtccttgtatggaccatcctcttcagagcagaacaatgttattagatcatcgtgcaaacagtaaaatttacagaagggtaaaagctgaatagttgtttagcagcatctgttatagagtttaccatgtgcatagtggtgtagtcctgaaagaatcatgtagttcatgtttatccaaatggcacctctccaatatgggggatcatgctcagtgttgcgcttcatatatattgaactggaccatggacaacagataattcagatcagagtaaccaaaagaccaaacaataatgctatgtatacattgttatgttgattttaattcattaacaagctcaaacgataaacatttaggtgttgggggcaatgcagacttatacccacttcatcccccgggacaagtcttaccaattgagtattggatcctctaaagaaattacacttttcaaataaataaatgaaatgaaatatctcatttattccagaagtatcagcttcataactaatcgtcttgatgcaagtttaggttgctggagatcaagtaggaaattttgcccatgattcaggttaaatgagttattatctttatatataccttgttcgagaaagtgaccgaagtccgtaatttgtccacaggatagagctatttgatataagatcaagctgcttctcaagaacccatgattcctgaacagagttgaatggtagttaatactttaggggatgagcatcactggattggtaaaagtgagaacaagtatatgtaggtaaagagcatacaggtggaatggcccccatcatgaaagggaacatgctgacataaccgacatgaggtactaattgcagctgagggggttgtaatgtttcacgcaaaagctctcgtctcataacatcattctctctaacttcataccatctcaatcgaacctgtaagaataatattgtcatcagagtttgaaagttatgaatcatgtccgaaaggcaagatggcaagatagaggaactgcaagagagaccttttctgtgtggttaccatagtcgaaataggcaccggttttatcatccaagtgcatctgtaaaaatgccaatactttcaaattactataggataaatgtgaccatcaaaacccttcctgtgacacaaaatgattggcggcaattgataaaaaccattttagttgctatatgatctttgaacgtttgatcaaaagtaagacttcctgacacagcaggcgtttatgcaaagtttattatctttatggcatatataagtatgtaaccataatattgcaatgatcacgaacagaaaaccaagcacaaaacaaaaactattagcttcgtctagtatgtaaaatgttaatataagaaaccattattgttataggcgcaagtgttagtgttggagtatcaagccattaattatatccaaaatgtagcagccattggtggattgatatgcagattaagtatctatctgacctaaaaaggacaaaagctcagaacaagaagaaacagtcagaactctcagagcaataccttgttaagtatcccaaaatctgaaagttgatttgacatcttgtagtaatcctgtagaagttcaagacagatttttttcaagagaaccaaaggctgagacaaagcataaggcacagtccattcactctgcagtaccttctcaagagagctgtctgttttaagaaactctgcaattgagcacatacaattcgtagctaaaagcatccaacaccggaggtcaacatggcgctcttcatcattaggatgagatgcccgtggatagtcatccaaaccagatgtcaaagtctgtagagtagtcagcaacatcaggagtgaacggttagtagaaatgacatagaaagacaaggcaagaaactgtagcgtaggcatgacaaaagctcaaaaacataaactgtaatgtaggcatgacaaaagctcaaaaacaaatttcttttgctattatttgggaccaattagtctgtggaagaaagcaactatgaagtgttccaaaaccttcggattcaactccctggtggccatgctgtctcttccatgccaataaaaggtgccttcgtatttccctaaaaaaaacaagtttgaaagtcaaagaagctatataggatagataagtcgaaggtgaaaaaagttggcatgacaaacaaaaatattggttattccacacatggaaagtacagccaatgttcattgacataacaatcaacaatgtccgccaaaaaggaaaaaaacaatcaacaaggtgatggaaaaggtaaagataacagtaattgcataatttctagctatgtggaatggtggctatagtttgcaatgacactaagctaaattttgcttagcacaggagcagaaggttattcccttcgctaagtaagtttgaacatctcaattgcatggttcctcttgggtggcagtgaattaaagttactttctaaagagtcaggaatttgggttcataactctctcgtccaggaacagtaaatgagtgaaacaacgactactgaataagttgacgatcaaaattattatttcatatagcatgcactgccttgagtgtatgtaaaatatagagtgccagggatatctgaagactaacatcatccaaaactgatgcaaaaactagtagcttctgcaagacaaaacggccagaaaattttgctggtcacaatcctattcacaaatcacaaatatgatagtacacttaaaaaatgataaaactataatttatgatagtactcttttatccaatcaaaccattcataaaatgtgaacatgtcatatttgtatatccaatcaaaatatttataaagctataaatagatacactgactgcatgcatccccaaaatatcacccttttttttactgaaaagtaagatattaatggctcatcatgttcatgtgttcaggcatgtattttctgaacattaattaacataataataggcctaaattaaagtgaagatccaatccatacaaattccatacttgccagaaagagggcaggttattctgtctgcagttattcacaagcaatcaagcatcattggttaccaagttcctaataaatagtatggaccataaaatgtcataacttaactcacctgtttgtgtgctattgaaccactgaaaccaagagttcagccttacataagcccttttaaggaaagtggatatcttttcagattcctcatctgaaaactggtttgcatgtattccacttgccaaatctgtaccaaaaagtggcaagttaaactcaataggatgttcgatcacagtttatgcacttccatacagtagcaaccttgttgtgctaaaccaaaatcgcagacagcgtgaaaattctcaatattataaatttgagacaaacgcactgaaaacagtgcaaaataatgtttttgtggtaacttgattttctgagatatactcaagtcagataatttagatactttgattctcaacagtactgctatactgcatttaatgtgtcatgacagtgaagagcaaggaagaaagcattgtctcaccacgcagtgcaagaaataaggttgggggatttccattggaagggtactgcagaacaaattcctcaggaactttactgcagaaatgtaaaaacagattatataagaactgacactctaaactcatagctagatatgacaatggttcattgctcgccaggggaaccaccttaaagcttcagctcctaatatttgctcccgaggaatccatccatccgcatttattagatctaaccagtgaccaattatatccatcgatatatgcacatcccagcgcctatacatcaccatcaaggatgtgttaaacaagcagcaataataccagcacagattcaaaaaaaaagcgagtgatgatatagtggcagaagccctgcgctacacatcaagatcgatgaaatgcttaccaaatgactaactgatggaagccctcatcccatagaaatccccttgggaagaatgagcgactaggcacagctgtatatagtgcagctggccaatatgggatatatttatccccatttttttgctgcaaggaaactcttgaagcattagattttgtttgagtgtgatgtgtaatcgcctaggatttatatcagatctacaaaagatagcacagtaataagaagggggggggggactaaatcagatagcataaagttcagctgcaatagctattaggaaaaggatctaattatcaggtaacactctaaaacttactgtaaaaccttttggaagtgcaatttttgactgcccatagaaatagccaattccaccaagaagatttgataaagcagcaacaccaacagataattctttgggattaatctgcatcagtgaaacaataatatcaactgctccatcacaaactttcttctgattatgcagccagtcacactacttatcttccaggggaaaaatagcttttaaaggttctttcaactatgaaaagtgtacagacttgaacaaaatggcaaggacactatcatttatacgcaatagcaattttatataatcataggaacaggagcataatgagaagaaaacaactgtatagactgctaaaagaagattgtcaaaactacaaagctcatccaagagatcacaccttattatttgcattgaaaatttggtcatatctcttttcaaaatccttctgttttgattcaagacgagtgctcagaacaggacctggcaacattagtgatataaaatcaacaagcaagatgaaatattgctttcaacatctctgaatttcaggttcaacagaaggaaaagatgcaggcaaggaaaaaaaaggaatggataccaaatgcaaggcagcaaaagaaaaggtcaagagcctatgcataccaaattatggaggacatggtatctatggcatgattgccatcccaaaatgaatagaacaaaaggaaaatcacatatcctatctccatgcagtatgagctatgcagtagagtcacctgttagcctgttaatgcgctcttcaatcattgggttttctgaggcggcccctgacaagaagactatgtcgacttcggcagaacgtttcatggaaacctgtgaagatgagagagagcatagatcacaatgccggaagagaacactatttaaatctgggtgtacgttgactcattggattctcatattgacagaataactttctttttcatctttgacgcacctgatatactattacatttgaagaatcttctgccatgtctggaaggttaaggttcccactttgcattgcctagaaaggtacacaggagcagctaaatggcaacttgagttcataaaaaaaaactgagacttgtttttgaccccccccccaaaaaaaaaggtaaatgtaaggagctaagacatacattagtcgcaagggcttgctgtactaggtcacttagattgtgcatactaattgatttgaatccagctctgtgaatttccaaattttcctgcgagaaaaacacagttctgtacatgtcaatattaacatcagtttatatggaattgtaatgctatataccagtagcgagtaaaatagaaaaataaaaaaatagtagcaacaatgtgacgagcatactgaaatatgctacctcagatctcaaatagactttccaatcaccaatctcctcacgggatccagatgccaaaagaacatgacctcttgacgaaggtatatgcgaatccatagtgattgagttccctgcttcatccgcgatgtagaaaaacaggtgtgtggtgctttcttggtcttcacttaaacttggcctaaattaagtataactacatggaataaatttcttttggttcctttggtaactttatataggtagcaaataaatgattgttaatatcatcctggtttgtgaatagggaatgaaaaagtcaatccagtaaaatttattggtcttttcaccttgtacttaaaactggaaaattgtttacatctcttcagtaaaaaaaacttttcagttttgtaactgacaaatatacacttacccatcagtcttcgcattcaatcgaactgcccaatctccaccataaccgctaccctctcctttctctttcaggaaactcgtggtcaacaacaagccatgatcaaccaacacttgatgtccataatccctcccattgtgatctgtccacccatatgtgctaagctcatcagaatcttggcaaacatgacgaagaaagtattgcccattctttgcaccaatccacattatcccagcaattagagacaacggggttctgaaatagaaatactattagcaagaagttgagagtgccaccatatcatcatcatacagcaatagaattccaactatgaggtggtaaggtggcaacattctaaaccagaaacaaaaacaatacgcattcaaggaatcaagcaggaaatataacaacatctttgttctcgacacatatggactaagcaaatgggaacaaaactccatagaagtgtttaaagcataaaaaacatatgatgctagcaatatgaacttccctgcatatttctagcatgccatggtggactaagagaactgaattgcttaaattagcacgctataagaatcaaggggaagatcaaagttaagcaccttgcacgaattccaagatatacattcggcctgtaggtaccccaatacaagctttccttgtgatctccttggaactgtaaacagtcaactatgagccatcagaaagctaaccataattaccatccaaactcaacagtatggaataacatgatgttacgtataaatcaatcagaactagcttacaggaggatatttaacagaaactggtacattttaggtcgtctgtcctagctcagatgacatttgcggctatgcacaattcatattcattttacctatgacaaaccagtcgtatccactatgtggttcaaacataaagcagcccttgtaaaatccaaacaagcagtggtcgattccgttattctcctagcatttttacacaattcaattaagttcttaactactactgttgcagcagattaagcagaagcgcactaatagactacaaccgcgcgagattgtaatctaaagctatttcacagagcattggaggcttgaagaaacaatgcgacgaacttaatggtcatcacctgaggcagatccatcatcctgggcgcgtcaagcggcgtgacggagcgcacggccctgcgcagaggcgtctcgacctccccatccgccttaccctgccacacgccggtatacaccacgaaggcgacggcgaggagggcgacggaagcagtccctacaaggaggaggttccgtgggctcacctccatgagccgcagggggccatggtcgccgcggccacggcgccgcgctgctgctgcggcggcggcggcggcggcggcggccgcccggcgcgcgtccggctctggacctgagcggctcctggcggcggctacgggtcgccggacactgctgctgccgccgccgccgctcatcggagaaaaatcccggcgatctccgcgtctctggttggtttggtccgaggactcgccgccacttggggagactgagacgaggggtttgggttgtttctacactagtcccgtctttccgttcgataggcgtaactatcaaaatacgccttccggtgatggatacgagtagttccagcttgaaatgtaatttgggattacgccttccacgcatcgggtgagggaaaattgaccatgttcagccgttcgggcctcgttttaatgggcctcagtatctcggcccatccacatgtggcctcaatccttcttggggcaccacgtggataggccttaatggtcttatctaagcgaggccttcactgctgagtactactagtttcttttttttttttgcggggtgctgactgctgagtactagtttctgttcactatattcgatgattttttttagaaaaaatgaatcgctgttaaaatgaagattctcaatgcttgttatcaatgtgcatccatcatgtttcatcctacttcttccgtttcacaatgtaagtaattctagcattttccacatttatattgatgttaataaatctagatagatatatatatctacatccattaacatctactaggaagaaagcccgcgcagttgcgcgggcaatttatttattgtttaaaaaaaacctaaaaaagcattatctcaccatattcactataagaaataaaccataaattttgacatactaaattataataatgtccatcatatccaaacaaaaatctttttgccctcatctatcaccactacttattatcgttgtcttgaaatatagatattttttaatagttagaactgcatctctatccacaaataaacccaatacataattaataccatataaaattcatatgtacttcatacgcaagtactcataccttacaggtatccgaatctatatgtaaatatttaaaaataccacatctaataattaattaatatgataaaatcattaacttatatatgaatatccctttaataaccagtgaagccgactatagccgctaagccttttttctccaatgccttgattcatgtgtcccttattgatatagttgtgctcctcaagacaagcttggagcactattttataaaggattgcatcggtaagtaggctagttgagctctattatcaatggtgacctcttactcggaccacttctgctcaataatgcgtactcttgccgtagttactataatgtagccagttgaggtccatgcttggcgccctttagggtatgagtaagagaaaatacaggtgatgaaaatattttttaaatgttttgaatcaatttattttatagagtatacataatttatttatggtgttaatcgatactactaaattttaaattttagtggtacatatataattttctcttttaaagattagcagagttgatcattggactctactttgaaaaatccaatagtttcagtggtgatgaccactaaaaaaatatttggtcaaattgtgatcttttgctaacatacaagttaatataggttttgattttttttcttctattatacatctaatttacctatgcatattcatgggactaacattcaatgaaatttgttaaaattatttgtgctaattgttaacactatttgtagagaaagacataaaaagagatataatgtagttacatctatgtttttttttctagagaacagtagtctctcgtgtggatgtttatttttccttttttttttctttttggatgattatttgtcaatcataggaatatgatgtacatttttctattcatagtgtgcatctgcatggatttatatgagctcatgtgatcgccttttacattgttagtaaataatactttaaaaagtttgacaggaagagggtggagcaacgggtggcatgaggtggtgtcatggtgtggcttattttaccaccttgctagaagtggtcacaacatctatgctcaatttagaaaataaaccttatagtcagaacgaatgagaaaactaccatatgggacagccatatacgcactcttctttttttattatttttatatatatctagcgtatgtatgtacatagaagttgtgtatgtacgtaaggagagattagacggtttttagatagagagattattgtcatagatctaatttaatggttgaaaataatggaatcgctaattttgaggtgtaaatagatgaatagttgtttttcttttattttatagttttcctagatactctctaattagagcgtcacataacatcttagaagcgtttgaaggagtatagaaattctattacccatagtcacaatctacttgtagtcaactattgtttatggtggattatgcaacctctacttgcctatcatttgttgatcgttgcacacttagtattgtcctttatcttcggtgcttgacgacatacatgctcattagatatcagttaactgttaggtgcattgtatacgaatatcttgtaagtgatatgacttagtgattagtaaagagtgacctatatataaaacttacatatatggggataagtgatgacatgcgattgatattttaggctaggatattgaccaattatattgcgtactacatattaagtttttaatacctaagtaataaatttaaggcagtgttgtaaagtgcttataggattaactactccctatttatagcgagtacgtttgtcaaactactatacggtgtattacacagtacgtgttttacaaactttttatataaaagttttttaataaatcaaatagattcatttgtattttttaatatttaatacccaattaatcctatgctaatgacatgtatcatcttgcacgtcctggataagcacacctaatgagctaaatcgatttaaaccacctaatgagctaaatcgatttaaacctaagtaggagataaaagacatcgacacgatttgaaaagaatatatttgatccttaatttctaatgatatataaaaaaagataactcacaatacgtgaaaatatattaatgataaatttagtaatattattttgatatatcaattatttttatagtagggagtgagtaattttgggaaagagtaattttgggaaatgttactcacaactgaagttgttttatttttaaaaatgtaagtctaatttcactatacaacatacaattatataatgcatattattcatttatttagatttttatggatgttttgatgacgtgcgtattgtagaatttaactcaaaatagcatatatttttacaactattagttgaaattattaatttggtttttatctcatgagagagaaaaaaaagaaaataaaaaaataagggaagggggtgggcacgtatgaggtatgtacgtacgtgcacgtacaggttcgggagggattgttatggacgtgcagctttttaaagataaatctatttggtattttagatctaaccgttaaaaatatggacccaccgaattaaatgaaaatcaatggctagatgttttttcaaaactttataatttattaaagtgccacttggtggcttaggagcgtttgtagagacgtcatgtggcggtttaggagtgtttgtaggaagtttaatggacttttaagtatataatagatatgaatgtgggaaatgttagaatgacttacactgtgaaacggaggaagtacatgttctgcaatgcaatatttcgtttgctaacttggttaaaagttcaggtaatcgagcacccatgacaaaagcaaacacaaaatgagattatcctaatccacacaacgccaaagctaattaaaacataggaaataaatcatcagactaataatgtgtatgcgtagtataatgattttttttcaaaacacgaaataaaagtaaacgctcatatacaaacgcgtatactcattctataaatcatttattttataggacagaaggagtatcactgtatcacacactctgtatgaatggctccagtctccagagagtgtcatattgattattggcgaaatcacccccatgtgcaaactatagtacatcaatttaatgtgttcagaactaatactactccctgagatatgaacaaacagagatgaaattgaacgaacaacatggggagaggcttcttccttccatccatcgatcctccaccgtccgtcccacatgccatcccaattctccagggcaatcaaacctcgagcacgattcaagtataaccccgagcaatattaaaatctacgacctctatttcagattataagacttcaaattaaccgagtttataaaaaaaatagtaatattttcgatccaagataaatttattataaaaatatatttaattattaatttaatgaaactaatttgataatgaaatatttctatatttatctatatatttagttaagcctgtagcagtttgactttaacgaaggtttaacccatcttataacctgaaacggagcgattatttagcttagctttgtcagcacgaatcagtgtatgcacttgccgccctcgaacgtccagccgatcttgcccatctgccgctcccaccgcggccgcgccacgtacctcctccagtcccggatcacgttcctcaggtcgtgcagcttgttctccagcccgatgcagcacgtcatgtgcacggtcgcgatgcggttcaggtcccgccccagctggcagaacccgctcaccgccgccgtgtcgatgaacctgatcctcacgccgacgccgccgccctcgcctgcgccggcggcgagctcccgcttgatctcgttgaagacgaactggtcgtgctccccggggaaccggcgccgcgccgcgtgccagtacgccatggcgcgcgcgttgcgcggcgtggccttgaagtagatgaacccggtgttcgggtagttccccaggtcgtccgggtcgccgaagtagaagtcgctcgacgtcgtgatgtccgccgccgccgtgatgtgcaccatcgggttcctgaaccacgccaggtcaacgtcctgccaatgccaacgcgcgtcgtgttcctcgtcgtcaacgcctcgtgtttctcccacaatcatggacgcctactagaattgacgaaaagatttatgtatgggtggagcttgccgtgaagaggaggttgtagccgagctcgaggacgcgctgctgcagcttgagcttgctccagacgaggtcgaggtagtccttggtcatgtagctcttggcgccggagaggtcgaggccggcgacctccgggagcagcaggtagcagtgcgggtggatggcgcggcaccgccggagcgcgccctcgtccatggccaccaccacgatgtgctcgacgaaatgcgagatgttctcccccaccctgaagctctccaggaacgagtccatcagcgaccccggcgccgcccacgcctcgttcaccgacgtcatgatcaccgtcctgtcctccatcgccgcccgccgcaccatcctcgcgaactcgtcgtcgtcgtccccaccgccggtctgcgtgcgaaatcatcacaattcacaaattagttcatcagttcttggactcggctggttaacaatggcgcatatcaagaacagcttacctgattagttcttgctgctctgcgcgtctctgaatctatccctttcgcccgtggagcgcaagccacggcggcagccttcttctcctgccttgtcgccggagttgcctccggcgtcggccacgcgggactcgcggtcgaggtgaagacgaagacgatcagcgcggtggccgacgccgcgccgaggaggaagacgaccaccggagataggccattcttggagctcgccatgcctgcacttcctcgcatgagcaaaaactctgtaatccgggaggtcgcaatctgtatttgtacactgctctgttgcaagagcttgacttttcatggaaactgacagctgccagttcgtggacgccctccaactcccatgtctcctgcaccatcaccgccgtctcctagccgtcgatcaagcgatggaccgttcagatttcgtgagaaaaaacagacgaggattgagatcatgagctgatgtgcgtgatcaaattattctcatcattgaggcctagagatcctcttttaatttgtagctgcagaagcttcagaggatatgccacccgaaaatattcagacatcgacatgcacgcatggttgttgggcatttttgtatgccaagaactcataaagaacagagatcaaagagatgtttatgtcttgatagccgttgcaccatcctactactattgattgttgcaagaggaatgcacataagtatttgtgtggacacaagtgaaaaatgcatagagatcttccggctagctctataagatgatgggctagacgccttgggttcaaagcctcatttttgtaattatttgatataagtttattccctaatattcacgtctttttatttgtgtggacacaagtaacacaaccgacacagcaagggacagatcctctatccccattgaccattgataggcagtgtgaattttgggtgacctcacaactgaacttttctctgtatatgaacagacgacactgctcaaaccacatagagtaacaggctgcagttctgcacatggtgggataaggcaaaagggcaagttggtcactaagaaaaccgaattgacctgtgtaattgaagagcaggcgaatcatggaagaacaaatcatttcagtgcacatattagaaggccaactgaactgtcagatggtccctctgaaagtcactggaattgaagcgtaagaaaatacagctgggttgagaaattgatcgagccatttcttattatttttccagcctcacatcacactcgagattctggagataacgcaaaataatttagtcgagcattttctattcattttgtttcttcacgtcacattcatcagttcagaggaagtaaaatgaggttgagttgggccttttgtattattgtacgtttcttcacgtcacaatcatcgatccggagaagaaagcaacacaagagacagagttgacagaagcttgattaccagcctatttgatttcctggcatccatttaattggcaacaggtccctggaactggaagaatcggaagatgacccattattcaaaactgtaccttttttgcctccataaaatgattaaagtagccagcaccactatcagaattcagaatctgtttcttttggaaaaaagatagtagtacatgccttcacagacttcaatccaaacataaaatacacatgcatcttctctctccaaaaaaaaacttaacctacgcctcttctaatacaatgaattcggataaacctcattcgtagtattaggagggattacattcctcgtaggttgaggttttttttgaaatggagggagtatagttcaatactagcacaagtacatcagaggcatcatagtttcccttcatctgaacaacctctcatttattcagatttattccagaatagctcagttcttacattgtcctagtgttaattcaattgataattaaggttcattgtcgattgacatatagttcatacaacaacagaatgctgcaatttcagtgacatcaaattagcttcaaccattaattctcttgacaatttagggatgaacaggtttacgccatccaatcgaattccggcaccgggtggggtacgtccacttgaaaccccccttcttcctctcctccggcgacatgcccgtgtagttcttccagtcggcggcgatgtcggtgaggtcgtgcaccttggtgtcgaggccgacgcagcagtcggcgtgcatggtgacggcgcgggcgaggtcgtcgtggtactcgcagaagccgccgaagtagagcgtgtcgagcggctcgatcctggcccgcagcttggcgacgagctcgtgcttgatgtggccgaacaccgcctggtcgtgcgcgccggggaaccgcggccgcgccgcctgccagtagcggagcatctccacgctctggctcgtcgccttcacgtagtagagccccgtgttgagcgggttgtccagcggcgcccgcgccgcggagtagtcgtccgacgacgtgctcatgtcggcgtacaccgcgatgtgccggaacgggtcacggaacaacaccatgtcacagtcctaattaacatggtacagaatcaattcagcaaatcgatcgccattgatgatctccagagctcaatgatttgctagatttggaagtggatttttgtccatcgaagaaacatcctctcattttgtacattgcgttcaaaaagttattaaaaaaactgaaaaaaattatcaagatatatcaatatatgatatatctttttgcaaacatacaagttaaaattcgacttatacaattcaaaacaaaaaacaagaagtttgaccgtgttaaaattgcgtgttcttttcatagtcaaatttgttaattttatttttattggtataagttgaatttgaatatgtatgtttgtgaagtggcatatcatatattgatctatcatactattttttttaattttttgatgactttataagtgacatgcaaaaacgagggataccccttagaggatgaatagttttttccattagatttgtacattaccgtgaagaggaagttgtagccgagctcgaggacgcgctgctggagggagagcttggtccagacgagctcgaggtactccctggacatgaagcgggtggcggaggtgaggttgatggacttgacgtggaggaggtagcagtgggggtggacggccttgcagcggcggaagccggcggggtcgacggcgacgacgaggacatggtcgaggaggtgggcgatcccctcgccgttcttgaagctgtcgcggtagaggtcgaggagggaccccggcgccgcccacgcctcgttcaccgacgtgatgatcaccgtcctgtcctccatcgccaccttcggcagcaactccggcaagcccgggaatttctcctgcacagggtgccatggcccatgggctcgttcaatctacatgggctgaacaaaatctgcctctggatgatgggctcaacagctagacaaaaaaagcccactagaaccagcagtttgaggtcgggataaattggcccgttactgcacggtgcaatctgccgacatatcctacgtactacgtacgtgctcaacaacgtcacgttataacaacgtacatatccgaaagactttcatctgaaaaaaattcatatgagaactaacaatttcatacgatatgaaacttgttgtagcaaaagaacaacgtataaactctctccagaattagccaagccataaatcaccaaattaaggggttttgcccgggcacaagggcgaagatagattcgggtgaaaatacacaaaaggaaaaggtgatcgcgcatgcatgtaactaatgaagctggactaatccatcaatttaatttgttagtttcttacctgttgagcaggaggaggagcagcgtcgccaccggcgcctctgagatcatgatccgccgccgccgccgacgatgatccaccactcccccagctcgacacgatcgccagcttctcgctcaccctgtcggacgcgaggaagaagagcagcaacgtcggcagcgcggcgccggcgaggaacgacacgacgtggttccggttgatcatcgccatgccgccgccgcctcccaaccccaaccccatctcgctctccctgctgctctctagagtacttgtgaaaggctaagagaggaattatgaagagcttagcagcagagctgtacttagctagctaagctaactactgtttcattgccacgtactcctactacttaaactacgtacggttctcgattcaacgatggatatatgagaatctattttgtcaaaaggatcgacagtgggattggccaatagctaggacgatcaagagagcccatcggaggaaaaaacaaaacgatatgtttacaaataaaaaataatttgtaaatacaaattttatatacatattcttaactatcaaaaaaatattaaaaaataaactacgataaaaaaaagtcaaaaatcaactttaaatttaaaattcaaagtataaacgaaaagataaggcggtaacactaactaattaactcgatggctttgacgtcaaaatcatcatggctacgatgtctggatttgcgtgtattttctcactttcttcctcctcgtgcccgcccgcggtaattaaacgactcagcgcgctctgccttttgagtgttgattaggtcatgtggaatttgttttcacctctgtcaagagtcaatggtgtaggtgatcaatgtgaagacttctcttaatccgtttaagtcgtacacgacgaagagtatacaccaatgcagcctccggtttggacttgtatttgcgcagatcacctgcgctatatagagattcaactggatgcacgagggcgacgagtacaatcacgcatagatgaacaaaaatgacaaagggaatgtttggagatctttagattctaattaagctgccggtgaaaacccagcttgtgagaatcaagagaaagcataaagattaatttctactccgtagttcattttttgattgttcaatgacaatttctcaaaattttaaaaactgaactatttggatgaatattttttattttatgagaagcagtataatgcattcgtcctaaattagtgtcgctttgattttttttaacgtttgaccattcgttttattgataaattagtacaaatgtaaaaaagataagtcatacttaaagtgcttttgataataaagcaagtcaaaaaaataaataataatttcatgattttttaataagacaaatgatcaaaagttacaaactaaaaacttaaagcgacaagtattttgggacggaggtagtagcaacaagactaaagattgggttggagtgaaaaaacaacaattgacctccggtgaaaattaatcagtctgttaattacaaccattgactcagtagtattatatttaaccaattaaccagtttgttagctaagctagttgccggaattcatgcagaattacagatgcagtaagagtagagatatcacggaagtggatttttgtctctcccggaggcacccgtcgttttgtgtataacatttaaaaattattcaaaaaaaattaaaaatttatcaagattgtcgacgtttgatgtcacaattccggtatttgcatagtatggggatcgttggtactaggatatacgtgagactgagataaaagagatggagacatggatttttatacaatgttcgggcccctgaattgtcaggtaataaccctacatcccgttggccgaagccggtattgctcttattcaccataatcacaccagtacaatatttggggtagcctatctaactgttgtcggcatggcggtctgaaggtctgactcgtggtcgacaacagggtagtcttccttctcgaatccgtgcccggcgagatcagagacatcgctagatccctacggccggcctctgaaggtaccagatagggtcgatctaggcatatctctgatgtcgatatccggcgacttgtcttggcgtatgttggcttgtatgttgtggcttatgttgttccgtgtatgttatggtgggtgttgattgtcccccatctcatcgtatagggccttgtatttatacccataggtgttcccttgtacaagtagaactagagaaacaaatatggatacaatctaagtagtccttatcgtttccatgtagaactctagttgtcttttcttatccggaactcctcctatatccgcaggttgtttccgtataattcctttgattcaaaggggccctaaaaggattcttaacatgaggtagaacctcatgttaaatttcctccaaaacttgcatgggaataggtattccataggaattttatgggattacataggattcattcatttgattcaaagggatatataggaaaaatacctataggaataaaatcctttaaaattcctatgaatttcctttcaatcaaagaggcctaaatatttaaacattaatgtttagaataagattcgattaaaacgttagatcgatttagtcaaagaacaaacaaaaatgataaagtaattgctaatcattgtattagtaaattactaatttacccataataatactggtagaaagcagcggagcatcactcttttcataaataagtaagtttaaatttcacctccacacattgtaaaaaaattactacgaatatacacatgctattagttgaaatttaatttattcgtcttgtcataatttgtagatattgaatgtgagttatatttatgaagtgatatatggtatattaatctattttgttataaaatattataactatttaagtgatatgaaaagagaaggtggtgtcgtctcgagagaaggtgatatgaaaagagaagtttccattctcggagcgattccgagcgaatgagagctaaaatagctggtcgatcattcaacctccattttgccaactaaatctagctagctgatcgttcgtttcttctgtttattttccccaacacaatccatccgtacttataatcgtacgtgcagccatacacaacgtggactatataccaaccttggcaacgcataatgaagagcttgcgagccatcaagtaaaattaaaggcgatcgatatgtccacgcatcatgcacgtgcatatatatgcatccatcagcaagaatacgtttttttttttttgttcttgttgttacctgttgcagttcgtgatcagtaagggcagcaccgtcgttgtaccccccatctggacacgatcgccagctgctcgcccaccctgtcggaggcgaggaagaagagcagcaacgccggcagagcggcgccggcgaggaacgacacgacgtggctccggttgatcgtcatgatgctgcctcccaatctcaaccccatatatatctcgatctctctttgaaactctaaccaaatgtggctggctgatcgatcgtgatgaacagataagagagagagagagagagagagagagagagagagagagagagagagagagagagagagagagagagagagagagagagagagagagagggcgcaataagaagcttggcaattgtctccctgcaaatatgtttcgtctctgtttcgtgcatggtagctgggttgattgaccaggccatggattactttgtcaaaagatttttgtgattgatcaacaaggcgactccatcatcctgcatgccgtttcgctagctaggcggcacgttacgcaactgcgtcagcgtgtgcatgtatttcttcattacaatatatatacccgtcattaacccaagcaaggccgcacacatttcctatccctttttttttctaaaatgctggagttctatttattcgaactgtccaagatttgtaacatcactcccttattttctaaaaatgcacatagtttaccagcttaattataaactacatattgtgaaagtatttcttacacgtgaacctaagaatataaattttatgacgttaaactatataagtttctaaatttatcctggaagcaaaagaaaaaattatagtagttccttttagagtaaacaatatatatatgagttggagtactattttctgcacgtgtattttggtctgtttataccatcagaagaacagtggcggaggccccccctcccaataaactattagaatcccctttaagacatcctaaaatttaaatccatatatctattgtaggggggttaaaatagactttatctgagattgttataaggcccaaaaggctgaggagcccccactataactttatcctggctccgccactgagaagaagaaacaagtagcttccggttcagacttgtgctaaatattattttgacaaaaaaaatataaatgttgggaaagtacgcgtacataaagagtcaaaacctgcaactgtgacacattcaaccacattgacagattggagcaaaacccttgataatccacggctaattattaacctatgtatagaataattaatctttgaccattcccggacttcatggtcagtgccgtttcaacgacgccttgcacttggccgggaacgtccacctgaacttgttggcacccttcttctccggcgacgtcaggccggccgtgtagttcttccagtcggcgagcacgttcttgaggtcgagcaccttgttctccagcccgacgcagcagttggcgtgcaccgtgcacaccctgccggcgtcggggcggtactcgcagaagccggcgaagaccgccgtgtccaggaacgtcgaggaggtagcagtgggggtggacggccttgcagcggcggaagccgccggcgtcgacggcgacgacgaggacgtggtcgaggaggtgggcgatgccgtcgccgttgtggaagctgtcacggaagaggtcgaggagggagcccggcgccgcccacgcgtcgttcaccgacgtgatgatcaccgtcttgtcctccatggccacctccggcagcagctccgccaggccggggaatttctcctgcgcatgtcgcagatttgccacgacgacacgtagcgcacggatggtcaagttgggtcaacgcaatatggagaatttttttcctttagaaaataaccgaaatcccgagtagcggcccagttgtggccctataaacctagagcctacactgccgaagaaacctggactaaatgcaaggcccgcacaaactctctgcttgttcaattacaacacaaaaaagatcggtttcccccctttttttttgacaagtaggaataaacattttttttgcgaggggaataaacattttctacttgggttgaaaagaattggattttacaaataaccatatttatagttggtatttggtacccactaactctaagctcaatatacaggtatggcatattatcacccactaataattattatctattgtattttaaatctcatataaatatgacatattatttataattttcttgtatttttagaactcaacattatgtaatagaataaaatcccggtctttgctcaacgaggtacaaccaaattcacgcaaactagcgcacataaacaagtcttaaaaaacccaccagcaaaagcttaaggaaacacgagctaataatcgctcacacgtgtagtttttattagtttaatgttctcatcacacattcctagtttagcccataaccaaagctatgtcaaatcatcatctctacattgttttcatgaaatatatacgttctattttgcaggacacacattcattcacatatcttgcaggaaataaagcgcgaagtatgaaatgcttttatacaacacgggtgtaaagtgcaaacggtgtagcaaaggatgattatattgcccgtaaggccgtaactccgtaagtgtaacatgttaacatcaataatgttaaaaagaatgaaatcacaaaattccagcaacaatactaatctgcacagagcttttttccccactgtaacagcagagataaaatcgatcaaaccttttctgctggggcaggtgctgagccatcgacgcctgtgaggtcaccaccttctcgagcagtagcacggccaccgatcacgagagctccattgcccaagctcgatatggtgggcagccgctcgctcacccggtcggaggcgaggaagaagagcagcacggtgggcagaacagctcctaggaggaaggaggtcaggtgatggtaataatggccactcatgttgccaagcgccaacaacccaggagggaagtacatggggaacagagctccaatatatacggaagcaaatgctattattcatctgatatctctgttctaaaattttagagaattttgatcatctagttacagggtcaaaatctcctatgtttttttttaaaaaatctcttatgttttcctatattttttaaataaaaagcctcttatattcgaagacagagtgtagtacttattagatatacaagtacatcaatattaattttaaagtatggcgtttgatcatttgttttaattaaatttattaaatgaagtattatttatcttgttatgatttattttattattaaagatactttaaacatgacttagaatttctttcatatctgtacattcagaatttctttcatatttatacattacttttctataaaacggatgaattgtcaaatataacgtccaaaggtcaatatcgctgtataattaaaaacagagcagggttccttccaaacgacgaccagatcggggacttaatttctcgagtgcacatttgacttggaaattttgcctttgagtgaagtgtcaatctgttttctccagaatgaacagtatctttgagtgctgatcccgtaacacggctcggtatttttcaatggtggtctcgacttactctgaaaccggttatacaattatctgacacgtggccctggattcgccaacaaacgcttcgaagctaagcgtgaaagaaaaaaaatgagtagtttacatgtatatacagcgtcgatctcccggatcacgggcgtagttctggagcctagcgcttgaagcgtaagatctccttaagaaaaaaaaatagtgcccaagtatgtacatgtagactgtagtattatccggaacgcgcacgtcaatatattatcctccattttcaaataaatgttagtagtaactcctaaatgatcaaactaagacgaacaaaagttccatataggatggaataaactttaacaatacactagtataattttgtagttttatttttttgcggaaaaagagtgatagaattttagaaataatcaatgttcggcgtaagttatttaaaaacagaggagggcatgggtctacttaaaaaaagttgttttgtttttattaaaaatattagtatattttttttataaacttgatggaacttaaaaaagcttaattaagaaaaaaaatcaaatgaattataatatgaactgattgagtaatttaaaatggaggagggcatgggcggacttacctttcatatttgaaagatctatcaaatgacaaatcaatttatcagcaaattagctgcatcatatgtcatcttttcaatactacaaacagcgcaacagctatcaattccttctcgtttgctagtctccctgaattacaggcgccgccgcggcggcgcgccacaccggccgccggcccggactcatcccctcttgtccggcgtcccgcacttggccgggacgctccacccggcgcggcggtcgccgccaccgccgccgctcttcttcttcctcccctccggcggcgcagggctcgtgtagttcgcccactggtcgagcgcgctcctcaggtcatggagcttgttgccgaggccgacgcagcagttggcgtgcatggtgcacgccctcgccatgtcgttgcggaagagctggcagaagccgccgaacacggcggtgtcgaggaagcggacgcgcacgccgaggccggcggcgagctcgtgcttgatgtagttgaagatgttctgctcgtggttcggcgggtacctcgcccgcgccgcccgccaccgccgcagcatctccactgtccggttcgtcgacttcacgtggtagaacccggtgttgggccagttgctcaggtcgtcgccatcgccgttgaacacgtcgcacgacgtcgtcatgtcggcgtacaccccgatgtgccggaacgggtccctgaaccacaagatatccacgtcctacaacacgaaatcatcatcgcaccattagctgaatcgatcgatctttgagttcctgattagaagaggaaactgatacatcttgctaatttttcacgaacacgtaaaatgattgcatgtcaatatattagaagaaaagagttataattatacaacgcaattagccaaaccggcttatgccaggggaaaggagaaaaagtaaaataaaaagttgaagcttagaaaacgatacatcttagcgaggttgatttgatcattaccgtgaagaggaagttgtagccgagctcgaggacgcgttgctggagggagagcttggtccagacgagctcgacgtaggcctcgctcatgaagttgttggccgagctgaggttcatggtgtccaccttgaggtggtagcagtgagggtgcacagcgcggcagtggtggaacgcggcggggtcgacggcgacgacgaggacgtggtcgaggaggtgggcgatcttctcgccggcggcgaagctctcgcggaagaggacgaggagggagtttggccgcgcgaacgcctcgttcaccgacgtgatgatcaccgtcctgtcgtcggttgccaccttgggcagaagctcagctaaatctgcaaaacttgactggaatattgaaatccaaattaagggtgtcgattggagatgtaaaaaaggataaattcttttgaagtgtagctattcacttcctaaatgagaactgcagtacaatttttgaatcaatatttgagtgttcagagtttcttcagaacagtacttgtgtgttcagattatataggcatcatgtctacgtggagcaagatactgttttgctggatcggagtaaatctctatttgttttcttgataatggattatataaccccacctcttcatcctaaatgaatgtacacggctaacagttcatttctaggaagtaggatcatgactgttttaatgagctagctaactgtgttttgtgaagggaagtactgtactgaatcttttcagcactatttgagaggtggcatattcacatatatatgatgaaagcatcattattcttattaagcacaaaaaaatgactatttgaagtggtttccgtacgttcctgcaaaactgaactgaaatcaacctcactttatacttatttatacagtattatataagctctaaaagaaggtaaggactaaatatgtacgttgatcttttctttttctgtgattttgtcacatgtgaatgttgtctgtggaataaaatctggatctttaatggtaatcggaataacatcattgttttccctttttgtcaatgcacataaatgttgcattactcctttctcctactcaacaattgtcacatatgccatttgtttttctatttttctgctaattatcaaatacgcaatacctatctcgagaaaaaacgatgatgcgcctcttgttttaacaggcctagattataataatatgtgttaactatagtcgtatcagaaatatgatcaatagaccatgattataatcataccgatcatgagacataaacaatacagctacgctctataatatagccgtacgattgcgcgggcttttccgttacttttgaagatataatacaattttctaaccgttagatgtgatcaaagattcgtgtttcccttcttaaagaaagcctttcttttgccgcgcaaatctaatggttcgaaaaattgtacttatggttcctcttcataaataaacattttttctgcttaagcaaagacaagatataagatttaatcatttggggctgtaagaaacatggtatatgaaactgaagattgcagattgctactgtcatgaactaacacagaagtacagaaccatacaacagagcacaaaattaaacagaacaaagaaaaagaaaaaaaacatcaccatacatatcgagatcgagtacaaaagcattattacctcgttggaattaccgctggtaccagtaacttcttctgatatgcgagaagaagcgattccaatctgactgcagttgcagacttccgccgccgccggcatctccggcgatccccccgtgttggcgagcacgcatagcaggaccaggacaagggtggccgcgagccacagctcgaagaggaagacgaagaagcggcggagattgcccttgatctccatggcgacgcgccgcggagagcaaaactcttcagcaaaaaagagttggagaaagggcagaatagacgcgcaaagcctgggattttttttatagggcgtttttatgaacttggcagaatacagctaatgatgatacaggttaattatatatatgggatagaaacttacaactatcttctatggtttgtagtaacgtatgtcccatattgtgaatcaagctggcttttaaatgcttatcgatcaggattttttttcttcaatgcattgtatatttacacctttcctcgatgaaaagttgaaaaccgttgttctctataacattattttctgctaattatcaagtgcgtgacacctatcattcttttaggaaaattactgtgtgatacctatcattagtccaagaaaaatctaagacgactactctgattattctgatgcccctatattataacggcatgaacaaactatagaaaaaaggttatctagttttcagacacctaaaaatatttacaaatttaaagctttttgacaatatagatcacgactaaagtatattaacctaatattcttcttttcctttttccatggtcgcagcgcacgtctccgaccactagatcttgagctcgcgcatgaggccacctccctaccttgcagtgcctcttccatgtgcctcgccctacgccagggccgatgaggcccgctagatgacccactcttcctccttccccactattcccgaagccaaagtggtggtgaggtgcccccgccttcttcctcatctttggtggctcatgccgccgcgaccacctttacctccacatccacctccactcataagttctaaccacttttgatctcatgtcacaaccgccgaccttgccctccctctccctgccttctccgatgctatggctttggctctaccgcctcccctaccatccctctaagcccaacccccttcgcctcctcccttcaacccccttcgatttttgggataaccaaaaaataaatctcattggcttagctattgcggtcgtttattgccatcgattagggttgcatgcactatgtcacgccccgaactagtcccgaccgaaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtatgggagtactcagtaagccaagggaagtaagtgtttaatgcaggcttcaaagaaaggctgttgtttttgcaattgattttatttgagctcttttctaaaaacaactaagtgagtgcttctcaaacgacacgggtgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgtagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgccaggaagcccaggggtcctccccgacaccaccccggcgaatccacatgtctctcggcatcaaggctcccctgataagttagttactcagccaggggtgtcccattccacccatgtggtcgtacttgtcttatgtttggatgaaattacaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactgaacaaacggcgaaaataaagccctattaatgacctctaagcgtgccattagatagatctcgagatttgagaaattttggaatttgaacggagtcaaacggatttacggttgggaagatattgaatttctaagattattggatttttggtctaaaggttggaaaagaaaagaaaagaaaaagggagagggagggaatatagacttccctcgggcggctagggcgcggcccgatagaaagggcagctagggcgcggcccgagagaaagggcggctcggccgagcttaacgggccggccggcccaagaaggtggcccaaggcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcacgggcgggggagggacgcggtgcacgcgcacggttcgcggtggacgcggatgcggcgggcccacgcgcagcctcacggctcgcggtggaacgcgcgcacggggagggactgaccggggtcggctcgacccggtctaggctaagctggctccgacgtggcgcctacgtggctgccacgcgggccggcgggaggtagacgacgacccggccgcgaatggacggtgggcggcggcggcgagcggtggagcgaaccacggcgatacgggcaaaagctagcacaccgggcggttgttcgtgatgaggggagacgagccaacggctcggatttgccggaggaagcttgacggcggcgaatcgcggcggcgacaaccggtggggagggaagagggaaacggcggcgaggccacgaggggtcgattcccggcggtgagagcatctacgcggtttcgggaactcgatgctagcgtcggattggacggagctacgccgagcgaggctggcgacgtgtgggtgctacggagctcgagcggcgacggcggcgagcacacggcgagcgacggcaacggtcggggcggcgccggctaactacggggagtctactcgagctactaccgaaagctagggggaggagatggagcgaggaggaagaatggagggaggcatcaccgagatgaggaggggcgctgtgacgagaggccgacggcgcgggagtaatctctccggcctcgggctggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccaacttagggcggtcaaggcgcgagctggcgctcggcggtcgcgaccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgatgacggcgatgacgacgggcggtttggagcggcgcgacgacacgggcgacagacgcgtgcagaggctgacggcggcggcgaccgggcggtcggccactcggcacgcgcgcgcggcttgcaacgggcggcgtccgcgcgggcgcgcgcacgcgaacacggcgtgcgggaagcggcagcgagggagcggagagggaggacttggctcggcgcgggcggcttacgcaggcgcggcagagcgaggagaagggaagggggcgctcggcgcggcggctcacgcgcacgcgcgcgggcggagcg

SEQ ID NO: 62214 - DNA, 20003 bp, Oryza sativa
tgctgcctcctcctccgctcgcccccactgcccgtccacgccgccgtcacacgctcccacctcgttgccgtcttcgctcccatgacgaccggcgcatctcgccgggggctcatcctagccggcgactgcgaggagcccgtccgccgccgctctgcctcgttctccgccggcgccgtcgctctgcctcgtccttcgccacatcggaccggagggagagaagaaggagagagaggagaggctgacaagtgtgacccacactggtttctaccttccattgccatgttggcatgccatgtgagcaaaagtggcaaatagttaagaaggcatctcgtaaaagtggcaaaaaattatgtccaaacctaaaaggggcatttggataattgtccaacctaaaagtggtaaatagttaaattcccccatggtaaacgggcacaggcgaagttgcgatgcgcgcaaaataatatcgtcggcacgtaagtctccgtgtaggcacacagggcgtgtacttttgattccctcgtatttgcggttgtggcgacccggcgcggtgtgaaggggtgatgacccctcctggcacgcacgatgcgtcgcgcgtgaggtgccattggaggtggtggtgatggtggtggtggccggcttgcttgcttgctgagcccatcgttttggtggtatggcacacggcttgcctaagtgtagtgctgcggtttcttgggcggtgcgtgaggcgtcgatgtgttaccgcgcgggaagtcaagcgcggtcgtcgcgaattgcagccacgagtacgtgaaccctttgttgcgctgtgcaacggtacgagaagacgatgaagtctttgtgtgcggtggcgtcgctgcagctcagtcggagtaggcagttgggcatcgagatgtacagagcgttgcatgaaacgatggcatgatgatcttgccggtcatgtttcaaggattgtgtgaagcggagcggcacacgagttggcacagcgcgactcgctttgtcttggcgtgctggtgcccgcggcgtggcgtggctcgcgattgggctgcgcgagcagcgggtgggagcaggcgacgcgcatcggcgcgtgcgtcctgcctggtgggctcgaccgcgatatcggccggttggctggttgggccgcctagccgagggaagaagaggaggaaaattggaaaaagtacgccgaaggtacctcaacttgttatcgagttaaagaattgtccctcaactgtaaaaccacatacagcgtatctcccaacatacaaaacctgtgcaaactagctccctcagcggttttcaccccgattttttctgacgtggtagctgagtcagcgtagaatccacattggccccgcatgtcaggatgccacatcagcacgccggcatatcccttcctctccttttctcctctctctctcacactcttctctctggacgcaggccggctggcggtggggaggaggtcaccggcgtaaggaggtccgacggtcggcaggcgatgcggcggcggcgcgctcgtactagtcgtgcccggcgcccatgagcctaccccaccgctccaggtccccaacagcgaagccgctgctgtccaccgctgcgagctccacgccaatcgccgcgtccgtgccggccatccagatccacccggtctccacgtacagcgtgtacacgcactcgttcttgtcgttgtccccaccggcaaccagctggccacggcgcggcagcgctgccatgccgtccagcgatctcgatccggcggcctgcgcgcgcgtatgcaattaacatggtcagatcaactcacaggtcacagcagagcagagagacgatccgaaaagaaaatgcacgtaccaagaccaccatggaaacgagcgaggcgaagtgcaagaatctgtcagcagccattgtcgtcaaaggcttgaagaactccatctatttggactttttggattggatgtgcccttttgtgagctaagctgaagagtgtttatatattggcagtaccagatctaacagtgacttgttagattttcttatagagagaacagttcgtgaacctcaagctccgcgcgcgtacgtgaacctcgccggcaacccggggatgaggacctcctcgtcgtggccgtcgtcttcttcgccctgttggtccttgctcacatacgaagcctgctgcgacgacagcatcggcagcttgaaccagctgcggccgtggcgctgccctcccctgtcccgtgtctctgccctgccgcgtcgccgccgccgtatcgccggctggccgtcggacctcctcgcgccggtgacctcctccccaccgcgggctggccggcctgtctagtctagagagaagagtgtgtgagagagagagaggggagaaaggagaggaacagataggccggcgtgctgacgtggcatcctgacatgtgaggcccacgtaggtcccacgctgacttagtcgtcacgtcggataaaatcggggtcaaaaccactaaggaacttagtttgcattggttttgtaagttgtaggatgcgctgtatcggttttacggttgggggacgattttgtaactcgatgtcaagttgagggacattcggtatactgggaggcgatagaaaataaaagaaaggaataagtttaccagtagtccatcaactttacatcgagtttgcattatatccctgatcccctataccaaaatcttcacccgtaacctatataaaaccgtgcaattttggtcctatggtagtatggatctctgcatttgcttacgtggcatcgtagttagtgaaaaaaaataaaaaagttgtgggacccaaatataagtggaaagaaaaagtgtgacacccacatctcttctttcttctctcctctcatctcttttcctcttttcttctcctcttctcttcagcgatttcagagagggaagaggcggctggtgatcccgaccaagctccgccgtcgctgccctgatgggaggagggaaagggggagaggtggggcaaccggcatgaaatgagggaggggagaggtgtggtgatggggacagtgaggcaatgggggatgtggagcggagcgggcgggcatcgcgagtggtgcccatggtggcgagctcctgcgtgctatgtacttgctgcatgggcggtggcgtggtagggagctgtcgatgcgaaaaacacacactggccttagagatttgcatactttagtgcaggtcctaaatcttacttttgggttcagggcgtgccagttggtttgatcctacaaccaacaagaaacatcgcaaacaaagttaaatccgtaaatgatagccgatcggatgggttgccgatgacgtatcgtttatcctaggccgatgtgatatggatcagatcagcaacgaagtatgcagcaaaggaggagttaaacctgctctatgggctgtagatatcaataatatgtaatctacacttcagagtacgtttaaaccaagtgattaggatagatcggtcaggataccgagagacattataaaccactcaagtttagagatacttcaaagcgaagattatatatattcacagcatagtcgataggcaaatctgacgtgtaactactagtgctccgatactactttatactaatatatcaatatatatcaaatattctaatcaagagtcaatccagtgttaggatagcctaatagactgacatcgagcttaatatattttatccaagtgagatcctaatataaaaggcagattcagtatatcaagaaaacaagacaactaaaccatgtaagatcggctgaaaccccaatgctatccttattagctatcatggaacaagctatatattatggttctagatattacttaatagatcaaactcaactgatttaacattaagcataaagagaaacacaaaatctaaataagttaatgagagcctttttgggatggtaggtatcctatataatctaattcaacgatgatatgaggtcccgttgactgtttttgatgatagaggcgggctgacaatgtcacatagaaaagtcgataagcatacatgataactcgacgatttgtgtaatcaggactagagtgtcgtaacgatgtaagcactagtcccaagaacacaagccaccataacaagctttacctcttgccggagatcgaaactaatgcagcccaactcgaaagcaagtactcatcaaaaacaaagaaaagtaaatggtggcgatgcgccgagagtgtactaaacttgatgttttttgtttacacggtctcggatcatatttatacccaaaatacatagaatgtccttgccagagatgactccacttctattacaacttgaaaatacgaacaagtcccttaggcagactcttactgaaaatatctataaggaaactaccaaaatatcctaattaatatatacaattgccttcttcagactcaatccatacttggcaataattgtacaacacttcgaccgataccgacaatgattctatgattatcttgccgaaatcggctacatcggcttccccgtatccaattcggtgtcagccgatgcagacaatagccaatgcgcactctgtttccgtgaataacgatttcctcccaaatccgctttggttttgacttcaaatctaatttatgatttaccaaacttggtcgttaacaggagcccagcaagctcaagctcgctccacgcgcgccacatcaccgggggcacgacgacgggtgggtgtgggcggtcccgctgctggatgccaatgacagcaacgatggtcgagacgaacacctggaagctcgtggatggccgtgtcgccctgaggtggtcgtactcgtcgcacatgtaggcgagctcttgccagagttgaccgacactagcaggtcctcgtcgaggcccttgtcgacgaggaggtacctgatcgcggtgacggcaatggcagagacactggctttctctgcctgtcgtgccctcaactcgcggaagggacctcgtgcggcacgacgaggaaggcgagggcgtcgggaggcgcctcgtcggggcagtccaagtcgtcatccggaggcggcaggagtggcggcggatgcgctccctatgctgcagacgcataggccgcgatgccggttgtggcgccgtcgccacgcctctcccctcccccatctcccgccgggcgcctcctgtctcctactttctgtcacgtcctgataaattcatcccgaaataaaaatcattctctaaaaggaataatagaattaattaaaatttaaaaagaaattagcaaacattaaaatgcgtacaagaaaaattcgaatgtggcccgaagaatttttgttaaattctccttggtctaaaaggagccctcaaattttactttaatttttagaacaccggaaataaatattaagcaacaacaacaattatcagagtttttaaaaaaagaaaactaaaaataatcctccttcctcctttgggccgagtctagcccaaagtcttcccctctctctctctccctcagcccgcggctgaagtccctctctcctccctcccttttccctcctctcccgggcctcccctcccctcggcccagctccctcctctcctcctcccgcctgggcctgccccggcccaagccgagccgcagccctcccgcgcacgcgcgttgaccgcgcgccttccgcgtgggtcccgcccttcaggcgtccccgacctccagccgccggcctccttcctctctctcctgtgaaccctagcgccgttcctccctccaatccgctcgattcaaatggctaattacaaaattgattagggggaattaaaccccattgattcctctctctttccccctaattacccccttgaatagcaccattaattgcccggaacagccgtgccatccccggccgccattctcggtgccgttccgccctatcccgtggccggctctcttccctccgctataaaatggaaccccctctgtgcgttctctcgtttttgcctcttcccgagctcccccgtggccaccccgcctctccctgccttccacctctctctcccgtgccgccggccacctccagccgcctctaccgcctcgcccgtgtgccggccgtgccgtcgccacccgagagcaccggaggcgcgttcctgccggcgtccagtggcgttgccgccactgcaccatctccggccggctgctgttcatcgccggtacgccgatcaacgccgttgtctccttcgtcgacgtcgtagcgtcgccctccgccccggcctgccctcagattcgtcggaacaccgtcgtccgcgccgcccctccttcggtcacgtcggcacccactccggcagccccttccaccgtgccaatgcgccagccgacgtcgccgtctccaccttcggcatcgcagtggcaaggtcgtcctcggcctcgcctcccctccatccgaaccccgccggtcttcgtcgtcgtcctcccgttgttcctggtagtcgtggtattcgtccctccgtcaagccgtgctgttcgtcgcccgcctttcgtcaaggttgctgcagccccgtcgtcgtcttcgtcctcagctccgcatcgtcaagcgttgcgccggccgcgtctcgccttcgtccaaggatagccgccgaagtcgttccctcgccgtttgcttctgtcgtccctgagctgtctccgttcccacgcctcgtcgcgtggtggtaaggatccctctccctcgttgccccgtcctcgtcctttcggtgtcgcccatgcccgttgtgcggttgtcggccccggtacccgtgtatcggtgtgggcagtcgttcatgtgtgcgtgtggtgacctgttagtgtgcccgctcggtagccgtgtggtttccacgtgtgcatcccgcgtggtgtctagtggagtccgtttgtcagccacttgcctcggttgacacacgggatccgcttccgtcgacccgtggaccgtctctgtgtactcggtctaccgtggtcccttaggttgacatgtggggtccgcatgtcaatagcgcagccttcctgtcttttccgggctagcgcttacacatgttttatagttgcaaagcctaattacaataattcgtaaatctccatgtaacagcattaaacttcggatgaccatatcttggtcatacgaactctgaatcgacccattcaagtctcttaatgtttgttataacctaaagaaccgtgtgctttctttttatgtattgttattgcttctttttaggcttgtagctttgcttgtgtacttcgcgtagcttctattgttctggaggtttctgaagcgtgcttcgctgtcatcgccgaaggttcggaaggccgttctctctgagcaaggcaagtcgcatcacccttaagcatattgaatcccagtttataaaattattttgatttaaattattgcattaccgctttacttaaatttccgcgttatcactattttatttagccatgcctatttacctttgttatgaccttattattattgctattgttattattaccttgttcaccctaggataaacaaaatcccaactagtgggtactctattaatggttccactagtatgaatttaggtagatgcttcgctgattaattaggcaacactaggtggttttataactttagactttgggagttctcatatcatttggacattgtggaatggttggcttgtgatggaattgaacacacaccttccccccccctttattcaaaactcccaaaatggttttaggctaggctcgaggtgcatggttctgctagtagcacctcggccactataaggaccggtcttcgggcctctgttgcaaaacactaccgtactaaccacatgtctaatgggtaaggcttaactcagtgctcagtctagtcctagcaagagtacacggatggagatggacgaagtcggggctcgatggacatctctagggcaaatgaaggctacacgggctgcggctcggtagtcgagatgtcatggcatagggccggtgtcctgctgctaggggctcaatcttacctacctatctcgggattccggccgtaggcgaggttgggtcagtgcttttgtcacgactaggatgggtaaaggggttatgtcacatcctttacgacggggttccacggccgtggaatgcggagtaaagatgtgtcttgtgggtaaagatgtacacctctgatcagagtataatctattcgaatagccacgccctcggttatgggcaagcctagcaatgtacccaagttagtggtttaattcttaaaacttgcttaacaactaaaatgtggaatggttggcctgggtttgcttgggacgagctgggacccaggtcaggttgccagttcggtctgaatcatcgtaggccttggattaaggcaggtccgtgtgggttcacggccttgattaataatactgtgtagctctaggatcgtctttataaaatagctttgggcaactaagtgacttttaaatgttgtttactgcaaaacttaacccttatattattaccccttgtaccccattgcattaatcatgcatctcccggtgtggcttgctgagtactatggttgtaatcatttttgctctatctctcccccctttagtaacagaagctttggagaagaagtcctaggtagagccctggcttataccccagttgagcacctgtgaagatggagccgtaggcccgctagtctgctgctgtttatttttgattgtcaggcctgaagcgcctttgtaataatgtaaatattatcgatggaataaagatgtgttttttatatcatgtttgtgtggtgtaccccggcttttcttgggacagggattaatacactagcgttcgggaaaatgcaaattttctcggtcgtgacactttccctcctccagttgggaggcgctcgagacggcggtggtggcggaggcactccgttttcttgtagtgaccttggccgggcttgcgggccgcctctcccctctgtgccatcgctaaagagaagagaagagaagagaagtagaaaagataatagaggagaaaacaggtagtggcggcctctcccctcatttgtttgccctcaggtacaaaattggagttctcacaattagtttttacacttcttcattattttgataagggagtttgagttcttttccttcatgtttctctttcattctttagtccattttttctccatccctcatgatgttgcttctcttccttttcctaatcttcctctagctcgctgctgcccattccgatgaccatcctcatgtccttctaagatgcatgttttcaactgaaaaacatgtaatatcttttaggtaaagcatggcacgctaaatgaatcattttttttcgaaacgctaaatgaactatagtagattgatgagtaccggaaacgctaattagcgcagacgcgctagctagcgatctagcgagcgtttttggcccatgttgttccggcccaccagcgcaccagcgaggaagcgggtcttttttttcgcggcacgcgcgcatgcatgatgactaagagaaaaaaatcgtgaagaggattaagagaaaacgtgattagtttaatcttttcttccgataatcacatattagttaactttttttcaggaggttttttcttcttttactaaaagtttaaaaatctctacgtaaaatttgaaacttttaacttcagttttgaaaactttcaacccgaatttcaaaaactttcaacccgaatttttaaaacattcaagtcaaaactttaaactttcaactcaaatttaaaaacttccaactcaaacatgaaagttttcaaatttgacttgaaagttttaaaattttatgttgaaagttttcaaatctgggttgaaaattttaaatttgaattgaaagtttccatatctaggttgaaagttttcaaatctgagttgaaagtttttaaatccgagttgaaagttttcaaacctgagttaaaagttttcaaaatcttgagttgaaagtgttcaaaatctcgaattgaaagttttcaaacccgagttaaaagttttcaaaatctcgagttgaaagtttttaaaccatagtggaaagttttttcaaatttgagatgaaaagttgaaaattttcaaattttggcttcaaaaattcaattttcgagttgaaaagcttttaaatctagactgaatgttttcaaaatttgacttcacatatagatttgttttcaatctgttacttacaaatatgttctagaaaaaaagtcttatcttaattaccgtcgttatctaaaactaacatgttagttacgttagatatactcgtcgaaaaaaattctacggaaaaaaatccaccggcatacgcgataaaaaaaaccacgaaaaaaatgaaaatccaaaagtgaaataaaagtaatagaaagaaaaaaaaaagaaaacctacctagggctgcgtgcgcgttgccggcacgcacacgccaactaggaagccccgaagagtacctatagttcaatcttcatccggtaaagcatggcacgctacggttgggacataccatcaaaatgagcatagagctggagatactaaagaacctggacattttggtttacgaaaaattgtaaaacttgaagtttcatatttcatcctataagtcattttattgtaaatacctagttatctatctcaacttagttttgttgaaaaaccgcacacatgcttaactgaatcagcccgttatcgttgatgtagagttataccactagctaagttagttgagttaattttgtccaagtgcttgaattagatttatttttcatgtttggttgaactttatttttgcgcatatagcgaaactaagtatcataatgtttaagctctcactgacaaaatgacttataaggtggaatatgaaacctcaagcgacttatgaggtggtttttgtattttcccttgtttttttttaaagttgcaactaagcataggaagaactacaggaaaaaatgtacaaaatttttgacaggagcagaaggcctaatgcacatacggcaaaataatgaattttgacaggatctggaccaagaattgttagactactctataggggacaaatagttaatactcctgcttttaccacggtttgctattctacattgttctattatactccctccatcccaaaaatagagctatttatgaagttcaagtttatttctccatccacccctcatctcaactaacgagagtcatccactagtacagaaaacattttcctgtgcgatcaaaatcgatttttccatacggaggtagcgcccgtctgcacccatatgtctgcgaaaaatcaactttatctcgtgcgggcggcccaaccgcacgggatcagtcagattaagtggaccgcacgagatatctcctatttaattcttcacagctttctcatctcagtcattcacaatcttccaccaccattcatcttccacccccattcaattttacctgcttgcttagttccaatgaaaccatctaaaatccatctaaaatttcttacattttaggatggggagaatatggtttaagtttttataagacatagatagtttgttggtttgttaacagacagtcgtacaatcattaaatgcaaacctaaaacaaataattatacatacaacctattgcactagttgtcatatatcatctcagagtctaagcatgacaaaaaactatgagcatcactacggtactttattggtagtactctttctatcctatatatattataggtctagttatactcggcacggtatccaaaactaatgtttaacttataattttccatatacaataagttctctaacaacaaaacaacaaccatatgaaaataaatttaaatgtcaatctaactgatagtttttttagcaaatataaattcaccttatattataataatttttcgtcaaatgttttcaaagttaaatctaaaatacgcgcgtgtgctacgttattggattgagagagtattatattaccagtataatcgatctgaaccgatgttttgtaagggcatttattttattcatctagtgattagtggtaaggttggtatttaggatattatacatccttaagaaaaagtttttatctacttagatagtatcgcttgggtactcgcactagtaaaaaaaattatttgttcagatgggccaaaattagttttcgtgtgcggacctccggcccatctacgaaaatccaattttttcatgcagatgattatgtcatccgcacgcgaagacaaaaacccaaaaagaaataaaagtcgcatcctcgccaccggatccgggtgaccctgtctgtccgccgccgccagtctccacccgtcgcagcggccgttctcctcctgccaccgccggatctgtgtggaggatggctgtcgactcctgccgaattcgttgccgcccacccgccaccgcatgtacgccgccgtgctcctcccgccaccgccgctgcctttgttgctttccagtcggctgccgccactcgtctaggagagagtttgagagagagagagaggagtatgaggagaggagaggagatgagataactagataagtacaagtatgaggtaaggtgagaggggatgattgaaaaaattgaattgttaaagatgaaaaaaaggaggaggtaactcagacatttggatggacctttaagaggcccgtatggaaaagttacccggtttttttgcatatggctccctaggagggccgtctgcgaaaataaattttcgcgtgcagttctctcaaggagtcgtatgtgaaaataggggaccgaattttttcaaacacgggcacttatgataggtctgcaatctattgcggcggctccggtggtcacgctcacacggccgttctttttcacttcttatcctccattcgttgcaccgtttcagacaggaagtactcctagaagatataaattgttggtcagcaactgtagcctagtcgttggcttagtaaatttcatgcataatgttcagccctgattctttccgcaggcaggagattgccgaccgtagacataagctaccatcgataggtgatcagccgccgccatcgcccgcgtctacgccagcatcatgtacgctcggcccaaaaatcccagggtttctaactgatatgcaaatttacaaaatcatcattcatgttaatatgataatagtgtaaatagagagcacagtaatatatgattaattgagtattaattatttcagattttaaaaaggattaatatgacttttttaaaaataaattttatataacattttttttcaaaaacatacagtttagcaagtcggaaagtgagtgcgtagaaaataagaagtttttctcccaatgggctactgccgaatgctaatgttcgaacagaactaaagtagaaactgaattatctgaattttcctggcatttgagacagcaatcaagcctgtgtacaagtcctttacacatgcctgaaattgtgagacactaacaacccagtccatgaagtccaccaaaaatacgcatgagtactactaaaacatttggacagcagtgacaaatataagaatttgaactttgtcagaacatactaccgatggccaaggccaaatgtttcaagtttttcggctttgtcatgtctaaggtcagaattaaaatcacatttacaaaaatataaacggaggaatcgctttttaaagaccacttagataatttgtacagtaagagcagagaaatcgagtgcaccaaatgcttagatcccatttggaagagaacattaaactctcacgtgagcctgttgaagtccaattccaaacaaaactttagtattttcatcgcagtacataaacagaagagaaacagacacctatatataacaggaatgcagagctagctggaaacgctccggataggcacggcaaatatcatatggacctctttcttcagttggagacagtgtgacatatgcaagtcttccctcaaaacataggattggtaggcaccgggaactccttgagatctcaaacacagaaccttagccatctagctagtatgatagcagcaacgcagcacacagtttcctgcctcatgactgttttcagctccagcgtgtgatctccatggagcacctggaggaaaattggctgcagacctacaataaaagaccagttaaaatttaaaaagttcagagtacagataaacctttttagtcaatgtcatctccgtagtatttgcggcgaatatttgttttttcattatctaaaggagctgaaaatgcaactgcaagaaactattacatggccagcagcttctacagcactgtggccgacatgtatccgtggatccatagtaaactccattcatttcatcagaatctaatctctctacaagaaaaatgttcctcctcctaatagtagccaggcacaagaagacacagcctcaacaccctgataccataattcaactctggcagcacatgggctgtttgcagatacccgatctccagcacaggggtgcagcaatgtgtggagtagttaagcagttaaatgatcctacaaagaggacaatttatttatgttgtcaaagttagtacaagaagtagcaatataatgtgtggagcagttaaatgatcctacaaagaaaaaaaaattatgtacatgttgtcaacgtttgaaccaatcatataatatcccagctactttttctgttttttaggaacacataacagtaacagccccacttaacaactccattatgtattttttcataaataacgactccattatgtagtagtaccccaaaaacagtcaacaaatggtcccaacactaataccttcattaagaagcaagaggcataggaattacggtgtgacaaatgtttaccactgttacctaacaaggaccaggctggtgttcacagaacccaaagcagagcttgaacaaagagcaataggttaaaccagaagcattcagtgagaattcgaaaaaactgcaagcagagggatgcagccaagcatgccctaccatctgaaagtccatgcactgctcacacagagtcaaagaaaggatgattaagatcccagaatagaattttactccataaaactttacctatacaagctaaccactccaaagcagaggtttgcttagtgcacattacctctactgtaccagtctacagaagctggatgcatgacagacaaccatgcagtcctgcaatgcaaaacgcattatcacaatccatctgctcccaacaactcagaagattcttcattcttgttctcctccccctctcctaacccctgcttcagcaaggagatgctcaccttctccacttcatcctcatcacagccacattgcattcgcaaccactccaccatctctcgccgatggagcaggcacgcgttggctcagccatgatcttcctactcctcgctttcctgtcagaggtttctgcatccatatcgcagcagcagcagcagcaatgcggtggtgcatcgtctgcaggagtgagagctggcttctggctgccatcctcgagccactactcgcctctcggcagcatcgacacctcgctgtacagccatctctactacagctcgctctccatcgacgagacccgctgcgccgtcgcgccgccgtcctccggtgaagagagctccattctttccaatttctcgagcagcatcaagtcctccggtgggggtttcgctgtcaagaccatcttgtccattggcacggatgagttcagggaggatgtgtccaatgccgccttctccaggatggcctcggagaagaaccttcggagagcgttcatcaactcgtcgatcgaattggctcgtgccaatggcttcgatggcctcgacttggcgtggaggtttcccgcaacgcagctggacatggagaacctcggagatcttctcgcggaatggcgagccgagatcatggaggattcgacgaccagatcgaccgagcctctcctgctgacggctactgtttacttctcgaaccacctgttcggcatggccgacactaacctcaactacccgatagacgacatgtcgagcagcctcgattgggtgaacattatcacgttcagcctgcacaagaacagcaacgtcaccacggctgacgcgcctctctacgacaaggattctcacttctcggctagctatggtgtcatctcgtggctggatgcagggctccctccatgcaagcttgtgatggggatacctctgtttggaaggtcttggttcctcagaaacaaggacaagaacgggctaggagcaccaactgcagctgctggaacaaagcagagaaagagcaaccagatcggcgtaatcgcgtacgcagagatcgaagagtacctgaagtctcagagtgtttttgttactcatgacaaccagtcagtggcagactacttctacagcggtgatctctgggtcagcttcgacagtgccgtggttgtgcaggagaaggtggagtttgtggcgaagtctcagttgcttgggtacttcctctcgaccatcagctttgatgactcaaactacacattgtccaagcaaggttagtgattgtcaaattctcatcacagatgtaattaaatgcctcagctaatccttccaaattttgtaatgcagcatcacagtcctggaatcaatatcatgtttcttcatatgcgcaaggtagttttggaattatgcaagaaggagctataatccaagatctgcatgcatcaacagggtcaccaagtagttggtattcaaaaactctcagctacttgttattgtcaataatacttgtattggaggttctataataccaagaacagccgtaatttgtaaacaggccagattgcacaaatagtttcagatgataaggcttataacactacatttatgaacagatgctctgttttatgccttccatgtggttcagagacattatctgaagttcaaataaacaggttgcacagatcatgtacattaccaggacttttcaagttttaccaacaagtgaggttttgaaaagagctatttgattttactttccggcttatgttgttgacttcttcttctcataaaagtaaaatcaaacagattttttccgaaaccccacttgttggtaagacttgaaaagccctgttaatgtacatgtcctgtgcaacctgtttaatgtcctatgggggtttcatccctcatagggcgttgatgggcattgatcaaaatttgcaatacgatttttgatggcttatgtgggtggtcttcgacaatcacaacctctgatctccggaagctgagccagcttgtgtggaagaagaccttctgacattctcgactcctagtgcttcgaggttgcatgtgaagtaaatggtgttaagctagcgagctggtttagttctcattaggagtttggttatgtgatcttgttggtggaaaacatcaggcacctccccccctctctctctcatttcttttatgccccctttgattcaaaagaaattcataggaattttagaggatttcattcatataggaatttttcctacaaagctctttgaattaaggaatgaaccctatggaattttatgaaatttctacggaatgtctcttcccatataaattttggaggaaatttaacaagaggtagaactcatggaaaaaaatcctgtctttatctctcctcaaattcctgtgtttttccagtggtccaatcaaacaatcattcctacgtttttcatgtcggaattctatgttttttttattcctctatttttttttttcattcctgtgattcatagtggcccttagtgcccttgggggtggttgtgttccccttttggtttctcttcattgtattccctcgtgtactcactctcttattctccaaggctcatgcgcttgcgcaatcggagttttcccctatgtaagttcgtttgatgcaatatattcaggtgggcaattcccccctagtgacccgtcaaaaaaaatattgttgactttttagcaagcaccaattctaaaagatatatatatctacaaagctattgaaatgtgcaagagattgtgtcatagatagccgagatggcctaaagcaaaagatcatggtgttgattggttaagaagatcctcatcatgacactgctactagaactcaccatgtcccctactcttttttccagtagggaatgagctgaaactagtagggaaacaagctccctaggctttttcatagggaaaactttcatgggatattattcaccgggaattagatgtaccttacgattttagttgtgaaagcgcagggaaaaaaggttccctgcggtttgaaatggtagagaactaggcttacatggcattatattcagtatgtaaagtgattctgattcccccaaggtttctaaaactgtagggttccaaaatagagagcttgcagctagcaatataacacaaaactatccaagaacaaaagaagctgcattcaacacttgcatcaaggttcacacttcagtgcaattcttccaaacattctaagatcaaaatgggccaagctcttccaaagaattccaaaggacacctgcaggtcgttagagtataagtgttttagattatatgttgaagggtattttagtcgtttcactttcttcttgtacacaatatatcgctctttagagctaactcaatgcaaagattcattctccaatttcctctaaattgtgacatggtataagagccttacacctaaatctagccaccaaatccccatcgccggcgcggcggctcgtcgtcgtcactggtcatcattcgtcatcttggtttcagtagcaacagcagtcagtcgtcatctttgtcttcaaccagcaaagcctttggcggccatcgccgaccagcctccattaccagtcgtcgtcttcgtatttgaatcttcaagcaacagcagccgcaaccgaatcagtcgtcccgcgcggtccttgtcgcgcgcccgtcgtggctccacatctcgtcagtcatcactgccagtcgccgtccattgcggaaccccctcgaggctgctccatcatcgccgggccatccgtgctgccccagatctggggcactgcatcatcgattgctcatctctatgcctgatctgttccgcatttgttgttgccggctgtagtcgtcaatctgggtcctccgtcgcctgcggtttcatctcgtcaccgccttcctcgggctcctgcgctgagcacgtcggccggcctgggtaccactctgttctgcaacctttgctcttttgtgtctttgtcgtcagctagtcacattcatcttcaagcagcatcaatagcagcagccagcaggccgatcctctgcttgctgtctacaagcacaggccctcatctggccatctcatctactacagctagcattcacagcaccagccctcattgtgtcattctttatcgagtggtgaaaagttttgaggtgtcacatcgaatatacggacacacatttaaagtattaaacatagactagtaataaaacaaattacagattccacttgtaaaccgcgagacaaatttattaagcctaattaatccctcgttagcatatgtttactgtagcaccacattgtagcaccacattgtcaaatcaagaagcaattaggcttaaaagattcatctcgtaatttacacacaatctgtgtaattagttatttttattatatttaatactccatgcatgtgtccaaacatttgatttgacacggtgaaaatttttaccagaggatctaaacagacccttcgctttagttcttatgcttgcttgccgctgctatgaatatatctactagtatcaggtgccttttgctactatgctgatgtaatcaatttcctatgtgtcgaggagtgatcctctctagcgggaggtcatgagaccccccctttgtgagttcggccggggaagcgagtgagatccgaggttcctcgagacaaaagagacacgagggattt

SEQ ID NO: 62215 - DNA, 3938 bp, Oryza sativa
accctcctgctacacgaagtaatccaagagggtcccgtaattatataaaagtagagactcaaagtttaggggtgagactctctttcactattcaatcatccgatcaactgtataatgagtagccccctcctctctttatatagtgcaatctaatatatggaaagtttggtgataggcccaataaatatatttaggccaggccttcatgggccaagcccaaagtttcttactcagaactaccagaaccctacgggcgcatagcgcgcacaactttctatattccagcacactggcggattaattcaccatccagcgacccggacgactgctcgggtattcagcggataatcaattgggttctataaatttagaaggattgaaatgaattttttatagtaaatagtagctacccgtcgtttctgattttttttagtcaaacatttttggatttgatgaagtttatataaaatttagcaacatccataccatcaaattaatttaattaaatataacattgaatatattgtggtaatatatatcttttgtcacaactacagaaatcataataagtaccagttgaaaatcccacgtagatgccgaatttcctagcgggcacatcacaggcggtactaatgaggaggacacaaatatgctggtttaactgacaccattgagatatacggtttgaaaaaaaaaagctggctcgactcgagttgagctgatgattgaaagccaccaaaaataaatcgaaaaattcaacaacaaaaaggagacaagttcacgatagagaatcaacgagttcatagatcaaaatcaaaatattcatcgataacttcacatcattgaatcaaacatcatcgacaagttcacatcaaataattcaaaaaccaaattaaataatgcaccaattacactggagaactctgcccgccgccatcgcgcattgaagaggaaggggaggctgccacaaaggagagaagggaggctgccgcccctgcataggggagaaggggatgtcgtgggcaggtgagggaaacaccgccgaggggagatgaggtggatgtcatcccgttgagccgcgctgctgaggggaggcgttggtggacgttgcctcctccgctcgctctgttgcctttccatcgagcccccaccgaggggaggcactctgaggaggcaaggccatggagaggtgagggaggtgccgccgaggggaggcgagatggatgccacctcctcccacttgctcagccatcgtcccttcaaaccgtgccaatagatgtggggatgtgggggagagattgagaaggagagagccggctaggtggagaggaggctgccttgcctgcttgccctgctagggagacggagctagccgccgcttgcaaaccggacttggacgggagagaggagatgggagagggagatggagacttgagagggagacaagagacaggaggataagaagagagcgaagagaccgagaagataaggacgagagtgaccctattcagttcggctccttcctagagtgttggttgtttaaaaaaccgatgctttttatcttgtataaggtgccggttgttattaaaatccatctatgtctgacaacacttattggtgctgcgtaatattaaaaaccgatacctatatcgtcacataggtgtctgttctcccaaacggtgctatatgagcacacgttcggacgagaaaaacattataggtggtggttttattttttcataagtttagttagacttaaaagagtaaaaaaaaatcaaaacaaattaaaatatgaaacaaagggagtttgctgggactttataatttgggtaaagttcaccagctgtctctcaactttacgtcgagtttgtataacatccctaatccccaatactagaaatcttcaccccttaactataaaaaaccgtgcaatttgggttccatgggatctctggtttcgctgcgtggcatcatagtccacaaaataaaaataaaaaaaatcatggagcccacatgtaagtgactaagaaaaaaagtgtggcccctcatttcttctttctctctttttttttctctcctctcttctgttttcttttttttttctcttctcttcagcaatcctaggagggtggcggcggcagaaaggggagagacgatcggcaagcccggccaagctccaccgctgcctctagcgcctcatgacaagaggagggagcgggggagaggggaggcggctggcgggagattggggaggggagaggcacaatcacggggatggcgaggcaatgggggacggggggcgcggtggggtgacggggatggcaaggggacaagggatgggcacatgccgggcgggcgtcacgacggtgacccagtgcgatggggacggcaaggcgagcggcttggtgatggggaacagggcgcggggcaagccggccgggcatcgcaaaccggcggtctccgtgggtgacgatatgctgctcgaggtggagcgacggtgtgacctggggtcacccatgtcactgactgcttccaccaccatttcatggccaccgtcgctgctgtcccctgacgtaccctatgagatcttgcgcggccgcatagcccatggctcgctgccgtcttcatagcctgcaccggtcgaacgcctgctgttacggctcgatgggggagacgacgacgctgccaccaaggatgcaccgagcgagcgctgacatgtgaacgtacgcgaaaccggggataaattgagtccatactgcttgggacctttttttgcacggtttgagataggtgaggggtagagatttttggtattactgattgggacctcagggacgacaggtgaacttattaattctttaaaatttctcgggatcgaccactgttccatcattactttgttgatcagatcatatgggtgttacgttttgttggaccacatttgttggcccgactatatttcatggcccaatctagcttcccgggcaaaatttatctgggctttgctggctctgttgatgggctatatatcttggcctatatattgatgaggaataagttcatctgaggtcccttaacttgtcaaccaatccgattttcgtccttcaaccagaaaaccggatacaacgagtccctcgactgtcaaaaccagtgcagatgaggtctctcggcggttttgatggcggttttggctgacgtggcgcctacgtggctaatttgacttagtcttcatctgatgtggcattgacgtggcgtttacgtggcaatttgatcctgaaaataataaaactcgtgggacccacatgtcagtctctcacacagaataataaaaaaatggtgggacccacgtgggccccacctgtcattgtcaatcctcttcttccttctctctccctatctcccctcttcatctctcccctctgctccctcctctcgtcggcggagtcgcggagataaaggacggcgtggggaggcgcggcctcctctactcccgcccccttgggcatacgccggcggctgccgcccctctcctcgtcgcgcgccgatgcgtcttagcagctcttgcctctctcctcgcgatctgttcgccggcatgctcattgcatcacacccacgagcgcggcctgcgacgggcgctgccggcatgctagctgcgaagacgccgtccgtggcggtggcagcggttcagagagatggtggatggagctgtggcaggactggaacgcctacaagaccaccaccaccactcgccactcgttgttcgctcgcccaccatggccatcgcgacggcgctccgcaagctctcgcccacgtaggcgccacgttagccaaaaccgccatcaaaaccgccgagggaccttatctgcactggttttgaaagttgagggactcgttgtatctggtttttcggtttttcggttgaaggacgaaaatcggat

SEQ ID NO: 62216 - DNA, 17918 bp, Oryza sativa
aaacttattcctattgatgatcgtcactgaaagatgtacgtacacgagaccgagcgcttgctcgggtgacaaagcgtcgctggtgggcacgctgggttcgacccttgtgctcgcccgggggatttttcccctctttccccggactgacttcggttggtcccggctagataataaggtatacatgtgcacgttttccgtgcattgaggtctagtgcctccaatcttattcctaacgtgtgttaggaacgcgtacgcatgtgtgtgcgtgtgtcgtggtgtgagtgcggtgtgtgtaagtgtgcgtacgcataataaattatgggattaattatgttggcttattaaacagatgcaaatgcatgcgcgagttttctattttctatagaaactcttcattaattgtagtacacgtacgtactccctccgtcataaaagagcgaatgagtttagacagaggtatgccacatttagtattagatgagttttttttaataggtggagggagtatataaaggcactgctacgttttaataaaataacatcattgacttttaattaacacaatggttgactattcatcatattcaaataatttatataaatattatttattttattgtgatgtattttatcattacataaactttaaatatgatttatactatagcacatttatactaatattttaataagacaaatgatcaaactcttttttttaagttaaggatgtcatttatcaaaaaattgaagtataatgtcatcgcgtagtgacgcaactttcgtcttcttgtggcaggaaaaagggttaattagatccatgtcactgtaactttgctaaattaaaaaaataccattactatttatcatatctgctacgtgtcattaaaaatttctaaaatttaaaccataccactccagtcaccttttccatcctcttgcctcacgccgtctctattccgtcctcatcccctaatctccatgactatgcgctgctcagccgcctccgcagccccaccaggcgcgacttcaccgctaccgccggcaacgcgcggctccgacgcctccacggccacgcgagcctagtccgcgagcctagtgccggacccacgcgtccgcgcctgccgccctccccctcgcttccgcgcgcgcatctgacgactcctccgcgaaccccgccaggccgggccacgaccgcgccgccctgtcctccgcgactgcgccccgccaagcacgacgcagccaagccaagctggcattggccatgctgtgagcattggccatgccgtgcaggagcactgggccgagccaatccggccacgccaagccgcgggagcgcctcgccaactccggggcgtgggcagcagccaaacaaaaacaagaagaaaaattaaaaagaagcaaacaacatcgctgcgacggcaaacaaggaagagccataagaagaagaagaagaagaagaagaagaaaggaaagctgcgacggccatgcccacggaagccgcaacgacgacgccgagcttgcccaccgtgcaacgcccgaacctccgagcagctagccctttggtccgcgccagccgcatgctcggccacgccgtcgacagagcttccatcttgctccgttcctccacagagcttccctcgccgcgacgacgcacgcccgttgctccgcgatggccgcatgcccggccatgttctcagcagcacctccaccgcaccctcgtcctccgcagcgctgccctcgccgggacggctgcatgcccgttgctctgcacgcgtcgaggggtggaggccggccgcgcgcggaagcggcggagccggctgagcagcgcatagccgtcgagatggacgattagggggatgaggacgggaacaacacggcgtgaggcaggagaacggaaatggtagccggagtggcatggttttaattttataaatttttagtggtatgaagcaaatatgacgaatagtggtggtatttttttaatttagtaaaattgcagtggcatggatccaattaaccccaggaaaaaaaacctgagaaaaaaaaagagtggttattgtacttaatttctgctcgagcagagcttacgcttctgcggcatgttttcagtcacataagtcgatgaagaaaaatattaatctccataaaattcaatgttggttacttaactagctagtatatatgtaacaaaagaaaatcactcttgtcaatcaactttcattagtacgaaaatctcaacaccacttattagtagctagctagggtcgagtcattacacttggtaactagctatatgtaattccaattgcccttctgaatagggctaacaccgatctagcactgggaaatactacaatcacaaacattaacacagaagcactactcatgcaccctagacacattttccattttgggaaagtgtcatctaataaccaccatatatatgtcctacaacattttatgacatatatatatatgtttctttttctctctttaatatataataactaattaatttgccttcagttgggaggctaattaacaattaatgttggatagatggctgccggacatggcagttggatgatggatgtagatcatgtcatgacctgtacctccggccgccgcagccgccctccctctggcagttgaagtaggcggcggcgacgggggagccgaggctgtagcaggcggcgaagtccctggtgttgaagttggagcgccaccccggcgcgtagatggactgccgcactgtctgccggaacacgatgaacaccaaccggtggatccccgctgtcggccgcgggctctcgtacgccaccacctccgtccctaaatatatatgcacatccattaatttatattacctcccttttttaatatacccgttggctattttacaaacgtttgatcattcgtcatattcaaattttaatatacctcagatgctagtatctcgatcgaggtacctgaattcttaagatggccgtaatatttctctaagtttaagccttttgagctagttcgattttttatggttggatactattagtttactcacctttactcgtatcgcctccttctggtacgtcagttaccaacctatacaatcaacaacaattaattaactctcagcctaagaatatagtaataacttctataaataaagttagggtaaccacaatgtgatataaaactattcctaggtagtaagcaataaaataactttattgcccaccaacgagcattgtagaaactgacgaggtaggtgcacgtacaggtaatggtgactaggtaggtgcacctacaggtgcctagagattggtctttttttcacttatgggctctaccttatattcatctgttacattcacacattatgatatatgtacagctacggcccactaatttctggccgcctattttattaccaactttgacaattgctgttataaaaagaacttatacagtagaaaaaaataaattattttagaaatgtgccaccagtagtcaagtgagcggtttgagtgaaatgagtgcgcgactatggatgacgatatattcctaatatttttttgtgcttggcatgagaagaaaacataggtgactcgcagtatatatagatgaaatggagagaagatagctagctctatctagctactagaggatagcatacttaccaatgaaggtattcccttttggaagggttgctggggctaggtgcatcagggtccaccattacctaagtaacaaatcatggtgtaaaaattgttaataaatccatgctatgactttcttttcataattttaggagcgactttttagacttgtttttgatcaattaaatgacacgtaagaaaggaccatatatatatgcattgtagttgacagttgactagcaaaactttgtctccagatgaaggtttgaagatgtgtaccatctatttttagttaaaacaaagttgaaaactaacatcccctgcattaagaaaacattatagtagcatatatgtatatactccctccatccaaaagtttaagacattttccttttatcagcaaaactaagggagaaattaacttatctccatataattaaaaaaaaattatatgcatgactgtttggtttcgatcaacaatttaattattcacacatatggacggtacaaatttgtcatttggcatcttttgcaaaacaagagaaataaaatatgctctagacttttggacaaattaaggaagagagtgcatatatatatatgttcaaatttgacatgcccgaaaatgcagctagctgtatgtgtttgtgtaaacgactcacgagcgtgtagagcgccctcccatcgcggcctccggtgatctggacggccggctcgccggcgacctgcgacggcctgagctccgacccgctcgtcatctcgcggtggttgtagaacagcctcagcagcgccgacgcgccgaagtggtccaccacgtcgccgacgatgctccccaccaccagcgggtccctcgacatgctcatcgccgccgccgccgctagctctacactcaatgccaccggcgatcgacgaggaagctagagctagatatactcaagttgtagtagtgcaatgtgatatgatgttaattggtggggtttgcagtgagtgtgttgtgttggtggagagggtgatatgtactcctatttatacccaggccacactggctttcttggctcatcctatgttgattttccatggaataatggaatatttctacatagatatagagatagatatagttagccagctagctatctatctatctatcttatatggttcaaagatgcgaatgcatccaatcataatttcaaagatcctggtatgaaccagaaataaaccaagcgagagatcatcttgtgatatcatgggacttgataataatcacatttgtttaatttatttaaagagtcgatttatgatcggatcggatggacaatgtgttgccaacaaggagtcggtttccgatccaacggtttgggtttcgacgcggcgttggaatattaggatggatgatatatatgcgattcctgatgatccttgatgagttcttggggaatctactttttgtaaagatcatctcaatcctttaggcttggatagcggctattataataagctacttcaataagttgtctgtttctttcagcttactcccaataatctggattataataattccaaactgaaagaaatagggcctaacgcatgtgtgtgtaaccatgcactcataaccaggggtttgcaatttcgaaacaggagtttttgctggtgggggccgaaagaatcgaaatcaccgaaatttcagtatttttttggccgatatttttggaaatttgatgactcttgaatgaatttgaataaacttcgaccaaattcaaaaaaaaaaccaaaaatttcggacgagatatgtgcttgccggtgaggagcgaaattaccgaaattttgaaaattttcccgatttcattccaaaattgcaatcactgctcgtaactccacgtactactatatataccaaatgaaattccatcatatagaaaaacagttatttttgcaaggaaatagtgaaatttctatacatataatactttggttctgatcaaaatggcaagtttgcctgttttatattaagaactgaaaaactgacaattttaaccaacatatttaattagcatatagaaaaatttaatgaaacatcggtatatatatggttattttcatgcatagatgcatgcacccaattaacaaaaccgaggtgcagtgcacctgaagaaaaaggagaagagttaaaagtggtaagatctgatgtgcattaaggagaaaggattgtgtatagctagagcgcacatgcatagcagatgtctaacctggtgtgtgatggaaaattaacaacttcaacaaaagttaagatctgttgccatgatcgatcactaagacatatacatacatatatgccaagaggccctgcacatatgcagcagatagccaagactcttacaccatcctatactgtaaagtgttgtgctttccggccgcctctagaagatatgagaatttgtgctcgtgacaaatataatgttgagctaggtagccaaagcaaaccaggaataatgggctccaatgctgtgctttctcttcttttcttcaaaaggaaaactatgttatgcatcatatcttttgattccttggccctagctacttttattcttgatcagttgtaatatgtatgatctccactattttggtacaatttttttaatgacacaatgcaaaggtgtgcttagcgcgtgtcaaactcatatgtcctatgatgtgacagaaacattatcaatgttctttatcactacctccatttataaagacttcatttatggctatgaagctaaaaatgaagtatttttggatgacataatattagttacttgggaaattaaaagaatttttacaagataaattaaaatcttggaacttccatgcatggtaacaatacttcatttttagccctgttaccgagttatttaggcacacggtagacttccgttccctggtagtgcctgctgaaattgtaagtactgcagttttcttgaaaaaatatttgtagttattccaatgatctatattatatattggcgtagcacaaaaataatatattattgaacctaataaagttgtgcttgagcgaaaagaaattctctaaactttaatttacttatggcttgcgacaagatatattagttatttttatatgtagttagagtattgtcatgattattccgtaattaaataacacctagattatttgaatttcaactacatactgtgcttaacgtacgcaagttcttgtttattattttgagatttaatttccgctgcatattatatccgaagcaattttgaatttcaagctttgattttaggatcaattttaggggtgttatttttgtcactttgcccagctctcttttcgtcatgctaaaaacacaagtaaaaatctaccaacaatattgctagcattaaattaaactttaaaatttaaaacctttttagttcagagccacctctcgatgtggtggactggcaaggtgtacatgcttatcactactacctccatcccaaaaatatagtgacctagaattggatgtgacacaacctctatttaaatacattgtactgggatgtgtacgatgtgtctcatccagtcctagtttgcaatattttgggatgaagggagtagctagctagcagtcccattgtcttttaagctgttactaaaatttgaatttcaagacttaaattttgagttgattttggatttttaatcatagtttatttttcaccattcgcttttaaatttctaaggacacatatatatttttttaacattttttttgccgataagccattatagcttataatgagccatttccagttagttttagaaaaacagaagagctaggtttccagtcctattgtctactcacactgtgcaagctaggtagatgtagagtgtgaactttgcaggctgttgtagagttatcaaatctgttagtaatatgccttagagacaatcttagagataattgtatcacgtaccatgttttataaatttacaataaagtgttcctgataagttattattgatcaatgaatatgatttatacatgagattatctgtatatatatatgttacaatttctaaatgatccttatcaaatgtgaaacaaatatgattataagattcaactcatgtattaattgatgatcatgtttactagactatggtatggagatactaaatcgataatgtggacacgtgttggagaatatattgttggatagacccattgacacactgtcaggattattataatgtgatatcagttagtcttaattaattaggtgttggtgttgaatccttgcacctaatattatcatggttcctaattgtaatggcttacactgggactggtaaatgctattccataactgcttagttataaaggtagtcttccaatttgttattaagcatgtagtgggatgtaaataatcatgaagggatttttccatcccatataatgggagagatatcttctgagtatctcgatgtaatagattatgaaactgtatagccatttcgagatgcctgaagtgctggttaggatttgaataatctaatacaagatcgagtaattgagacgatggcacaaatctagctttgagcttgatcaataccataaggtaaaaggtgtcatacccatttacgcactaaaggttaagttgatatgatctttatgtttactcggtgggtcaattcgtttggctaagggttattgttgacatgtggactgaaaatggattttcaaattgcaaccgaaaatacatgaacctaaggggctgtgcacttaatgggttaaaacaagacaactggatatagaaataatagtgtcttaattcggatagaactcataatgggccttggggactgattaaaggtcctatatgttcaggagcgaggggccacataggtaagagacacacatgcatgtaaaccctagccaccactcttaatcacgggagtcaaaaccctagttgcgtgcaggtgctaccacatccacgcacgacgttcctccctagacgtgtggatacaagtagaggctttgctaattgatgttggaatgcgaggcggcaaacacgcaaggaggagacactcgcacaagaaggagatgatcgggttgctaagattgactacttcctcttcaccgacgcatgctacatatgattggtctgcaatgcctcttgttctgctgttcagctcatctagtagtaacaatccatgatatgttactcgcatggttcttggtttatatggtacaaaattttttttttacgttatcatagcatatactcgtaacctatatcatccttcttgtttgtatgatctggacattatctatatatgaagtacaaaaacacatgcatgagtacaagtacttgtggatactggtgtgtgagtgcgaatataagtgcctaccttatctatattaccaatataaaggtacaacctacaacatcataaagctcaacatgcaaagatgtcacatcattatccattagtaattattgcatcttaaacctcatgcaaaacatgttatatcttctatattttaaagctttcaaatacaagcatgttacaaagggtttcatggaaatattcttccttgccttgtggcacatctggaagcagagaaatgggctcatttttcataatattatgccttcatttcaatcctggagatcctttttatgaatgaagttcttctgtatatgtgcagaatgaaggagcctctaaagcaaatagtttttgattggttacaaactctgtattattttggtgatttccttaattataaccatgtacatattttttattatttaatgaaattacactactaggcaaagtcctggtagtattcacagtaaaaaaatattatcccatataatttacataatatttcaagatatatctcttcatcattttatatagttcatccccatttagttaatattttctatcttctatcattaaaccatatcattttaattgtttatagcctttagatgattaatctatagttcgaattatttttctcattttcttaacccatgaagccacattaccttacttttatttttcaattatcaatctatataatatttaaattatcataaaaccacatcaattcaatggtttatagacttttcaatgattgataaaaaatacaaattcacatctagctacgttacacactattttttattattatcatattaaactttcgtagcaacgcacagggtttcatgtagggattaagatgaacacggccggatagtatcttggctttactaataagccatgtcatcaagtcaataattgagcaaactaattaagtatcaacgcttatcttttggagaagactaaatattttctttagctacttatataagtatctattaatctagctcctttagaaactatatgtgcgtcgatcttcttttatgcggatcatgcattattgcaatagcaagattattttagtcagatatactgatacagaggaatgagaatatatagtgctatatatatttgccaaaaggagtgagaatatatatgagtgagaggtagatgccagcatgacgtatagtcgatttgtttttcaatctgtgtattcatgacgtctagaggatttgcatatatgtgccaatgcagttattatatacttaaagtgcattatttgcgtttgcatttagtaagaccaataattgaccaaaccaacacacgcagatatggcggcccattacgaacgtttctttttcatggaaagagagacgggcatttgcaaaacggatatgtcttcacttaggccactaaataactactacatctgtcccaaattataccaagttttaatcatatactccctccgtcccaaaatatttgacaccgttgacttttaaaacatgtttgaccattcatcttattaaaataattaagtaattattaattcttttcctatcatttgattcattgttaaatataatactaccacgcactcaagtttttgaataatattcataaaattttttaaatgagacgaacggtaaaatatatttaactaattcaacggcgtcaaatattcagggaaggatggagtaggacatactggtttgtttcaaaatacaacaattctaaagtcataaaacaaatgatattccatatacgtaacgagaagttattatattttgggtcagagtagtactaattgattaattaaacataacactaattaactacctattaacttaagaaaaaaaaagtctaaactactttcgaggagacctcttcatgggcatataaaaattagtctaaactaccttctcgcctctatgccattggccaaactggccacattgactgcctaataggctgatactccctctgtactataaaaattcaaattttgcggataaatttgagcatagtatacgtcgagaaacatccacgggatttgagtttttatgagacaggatgtacgtgtgttgtctgccttcgcctccatccaactggccctagtgatgatgtgatcattgagtataggcatataactacaataaggaatacaaaatgttcctaagatgcacaatatttatgttagatttatgagatatttaactatttgccacacttatacgagtgacaataaaggatttaccactgaacctatatgtaacagacacatgaggtccacatgttatagactgcgagtggtaaatccttaattgccacatcttaaaagtgataaatagttaaatgcccctagatttataggttgtgtattcgagataactatatatcataataattgagtcgtatttcttaggattatatagccatgtataggattgtatttctaatatattcctctaattgaagatcctttgtattaatacatgattaccccgacgccccctcccctatcccacattgggtgaaaggtgtttcccctaatgcattctacatgaacccagataataataatgtacttcttcatgatcaacagaaccctcatcttgacttaattatgcgcatattatgctacgtgaaaggcaccctcaatactggcctccacatcggcatcggtccattcaatccttgactgcgtactctaatacggattgggcttgttgccttgattcatggtgctatattttcgtatcatgtgtcttcctcagtgatgatctagtttattggtcttccaagcgcaagacgatggtctcccactctggtgctaagacggaatatcgtgcgatggctcatgctgctgctgatcagtgttctcgactgcgctagctcctatatgaacttcatgttccgttcacttttgcaccagttgtctattacaacaactttaatgttgtttgtataacagccaacctagtgcatcatcctcacatgaactacatcaggattgatctcctttgaataaaattgttcttgcaatgttctctcatttgaattacagagatcatcgaccacacgtcacaattagtatggtatcgtttgtggtgtaacgattcgatggtgtcctagacttgttttagttggaagcacttcatcaacatcgcaatcaaccaaagtaggattatttatcctctttatcagaagattgggccacaagtgacaggtaattagttgtcttatctcggtaaaaaaattagccgtcttatcccccgccatgtcggttgccaccaccgccacgctagctatcgtctctggttcagtccgtcgacttggcctccgccgtgctgaccaccaccttggccatgttggctgccacctcctccacattggccatcgacttagccaccaaccctgatatcagtcccctcgtatacatgcgctctgccaagctaatcgcctctgcctccatttcaactgccccagctctcgtatacactattgttgctgctatcgccctcatcctccttgaagccctgcttcggcggcatggcgttggagaggtcgtcgttagttccccatttttcagtaggtgtggtggtggtggtggcgtaggcgagaggaaatccccatccgtggacacctcttggtgccccaactcactgctagtgatgatgtactgatattttcatgggaatcaatggctatctgaaacagagaagagagaagtgcggcgagaacagccttaagatcccggatcgcataggaaaataagcctatttttgcatgcggctccttaagtggcccatccgcgaaaatattttttttcacgtgagtctattaaggagctgtatgtgaaaacagagatcgaattttataggagccaccagttaattacggctcttcctgacgaacttaatgcatactccctctgtttcaaaatgtttgacaccgttgactttttagcatatgcttgaccgttcgtcttattaaaaaaaattgtaaaatatgtaaaactatatgtgtatatgaaagtatatttaaccatgaatcaaatgatatgaaaagaataaataattacttaaattttttgaataagacgaatggtcaaacacatacttaaaatgtcaacggtgttaaatattttgaaacggagggagtactatttttcttttgggcggctagtgtaattaagaggagacagtgaaaaccgtcttttaactagtgttgatgaataaaaaagattaagagtggccttcaaaagtctttgatacatttagttatgctgttttatttaagggtgatcgatacgtagtgagaaaataaagtactagcggtgctgatttattcctttagtcccagattcacccttcgcataattagcaatatggatacataagatagcttttgaattgacacatttaccaagggtaattaaccacgtgcttcttatatagctggaggcaattcaccaagttaattacctacagctggagacaattaacgtcgtagtgagtagtgacccttgcataaattaataatcctaatatggatccagtgtggtgggttgcacttttttcttttgtatcaagtactaaatccgccctttcattttctctataaattgatgatacgtgcatgcaatataattaatggtgatataattgagtttgtgaatatgaaagttggccaagatattgatcgatttaagaaattgatgatttgggatttggtactttatgtatatgcccattacatatactgggttgacacaatttgagtcagagatcgtgataactggacacgtgatggcagtccgatatgtacgtcgtcgtacttgttatcaaagagagacaatgtgctaataacgaacaggctcaagagggtattggttgagttttgtttttttttttttggttaggagtacttaactgtgtatatgcccattacatatactgggttgacacaatttgagtctatgatataggaagaaattgtgtttgaaatatggcttttgttttatttgttcataccgctacttaaaaaatgattttatttctaacgccacacttcttaattcgttggtggatgaaagaaaaaacgctagtgaaaatacaagagattcctagttagtgaccacttgtgaaaaatacattttcgcaagcggtcgtcttaatatgtccatttgcaaaaataactctatttttatgtgtaatctcttaagtggcactaaataacaccgcccgtaaaaagatttggctctcaattcccacgcatacaccttcctcatccgcttcctcctcgtccttcctcatcctaccccatagccacacacttctctcctccaccttccacaccagtggtggcatccactagcggcgggcggagcttgggcgaggctcataggttgtgtcaaagatcgggcgaggcgcgcaaacggcggcgacttggtttggcggcggatggaccagtggcagagctcgagcgaggcacgcatggtgactcatgtgggcggcagtccggccactgtaactcgcgtggtgatgagaatactaggtcctgatcttccgataggtattgataactctcgatttggtggaaacttgacacacacgatctggcttccgatcaacacgatctgaaccctgcaatcgtagcatcacatctcctctggttatcacccgtgtactaccgggttgacctcgctgagaaggctaatccctgcatacgaatcgaagaacacaagcaagaataagatatattgcaacacaattgcatataaatgattaagcactccaatttggggttccataaaccgaactagcggcgaaactgcaatggcagaaataatctaagcaaaacccaactctaaactatgaaagctactgaacaaatatgatttgggacgtcctagggttgccctaggacacacaccgcattggacttagcccacgacacaattacatggcccaataccaaatcagattcggactagatgatgtatgtggcttgttttgtagattcccgacagctcggtgagatttttgatgtgagaccaacaccatctcaaagtatactccataaactttccaacaagtgcttatgggccccgagattccttatagatcagtggctaagtccgtttgaagttgatgctgtcaggaggtccgaatccgaatccaaaacgtgtagaacttttctcttgttttttgtggaccaaaaatgatgtggtgacgtaggagtggacttggagaaggtcttggtttggtctccaatcaactttttttatcatccatgcattccttacactcgttcgcttttccttcatccacacaactacctctgcaaatgagaagatataaaactcatggtgtaataatgtttgttcaaatatataataagtaaatttaacattgaacatatcactactaggaaaacaacttttcatggtgtttgggaaaattttttcctggcggctacgagatgaaaccgctagtgcaaaaaatagaggggatggggggtggggggtcatgggctgtgacaaaaacctatcttccctagcaaccgccttaagctggccgctagcgaagatatggtatttttactagcggccctcttaacttgacgctagtgaaaacaccaatcttcgttggccgagtgacgatgtcggcctctagcgaaaatgaacctattttcgctggtggtaggaacagtattttgcagtattaaaatcccacctacccggtgctgcccacagaaacactcgctattttctcctcctctctccctccgctcctctttctctcctccttctcctccgtctccccctccctccccacaggcggcggcggcggctcaggcggcggcgctcaggcgggcagagctgcgatgctgcacggtggcggcgacgacggcgatgcttgggcgggccggagagctgcgatgcgaggcgggcgcaaccacggtggacgtgcgatgggaggcgggcgtgcggcaacggcgacacgaggtgggcgcaaccacggcggaccagctatggcaacgacgatgaccttgggccgcgggtcctcagccaggaggggctcgggcgcgggcgcggcatatacggccgccgtagggccgtgtgcggcgaatccaaccgtgggaggggcgcgtgcggcggattgggccgtggtgacccagctctccctcccctccctctctcagatccggtggtgaccttgccttcccctccccttcaggcgacgtcagctccctccagcctcgaggcggcgacgatgatggtgacagggggcggatccggtggtgcgatggttggagaccggcgacgtcctccctcccctttcatccctcttctccctctccctgatctggccgtagggagacggtggtggcagcaacctccatggtcgccggcaatgatgtttgcatgttgaaaatgctatgtgacaaatcgatgatatttggatcccgtgaaaaattgatgtttgcatgttcatgtttggatgttgatgtgaatatggattagacttgaatctgatcttgatgtggatttgaaaattgaaaatgcagcgggtttctgaatgtttttgctggcggttagagggtatgtggcatgtggttaattttattttttttcctcaaaatcaattatcgctggcggccggcatagcacaactgctagcaaaatttgattatcgctagcggtcctcataaggctgcagccagcgaagataattttcgctggccggctgtcttaagccggctgccagcgaagatacgtctttgctggcggctgacttaagacggccgccaacgaagatatgtctttgctggcagtcgataaccgccagcgaatattttgatcttcactggcctttgctttgtggcggcgccaaatgccgccagcgaagacccaaaatagccaccccaaaagatggttttcgtagtagtgtatgcatttttggttgatgaatactatataagttagtcatggtcatagttgtgtcctcatcatgtgggtatcggatttggcggtggcaattcgcgtgtgtgatggatccagcgctgatgactcacatgggcagcaaggcgcaagtggtagatctggggacggcaaccaagatccatcgccgacttctcccttctccaccatgacggtgttgcatgaatgcactgacaaccgtgctccgacgagacgtgtatcgtctgcctctttcttctttatatttgttcttcctgttctcttgcggatccatgttgtttgatccgtggatttaggaccatggaaatagttaaggagctagtgttgctgggggagcaggttttctgtaattgtttttaaaaagtgaagtatggtttagtaataaagttatcataaaactataggcttaacatcaatttaatgacaatacttggacgtttagaaatcaaccataacattagtgttaagaatttaaactccaaaatatatagtttttttataattttattattaaatctatacttatgcgatacttagccttaaacctgtaattttgtgataaatttattgtttaatctgtggttttgtgatacatcgccttaaatttatagttgtgtgataatttggtcaaaatacatgtagttctgtgaaatgtgctgacgctcatggtgtatgtttatatatgaaaaatgatgcaaaattttgaaagattagataatgaattcccaccatttttttattattctgtgtgagagactgacatgtgggtcccacgagttttattattttcaggatcaaattgccacgtaaacgccacgtcaatgccacatcagatgaagactaagtcaaattagccacgtaggcgccacgtcagccaaaa

SEQ ID NO: 62217 - DNA, 3976 bp, Oryza sativa
tgtgtgtgtgtgtgtgtgtgtgtgtgtgtgtgtgtgtgtgtgtgtgtgtgtgtgtgtgtctgagatatgtatccaagccatgtaatctatatatattagccctccgaagcacgatacaatgtgtccaatatcttcaatacatctatctcttcttataatattcaacatggcatcagagtaggcgacctatgccagccactgcttaggcttccgccgtcatcgcccttgggatggttctgatctctcggaggcaaccacccgtttatgtttttctttgttgccgtcatgccttacctaggggattgatcgtgatctcctaggcatgccttgttcttcgtcatgttgtccacacaacagcaacatgccaacattgtacttcatcagcaccagcatcaatcgtcatcgatctagatgtggtagtcatcgttctcctcgccgatctgttgcagctggccttgaacaatcgtcaacaccccatgtagcaggttgtaacttgtaagtggatattacctagttgaactcaccagactatggcaaagtccttagacttagtagtgttgacagtggttaagtgcaaacttccaccgtcaacttctgcataaaagaatataaaatataatatcaaacttagtgatagtgtttttttactaaccttttccactagtcttggtaaatattagtatgcaggtgatttctgaaggaaaatacactcgccatgcgacaaaatgtatctccgaccaattatacacaagaacaaggattgccgggcccacatgtcagtcaaaatcgactgaattttagctaatccactactaaccggcatcagggcccaccagtcatagagtggagagcgtctgtggcaagaggcggtatgcctgttcgaccgaaccaaggctaacccccatgttcacctgctcgcacgtggtgaccccctattggttggtaatggtggttgtgggtgcaccgacctccacaaaccgtcatatggaggctataaaagaaggagctcaactcacttcgaaaacatacaactcaagggaagtacaactcactttcatattttaggcatcactttagtatgtggaattaggtagagagtgagaggaagctccggaaagagtgtcccaaaaatcggagttcacttcgggatgtttaggaggagtgtcgggtttgttgacattcttccactggagttaaggagaagcgccagagttgtcggtctttttctcttgcttgtacctcggcggatgcttccttcaataaagtaagtataccagatctccttatgatatttaatttatttgcttgaatcagatatattcccaccgttgtgggctcatcgcttagttgatttattaagtgctataatactaggactctggataaagaaggaagtttctaaatgaggctagagtagaaatcaataacttagacgtggtgtctaggttagcggttaccttcgtttgttgtatgctccacaataagtgaggtatgcgataggtggtgatagcctggttcgtcctttgtatccctccacgttcgggtacatcatagagccataggtcggactcagcttggcagactaggggagagcaggtgcccaaagcaatcaacagggttttacctttaactcaagtatagtaaattaacccataggtaacatctttaaccttagcctaccattagttgttgcccttagatagaattatgttcttacatatatacacacgttccccgtgattcgataaccttggaatactctgtggtgaagtactacagcgatatccatgcgcttgcggattaatcaatgaccgtatcaattaccaacaagcatttttggcgctattgccgggaaacggttgatgtgtcatctccgaacctgagtcatcctcgtatctcttcttcctttctattcttaccatggagcacctttctattcaaaacattactactccatggggcgagttctgtgagccacctttttcttcaagacctatccgttcatttggccatgaacttcatcctagctttttagccatggttcgtgaacaataacttctaaagacatgaaagcgaaatacctaccatcatctacatgagtttgagcaattgttctcgtgcctaaaaatagtggacatgacataagaaatcttaaagtggaaattgtttttcttctctattatagagaggatgaagcaatggtacgtccatactgtgagaaaactgcatggtgaatgggaggaattaaaagctagctctgccttgttttcttcccattaaccactgtagtctcttaatgtaagaaggttctcagctttcaaaagaataagaaggaatccattggtgcagtctgggctcgtttctccatgttaattcaagatggccctaacttgtctctacccgatcacgggttcttgtaacatttccacttgggcttagacaaggagtttgtcatgtatctcaatatttttgccggaggtttgtttgcacacaaaatgacgttagaagatagggaactcttggattgtatcatggagaacacctccttcgtttgttgtgaaactgtcctggaaatcgaggatacgcatgaggaacctccgatggccaaatcggagaatacaacctctacatcccatgattcgaccgttgaatcatcacccgaaccacgggaaccgaaggtagaaattcagccttcggaatttccattccagtttgagggtgatctttttgaagattatggaagcccctcaaactattcatgccaaaagagtgcaccggtcctgcgtagttctcccatgccactcaaggagattctgttcaaagagatgcaacaggaattaactaccatcatgagggatgagtggttaagggaggtggagctttcttctgaagtaattcggattaacaccccatccttaactattacatgtctcatgagagaggccatggtgcaaactctttataatccaactattggcgcaaacattatgtctacaatctttgcattaaattgcttaggggatgaaccattggcaccaatagaaaaaacactttcagatcctatctggtcctatcatcgaaggttatgggattctttgtagatgccaatccggcacaatgatgtcgaggctatcttggacttccatgttttagaagtctttgacttcgatcttctcatgggccatcccatagagaaacttcgcattgatgtgccgcatacaagagtcctcaacatcaaacttgggaaaatggtgttttccatcccgatgttacgattgaaaatttgttggacgtaacccattgccaattccgagtcaactgaggaattgttggccatctctcctttcgagtccaatgaatccctcgtcgaagatgatgacaatccatttattgaagaggatcggaggacaatcctggagagctgatcgagttacccaaagctgatccatcctcacgacctccggttgagctcaaaccacttcctttaggccttcgctatgccttcttgtatggtgctatggattcactcgtcatcataagcgtcaggctttcgatggcgagacctcaaaactcacagctgtgttagaaacgcatcgctctattctaggctactcacttcaagatcttaaggggattagtctggccctctatactcatcatattcctttagatcattcttgtgcgtcctcttgagagccacaacaaaacctaaataatgctgtgagagaggtcatgaaaaaagatgtcttaaaactcttacatgtaagatagtgagtgggtcaacccagtccaggttgttcctaaaaaggaaagtatgacagatgttgaaaactcaaaaaaacaagttatttccacaacataccgtcatggggtggagaatgtgcatagactatagatagttcaacaaggctaccaggaaggaccacttcccgctgccctttattgaagaaatactagagcggctagcgaatcactc

SEQ ID NO: 62218 - DNA, 45258 bp, Oryza sativa
cccccagggggagatgggccgggaggaaatcggcccatcgacccccgggggaggcaaaatagacttttgcggaggaattgatttggaaggattggattcggaattggacccgacgatagatcagggattgagatcttgagatgacacggacactagacaacaagcaaagaaacaaatttcgcaattagggtttttaagagataattttcccgctaggcgccacgacggaacgggcgctacacactagcacccgtccacaggtatgtcttaaaaaaggaagtaaattacaaggacgcctctaaaagatcgctacaagatatgagtcatgcccgtggtcatcacaaaaatgtctgaaaagatatatcattcgttatttggactcatgaattgaggctagctcacttgattgggtatggatatacacctaaaacacccaaatttaagccctcatcaagaagggtttttatggccttttcttttcctaatatatacaaagccaccgagtctcataagttttcatatgttatatgaatgattgagctaaagtggcgatgtaactttttaaggttgatcttaaattctctagcttgcgctaaggggccacaaccattctttcgtgtgacatgaaccctaagttgaattatggagttctaaaagatgagagagaataattagaggtagaaaatagaggcaacagtatgaaataaaaaaatagctgttaaaaaggaaaaaggctatatataccaaacggttacagtgcaagctcataaagagtcttcaataagaaacttctaaaaataagaattttcgcacttcaatacttaccttttcttttctggcgggccatttaatacatactatatttgttgctttgttcagtagcggacaaaatgtgcacagctatctactccttcaccaaaagtcttatgcatatttggttttctggtctttctaaatgagatgggtatattggtagcctctatgcacccaagacttcttatctgtggtgctagattgaatcgttgatcagaacttgagcatccatcttaatacttactggttacatacatgtgtatagttccttaatttttgttgtacgcgggatgagttgattgcttcttttttttggtgataaaagaaaatacgtccgagacatttggatggaaggagaaatgctggcttttcccgacaaacagtttcaatctctcaacatggattttaattatgggtacccgaaaaaacaattggaatatatatctcagctcagttatacacctggccaggcaaacaattgataatgcaacaccgaactaatttaagaacacgtatagaccccccgcccctcctcttttccatccgtcttcctcacagcacgcgtggcagtgaatatacacgtacaatctttttacgtgttcgtgaaaaacacccatctacactaacaagctaaccgccttttgtttttttcttcagtgaatgcagatgccggggaccttccagcgcacgggcccctggcggcgctgctcgtcgggcatccgccggtacgcgcgccactcctcgagaaggttgcggaggtcgtgcagcttggcgccgaggccgacgcagcagttggcgtgcatggtgtagagcgtggcgaagtcgcgcgtgttgctgcagaacccggcgacgtgcgccgtgtccaggaactggatccgcacgccgcgccgctccaccagctcccgcttgatctcgttcagcacctgctgctcgtgcctccccgggtacgacgcccgcgcggcgcgccacgcctccatcacccccaccgcgcggcggctcgaccgcacgtacaggaaccccgtgttggggaagttggccgggttgtaggcgccgccgacgaagaagtccgacgaggtcaccatgtgcgccgccatcgacatctgctcgaacgggtcacggaaccacaggatgtccacgtcctgcgtgtatattgcgatatttgcatatttaaggggtgcgttatcgataaattacccaatgtttaaccattatatatttagtgagttgaattaaaaaggcactatttgaaatacatactactacaaattagtactttaaatttcaaagaaatttttgcaacgtttagaagcttagtaattaagcacgtatatggtgataattcgtaatattacataatctattactccatctgttccaaaatgttacaatctaatatgagtctttcagtacaatgaatctagatagatgttctatctagattcattgtccgttgtaatattttggcgtggagggagtatgcatctagaatatgctttagaaggatgcttttagaaaatgtgcttatgtacgtggaggacctttttgtgaaatgaaattagtagtacgaatttttgttttgtccttttgtgaatttataagatgtagtagtactgttccaactgctacgtagcgtgttgtaacgtaccgtgaagaggaagttgtatccgagctcgaggatccgctgctgcagcttgaccttgctccagaccaggtcaaggtagtcctcgctcatgaacaccttctcgtcggtgaagttgcggccggcgacggcgaggcggtagcagtgcgggtgcacgtcccggcaccgccggaaggcgccgtcgtcgagcgccacgatgaggaggtggtcgacgaagcgcgcgatcccctcgccggcgcggaacccctccaggaacaggtccagcagcgaccccggcgccgcccacgcctcgttcaccgacgtcatgatgatgttcttgtgctcgtcggccaccgccgccagcagcttctccagctccttctcctcctcctccttcgccgcctccgccgccgccgcctgcacggtcaaaattttcaagtcaacttttgccaagccaagaaaatttcagacaaattaaacacacagaaaactacagttttgtatactaatctgaattccagacctggctgttcgtcaggttagccttctcctcgacatgagcagcggtgctcgtcaggttggtctccttggccgtcgccgctacagtcccattcgcccagctcgacaagtccgtcgtcgtcgaccagccgccgccggccgacgagaagaagaagatcaacacggccgccgccgaaaccccgaggagaaacgacaccagctggttgagcgcgctctgctggccacccatcatcattggctggccactgccaagaaacggagcaaattaaaggattcaaggagaagagggagaagaagcgtgcgagggaaactgctcggcgtgttacttaacacttcggttttttggacgttgatctcttcaaaataagtcgccagtagccaatgagaccaattctacttggtcacacgttgctagagcattggtgcatgatatgaccgcagtttctcctctccctctcggcatgtgcgtctctagctacttctcttgtacaaagtcaatccctcttggggtttttgatatggaaatgggaatgtgctcttcagaagcagggttgcatgcatttgtaaactgttggggccatgtgtatatcagagaatcttcttattgtgtgcttattgtacacagtttacatggtcagcattgataattttcttcagattctctgactgtaaacatgttctgtgcaagtacattccttcttatggtaatcatctgtgtatgattctctgattttttttccattttttttcacagatggacacatcaatgatcaattgtcctgtacaagtatacagtgtggccgatgcaactgtttttttgaatgcttaacaggagaaaacttgttgtcatgacagtacatggctacatgccatcgttgaaccattgccagttgctttcgccaacaactctcaaaatgatatcacgtgggccttgctcatgaaagcgcacaaaatatttcaaaataattcgtcttccaatgggcgagatggatccagtatttttccaaattgattttcaattcagatgacaatcatagctgccacctgtccatgttttgacgaagttagtagattacttgtcccgtccgtaatccacaagtgttttttcccctcataggtcagtaatctgacagggaagtgagacaagtgccagtagaaaaaaagaaaagcaagaaaacgaaatgccactccacagttatattgaggtgactactcaaaactcaaaatggaaattttggccttgattcatcaaacgctctgaatggagaaaagagccatgaacttttgaacaacaaaacagaggtgcccaactaaggccctggcccgtcaaaaactttcctgaaactcgagcagtttaggcccaacacgtgctcatcacggcccagtataagattttgcatcagctgggctatcttggcccagaaccatgagacgaagtacagtagtgcaacattagcgcgttgagcacagtcattccaactccaaacggggttgccgccgtgacggacgtcgccgtcacgctgtttccgaggccactaatctccaaattatcgttgtcgcctccctcaatgcaggtgggccagcccagctgtccacgtcagccatggcccttctggtggggccacgccaagtcaatggtttcactggtccgcggggactgagacgaactcgactccaaagcggacggctcagatcgtcaccgctcatgatcggacggtcaggatttcgcctttcgacgcaaatagtcaaatccccgcgcggcacgagtaagaaagtcgtcgtcgccggacgggttgcctacgagaccccgttttacccgatccaaactacagttttattattgctcaagctatttttacagcacatatccgattatttcctacatccttgaaatcaaatgcggttgatatgataaagatgaattataatgcactaaacgagaaaacttctttacacatgattaattaattattgactattataaaatttaaaaataactttatttatttatttaaacaacatctatcacaccatttaacggtttgatgaaaataagaaatttaaaatttagagtcaagaaaaagaattgggcctagtcctaacggaataaaccaatgaacttttactactgatgatgaatttacagtgacttcttgtcgatcaagaaagaaagaaagaaacactctggtataaaacagtagaggcacaatcgggcatcgattctgttgttttcatgcccgaaaagaaagaaagaaagaagcatcaagcagcacgttcttcttgttccctaggccaagaaggttgggggggggggggggggggttataaaggtcaattcctcctctctctcccacctctgaatcctcctctccttcccctcgacacctcccgattcaaatcgatacccaaaaaaaaaaaaaaattcacgcgagagctctcgatctagggatccctcgtgttgccgcagagtcgccgcctccgccgcacaaaaccctaggtctagcggcggagccccctcctccaccccttcgctcccatggaggacggcatctactcgtcctccgcgccgccgtcgacggcgacggcggccgcggcggcggcggcggtggggtcgtcggtgatcccgatcgtgaacaagctgcaggacatcttctcgcagctggggagcagctccacgatcgacctgccgcaggtcgccgtcgtggggagccagagcagcggcaagtccagcgtcctcgaggcgctcgtcggccgcgacttcctgccccggggctccgacatatgcacgcggcgacccctcgtgctgcagctcgtgcaccagccccgccgccccgccgacgccgaggcggatgagtggggcgagttcctccacctccccggccgccgcttctatgacttccgcgaaatccgccgcgagatccaggttcccctcccccctcgcattctctatcttctatcgatgttgatttaggcgttctgatggttgattaactgatagaggtactagtttggaaccttcgcttgtgctcttagcgtattctactgctcgagagttcactggtaatgttgtgttatgactgcttgctagggtttcgaatagtttgtggtgatttggatgaataattagtattgtactgctcgtgagtctactggtaatgtactaatgttgttgtgtaatggcagcttgctagggattcgagtagttctaccaggtttggatggatcattagtaatttgttcggttttatgatgtatgtgatgccggttaggctctataggtttagtgcaattgggtacattctaacactaccaggttggattgggggataacccttttgggttatattccatcttcagatttaggggtggcgatattttctcatagttgcttttatggtgacttgtgctgatgtccatttgtgtttcttcaaaggtgtgggtgtattgccttatctaaaatctctttgatttgttcattgcctttgagatgtttgtactttcagcctttggtatattgtcagtagtttaaacttagtgatttgcttgaatgtggagattgtatatgcctgtgtatttggtgacgcttatcctattctgattaattaccattgcttttatttgtccggaatgaactggtcgctgagtttagtggttatgtaaaatctgttattggagaagtgtgcacaatagtacctttgatttaatttttttttcagtatatgctagaaaaattgtaccatttgttgtgttatgcttttattgattcagttatgctggtttgtttagttatgccaatgcctgcaagtgttgaacaaactgtaccatagggcatagagcactattaatcattcccccaatcaatgcaggccgaaacagacagagaggcgggtggtaacaaaggtgtgtcagataagcagatacgactgaagatctactcaccaaatgttctaaacattacgttggttgacttgcctgggataactaaggtgccagttggtgaccaaccaactgacattgaggccagaataaggaccatgatattgtcgtatatcaagcacaagacatgtatcatcttggctgtttcgccagcaaatgcagacttatcgaattctgatgctcttcaaattgctcgaaatgctgaccctgatggtattcactacagactcaatccattagataattcatgttaatatattttgtttcttattaataattgattcattgttcttgtaggttctcgaacaattggtgttataacaaaggtttgaccctggtcttgagttttttgtctggattaaataagcattgtgttcataccagtgacccagtttgatcttggcttcacttctattatcttccagctggacataatggacaggggcacagatgctcgtaactttctgttgggaaatgtgattccattacgactaggctatgttggtgtggtaaaccgcagtcaacaggtactgcattctggtcattctcatgacttcgtgagcgaactcattctgtatgtctgtatgataaccatagcttccagatggtgtagttgtctagcatcagcctgctgattgttcataaaataatgggtaacaaatagagatgtgtatactaccttgtgattacaaacttgtcctagtagtttgtagcataccaaggatgtaatcctccataacctggacaaatgcttttccattgtagtgctaagtttagtgttattagatttctattatatagttttctcggcgatgcaggatatcaaatcagatctcagtatcaaggaagctctggcgcgcgaagaaagtttcttccgtaatcatccagtaggctgcaatgaattttgttattactttagtgcttattttcttcttacatgtttgtgaaatgcactttccttgactttttaggcgtataatggtcttgctcagtactgtggtataccacaattagcaaagaagttaaaccaggtatttatgtaattaaattatcagttgtaatcaatctgataactttcatatttctgttgtgatttaaacgaaaatacatctgtatgtttcagattttggtccagcatataaagactgttctgccaggattgaagtcacgtataagttctcaattgacaactactgctaaggagctttccttttatggtgatccagtcgagtccaaggtggggtttgaattaaaaaagaaattttgtccaagtgttagaagcataaaatttgtttgaaatgtttttcaacaatattacctgactttttttatttagggcttaatgaaatcaggccaattcatctgtgttctcagctaattttttgtcctctttgttgatggtccatctgtgtttctttactgcaggctggtcaaggtgctaagcttttgaacattctggcaaagtactgtgaaggtaatttttgaatcatgactaactgtgctggcaatttttaaataatggtcaattgtgccatttaatactgtgtatgattaaaagtcctgtgttattttttgtataagtcttatcatatactacctctgtttcatattataagtcgttttgactttttttctagtcaaactcttttaagtttgaccaagtttataaaaatatatagcaatatttccaacacaaaacaaacatattatcaaaatatattgaatgctacatttaatgaaactaatttggtgttatcaatgttgctattgttttatgaacttggtcaaacctaaagaaatttgactaagaaaaaaaagccaaagcgacttataatatgaaacggagggagtgtgtctattcttttgtttaagctgtatgtgataaattgtgccattttaagttgaaacatttttatgttatagctttctcctcaatggtggagggaaaaaatgaggacatatcaacaattgagctttgtggtggagcaaggatccattatatttttcaatctatatatgtaaaaagcttagaggttcgtgattttgttgcatgttcaattacaaccttttcattatgttgtaccacatcattgttctataatgaagttatagaactttttacacaggatgttgacccttgtgaagatgttaccgatgaagacatccgtatggctatacagaacgcaactggtcctaggagtgctttgttcgtacctgaggtataccatcccactttaggaagaacgattgtaagagtaattcatggatgatggccagttaagctgacaatttttccttcgctaacatttctcaggtaccttttgaggtccttgtacgcaggcagatcagcagattgcttgatccaagccttcagtgtgcaggtttcatatacgatgagctagtcaaggttagacctgacacctttttttgccacttgtctggcattgccgtatgctaatgcctagtatatctttgtggatatgctttttcttaatatgccacttgcacttttgatgcatctatctggttcacctcacagcatcaactaacattctgatgtattgttgctctgttacttcttgaactgacaatttaagtttttgtgtagatgagccatcgctgtcttgctgttgagctgcagcagtttcctctgctccgtaggagcatggatgaagtcatcgggaggtttttacgggatgggcttaagcctgcgcaggatatgatagcacatatcattgagatggaggtaataattcctcatcatgttggatattaatggttaacaaatttcctggtagccattggagtttagaaatatgccactagcaatatttgaatatagtcttccataaatagtgctgattactgacccccagacccacaatttatgaagtatgtagaaaccaagctatttcatctaagctagtgtttgggccattgatagctgatgttttttttcccctgatttactcttgactttgcatagatatgctataatctttttcattgtcataacctgcaactctattttggttcaggcggattacataaacacatctcatccaaatttcatcggcggcagcaaggctgttgagcaagcacagcagcaagttaggtcttctagactggcagctgtggctagaagagtatgtatacatcatatgcaccattaccttttccttttcgttctgattttctaaaaacaatttaataacaatatggtagaatcactgccaagtacattgtgtttgtggcaattgcatattgtcaaacaagaacaatatttaatgaatgatgtacagatgaactatcttttcataagtgacatgtgcttctacttaattgcatgaggattgccacaatttgaggaccattggaactaagagctacgtgagcagtacatgtaattctataataaatgtttagcagctaaaaatagtacctctccatgacttttaacatatttcatgataaccgctggtatgcccataccataatggatatccatttgtttgtattcaaccattcttttttcatttagtaagaggcatggctaaataaactcatggtgtacaccatgttaggacttgtgctatacttgctgcacactactttggtaatttggataatctttacagatactttaattctgtaatttgcattatcattttttttgcacatttagatatttgttctcttggaaaataggtggtgtgacttaggaattcatatccttcacctgcaatttccgctcttgattcctcatattatcaactatcttaagtatctaacgtactatactgcaggagggagtagatgctgataagtcacaagcttctgataaaactcaaaagccgcgtgcgcttttgggtagaactggtgtaaatggagtagtcacagatcatctccaggtttttgtcattaccattttttttacccttgcaatgtctataattgttaggcacttacacctggcatttcttcttttgattttgtcatccactatcagggtttacggcctgctgctgaggctgagaggccaggatcttcaggtttgaattttgctacaaatgtcatatcttaagtctgttgtgctaacatatgtgaatgctaatagtatacccttctctagtgttgctcttactgctttgattctttctttttggggggaaactataaagcgatttgatgtaagcccagtttattggccatcttttaggtagtggaagcacatctttctggggatcaatatcaatattttcttctactagtgatgatcgtacacattcttctgcaaaagacaactcatcgaacaaatcttatacagcttctacttcccacctggagcattcactctctacgatacagttgagagaggtgagctatcttatcaatgccttaatattttctcatcagtgttatttgaatttgttgagtgattgattgaggtaattgtcaaacagccaccagttgtcttgaaaccttcagaaagccagtctgagcaggaggcgcttgaaatagcaataactaagttgctactgaagtcatattacaatatagtgcggaaaaatgttgaggacttcgttccaaaggcaatcatgcattttctggtccgtgatcgttgtctcacttttctcattattactcgctttgcataggatggtgatttatttggcacattatttcgattataactaatgtttctggacatgtaacatgactttctatgtactatttttagtgtcatggtaagcatagatgacagtaaacaaatattaagacataacattttttggggcaatgtatcctgtgcacacaagctttccatgtacacaccgtgcacatcaactaacaaatttcaccaaaaaatctagaaaacattgtacatgtacttccaatagcattacagttttaagggtataaatcagtcagaattttgtcttttttggtgctccacatatatataatgaatttgaagatgagactttacacttaaatgtgatactactaaaagtacatgtacaattttttctagaatttttggtgaagattgttagttggtgtgtacacgagaaggcttgtgtgcctaggacactttctcaatttttttaccacaattgtcaagcattgcttcttaaaaagcaagtgcaagtggatcactaatttactattagtgtggttgtgtgttttgcttgagtattgattatatttcctcctttttgcgtagcatttttatgttgatgcgactcgttgattttcattgcattggatggatcactaattataaatggttccttattcttttctggccacattagtatattcaaataaatatgcctatatcttctccagttatgattcagtttcatgcatatttctagtggcagggaagctgaccagaaatcctaattatccatgtctgtaaatttcctcttggggttgctgttgcatgttctttaaggatttgtttcgcttgcaggttaaccacacaaaacgggagctgcataattaccttataactaagctttataggtgagggaagccttttctactcatatacattataatgtttcaaacgctggatgtttccctataaatccgttataacatttcaaacgctggatgtttttgtatgtatcgttgcagagacgacctctttgcggacatgctcagagaacccgatgaaataaccataaagaggaggcaaatacgtgacaccctcaaggtccttcagcaagcatacaaggtatgttttgtcagaactaagttttccattttaatagcatttcatactgattgatctaacattaaattatttattggccttgtgacatgcttcagactttggatgagataccacttgaagcggacacagttgagagaggctattccctggatgccgatgcaacaggtctaccaagggctcatgggctttcttcatccttccaagatggaagctcgccatattcgaccccaaagcaaccaaggtcaaggaaatctagccactcaggggagcagctgccattcaatcccgatgcaagcggtaacggattttgatctcgccattcacgaccgtcacccgaacgaaccagtggttgaaccaggcgatgtaccgtggttgcacgcattctgcattcagtttgtttgcaccagatagatgtatgcttttctagttctactactattcttttcactcagtgttgcgccccaatgaagccatgacatggagcgagttttgcccgtttgccccctttgtacagtatatttcgctgcccaatcgtttcatcataaaatgatatatcagtgatgggtatagttttagtttaagcccagggaagagtctatggttgctcggtgttagtatcgagcgtccgaatgcctgtatcctaaaagacggttttgccttgcaaaatctgacaaggttggttggtaaggatacgcaaaacaaatttgtgttgcataaagttggtggtctgtaccagtataagtttggtgatttcagtcgatcactggtgatttgcaaagagaagctctgttcatttatttgttcttttaccatgcaatatcctggaaagttaaaaatgctatttttctttggttgatcatgaaaaatgctatttttctttggttaattatgaggggtttcctcgtactgtggcaatccctcgcgatagtttcacaatgcaataacccgatcataagatgaatacatgtatgtacagtaatctctatatttctgaacaaactagcagaacagctcatattcaatcgagtggtatcgctacgctgcttggagtgtgcatattgagcgcctcactggaatgccccttgtttacacaaagggagtgttcatcttgagctcctcctagcatatgccccctgtttacacaaagttttgagtgctagcaacatcactaataccaatttataggcattttaaggccctaaacaacatgcattaacttcctcatgggtcatgagtataaagatagggtacctgcaaactatcgccttttggtctagttttcatccttcaactttaaaactggacaacttacatccatcaactaccacaactttaaaactccagtttacatcctcactccagtttaaaggtcgttttatcctacttagcatatatgtggcgctgacatgacaatctaattaacaaaatattattttttttcaaaaaaaacactagcctctaaccatgtactacacgggctatttttacgattatattaagattattttttaatcatatgattaatatatggttattttttcaattaaacaaattgctcatatcatttgcatctttttaattatgtatttccaaattcaaaattaaatcaacaaaatactaagttgttcatggtataaatttaggaagaagggagtatgaggctgatataagagatgcattttttaaaagaaaaatgatgacgggagtactggacagatgtgtcacccccatgtcagacaaaaccgccttcaaacagggacaagggtgtacagtagtactagaaggtattaatagttgaagaatgcattttgtccggtttcaaagatggaggatgaaaactagaccaatgttcagggatgtttgtaggcatgttgcatgttttggtgaattttcattcgtcctgtcaactaacaacattaattgggaggtttgcaaccttagagatatgaaccttggaccttttctcttctatactatagaagcacagaatggaaggtccagatactgagacaaactaaaccagataattgggcaagttctttgaattacatgaatcttccgggtattaaattgatgcctggttggagggtgttaaattcttcaggacccacgttaattacacaggtaaacgtataccagatcttgtcacttccagccttccagatctagcaaaattgtttctgtaaggttagcttttcgggtgtctacttggctttcttcttcttagctttcttctttttcttttgaactgcttccgattctcgtttgaagattgccagcacttcgatgctgcgtcagtaattccattcaatcaatgtgatcaagggcatatcaagcagataacacaaatcactcatcttgataagtaatgtactaaaaccaagagtggatcaaatggggccaaacaaaaggggcggcatacataaagttctttacgcaagtcattgaatcaagatagcttagggcaggttagttaatagcttatggcaagctaattattttgatcatttaaaccaacttgatgatcagacacagaatgcaaatgagaaatcacaccaattatgtcttgattgctgaaaagaatgtatagtaatgtttcatttcccctatctgagtatcagagtatgccaaacttgaaaataaattcatgtctataataatccaaggtaggtggcgtcagggaagagttttatgttcctgcgatgccctacaactttatactatccatggtaaccctaaacagactttcacaagatcaatcctcacaatatgctagtgcaacggaataaattcaagtttagagcccagaatacctatcagtgccagggaagaaattaaaagcatgagcattctgcaaatgccaagccttactggacatcaagcttttgcagtcctgttgaagaaatggttataaacgacataataatcgcaccaggatagccagcagccaaggtacatattttggagagagctcataattcaggttcggcgaactagctgagtgcgtgatatatatgtactacctccgtcccaaaatataacaacttttggccatttatctggacaaaaatatgtccagatacatagccaaaagttataatttgggatggagggagtaacttttaccttcttaaaactgtcccatccgcagctaatgtatataagagtttctggccacgtttcactacttccttccaatggtgtactatcaacctgaacagctgcctctcttgctcttaggatccatggcctcttctcatctttgacctttgtaagtgtactgtgtccatgtaccaaatatcactatcaataaatttaccataacggacacgaaattctcaaattaagaagactcagatggatcatataataaaagcatgagagcacagaactgggaatgatatttccaactatctctaccttttcgccttatatgccttgcgttcggacaaagcaactttctgtaaagcacagataacagaggggtgcaatcctttcctgggtggatccacaataacaacacttgacccttcgagccaatgaacaggttcctggtatgatgatgaaggttccaaatgaatcctcataatatgagatgtaaccatagtagaaaatacaagtttagttacatacaactgaagcatcagtgttgtgccaagttatggtacaacccaggtttgggggaagtcggcttgctgatttttcaaaagacatttttgacaatttgttaatctcaacacatttcacagacctggaagtaaaaaaaaaatcatgaaatacctgaataaaagaagcatggcacctagaaggctatgctaaaagtaaacatggacacgcacaacccagaaatacctgaataagagaagcatggcacctagaaggctatgctaaaagtaaacatggacacgcacaacccagactgacccaaaaatatttttcaaggcttgagacaactgggctactgaaccaggcccacatgttctaataaatatcttagaatttttttaaaataaatatttctagtgaaaacacatttgtttgaatttcccaggctgagtttggagcttgttttggttgagacagaccaggcacgtaaacctagcattttcaggtcaccccaatataaggtttggtcaggtcaagcagaaacaacacaatatcataaggcaaaatttgctccagaatactctagatttgtaatgaagtgtaaaccatattataataaatccaccgtacctcccttgataccagtactattctactgcatctgacttagtatcctacaaacaagataagttccgcaatccgagctgatgcctccaacagatactaacaaatataatgaacatgaagcaaactcccaactcttgtttgtgaatcaagcaaagcatttaggttatgattttttttcaacatatgaagtataaaccaaatgaggctgttgctctttggtagcctaattgtcaagtaatgaagctatttgacaagccccaaaatgaaatacagggataaactcacctacatttcttcgaagcagcaagagataatccaataacaccagcaccagaatacaggtcaacaactgttgacccacgtggtacatatttgtgcaacgtatgcagtaacgcattaaaagactgaaagacattgcaaagaggtcacagcatttgtaagacattgatggtatggaatttagtataaactaacatagcctgtgaaacttctccgactatatctaaagattcatgcagcaaaaggatatatggagtatgcttgtatacaattgatcactatgtcctagaaagttgaattgtctagaattttggttttatctagtcctttgcatagttaagttctacatgaatcagcgataacttcaatcacacgtaccaaagtattagcctgcccaaagctataaggatccagagaaatatcaactccaccataacgctcccataagtcgttctccccaatgagatgtctccatttatgcccaaaaattatctgcagatgtaagaacatttttcttgaataaaataaatcatatatcctgaaggtaatgttcaattatgtctcttttaacttgtaagccaacagttatagcgtaagaaaagaaaggtgaacatggagaaagccttggatatttttttaaaattctagtccactagaatttttccctggtgtgttgcacaaatgctgacattagcatagtagcttttatatgggggcaggaatacagacatacagttttgcatatgtgcatcctcttgacaacgtggctaccaccagctaatcagagggagctgattgtacatacttgatgaatgtacaagtaagcttattatataagtgccactgttttcatccatatataatggatatgttgagatgttaaaccagtagatctgagcctctaaaagtgaattgtacaatgtccaacttcagataaaacatcaactttttcaagtatccatcatgaaaatggtaaacacagtatgtgcatagccaacaaatgtacaataagttcagttgtatacactaaaatgcaagggtgtatcttacattgctggttgatgtctgaaaattagcccatatagagtgaatcagatgaacattacttcttggtcccccatttctccataagaactgtcgcaaggagcacagagattgaggataaaatgggaaaaagaggagttgaagtactgatagaaaacgtccaaggaaacgcgaaagcaaaatagcagctacatgtgctgtagctgcagaacctcaatttcatcaacttacttctgacaacaagctcaacttctctgcatttttggatcgctcatcccttgaattccaaaccaacgaaacttgaactcttcctggttaagcaaatagcgcatttaaattaatttggaattagtattagacaagaaaagaaacttagagcattcagcgcatgaggaatcaggctaaccttgctcatatcttttagcaactggaatagatgtgttatacgttgtcacagccatctagagaatatgtaaaataaatcaaatgaccaggatcactaacataatgacatgggagtttttgaagaaaaagaatatgattgataaggtgacgtttttagccagaaaaagatgcataagctgtcattcatatagtaatatgtattatgtgcatgctattaagaaacagtttacctgcacatatctcagttcgccggtactcgcatcctcatcaaatggctcaatattcaactcagatatagctaaaagaacatagttactatatattaggtttctttggcaatggaaaggatatttttttttgcatatcccaatgaagcaacaaacaagtaattgtaggaacatgccttgtcttagaagcttgacagtagcattgatgcttgggtgatgagctgaagaaaatgtaaaacaaaaaggattcataaactgtcatgaaaaaataaagcatatcacaatgaagctcaaccagatcattgcagcttcctttgtaagtagttctcttaatttcataggtcatgataactttcttttttgaacgaactggcacaggatgtgccaagttcattgaatataggaggtatgtcgtggtaactaacctctgcactctggaatatctgcaacagcgtgtgtcccttcctgatataggccaatcaacgggttctctggtgttccacgtatagctagctttgcacggcaccgccactccctctaaaagcaccattctcatgtttagtggagaagcaaagccatcataattcttagataacctaaaacatttactgagagatccatacggcaatgtggcttagtacaggatttgcatgccttcagacgtcacagctctaagaagtaacgcatcacatggcatagccacataggccatcaaacaaacatataatcaggttgattgggcatctattagatctctgttactacaattttgcattaaaaaataaacataattagctatacaaaaaacaccgatgctactttcaactaaccatgatctatccctgcacaattgaataagaaattcagctagctagctcgctacatttggatgataaaattttctggtggacgcattgctttgatgtcctcaaaacaccagcatcagtttgccaaacatattcccaaatgaacaaaaccatgcacgactacatatatatccaaaatagctaagctaattaccgaaccgaacctgagatatcgtgagttcatgaccctttaaactaatctcggcaccaggtaagtaaattagacaaccaaacagcacggattgcatacattgggcacggccaaaattgtttagaagctacacgtaccagcctgcctctgctgaaggtgaaatctccaactccgtgacccttgaagaaattctccacctcctgcagcaccggcggcttgtccagatccacctcgtgcgtgcaacccgaacacctgcagagatcgcgcatcagaaaaaaaaaatcaaaaaaatcacttcgccgtctctcacacacgcgcacacgcattcgaggagagagagccgtacgagttgaagtggacgcattcgaggcacgtggaggtggagggggacaaggtgggggtgatgatgggaggcagcgtcgcggtggccgtggttgtgctcggcgcgacgacgacgacgggctcgagccgaggcggtggcggcgggggaggagcgggagggggtggagggcgaacgcgagtgcgaggaggagggcgcgtccgggtcggggcggccaggcgcgcggcggacggcgccggccaggggagcagccccgccggtggaggcattcgccggcggcgaggaaggaggtggatgaggaggcgggaagagggaaatgaaggggataaggcggtgaggaggagagagatttttttcccgctttttgtcggaatataggtcttgttctttttctccaataaaagttgtttggatacatgtggcatattttttaagctgctaaatggtgtgtttcgtgtgaaaactttttacatgaaagttgttataaaatataaggttaatacatttttcaagtttgtaataattaaaactcaattaatcacaagttattaccatctcatttggtgtgaaatacttaatttttatcttcatcttcatctttatcttcagaatattctaacaccaccatatatgtgactgatgaagtctcagtgatgatgacgaggatttttcttttcctccgaaatatggcagtttttgaaatgttttgtttgcaagcgaaaatgcacaagtgagcttcttgttacgggtgtaaactcaattgttttgacttggacaaaaatgggtctcaatccaaatataccgtgtgcactactgaaactggaagtaacaaaaatgggtctcaatagtaattgatctgacaaacagtggcatcaaacaacttgtaaagccgctcaaaaaataaaagttatgcaattccttgccattgccaacatagacggaagttagtttttctatgtctctggattggtgttttacatagttgtcttatttttaatcatattatggtttttttagtttatagtattttatcatgcaaggctgcaacccctgtaatagttgtggctattattaaaaaactagcatcaaaacaaactgcattaggatgggtttaaatttgcccaactgttttctaggccactcatgagaaatctatagattagctttattttaaggaaaaaattctatataaaattacatgttagtttaattcaatcacaaggaaacattccaaaagggatgatctaaccaccctttgaatttttttctctgaaacattttttttcaaccattggatcaaaatctagccatttacattattccccataccactaatagctaggagaaaaataaccacgtgctatcatcgtcgccgccacccgattcacattgcacttagtcttcccatcgcctccacctaggtttacattgctcctatcccctcgccttcactgccgaccgccgcctctcgataactctctccttgtttcctccaccgctaaccacactcctctcctgatccacggcaccacaccatccatgagcctccctctatactcgtaatcttcacccctttcctcttccctccctaatccctctctccatcccaacctcccctccaatctatatcataccttatattctaaatctgtcatatgtcgtcactggagaaacccaagagcttatcgaagtttgttagagatagattgacgaggtgatgcataaatctttgagcaagatctaaaggttagaaaatcatgggttctttgtcttaagaatcattcggatgttttttttaagtaaatcggttgtcaaaatttttctatatgtgcggaagcatcgatggtgtgatgatgcaattgtgggtctagaatttaggggttgtttggttgcttccttgagaatcatgcctaactcaggcatcgatctcagttgttcgattttagtcgcctgcggctggattgatctgtctgagtgagaacgctcaagtgagggcagcaaccaaacatccccttaaatcttgatggatacaaaaaattatgcacacataggtgtcatttttagtaggattttaataagattaaggccgatggtgttagcctctttaaacgtgtgtcaagagtatacttacagctagtgtcagatctaagaattttgttgagactgaacggccatataataagtactcctacagatgaatctatacaagaccattttgaccattaacagtagaaatagtgacagatcaaactcgtgatttaggagcagaaaaacggggaaataacttagatcgataggacgatgcttatgtcttactgatggtcatatgagtgttccaagccatggtgcgggcattaacagttttgcaatttatctcgactaatcttgccaccaccagggtaattaattactattgcaaattgcaatgctgtatatgcacttcattagaaccaacagagagcagtttgctattctactttgcaacttactatatttatcctaaaatataataatatttagctataaatctgattaaatatctgtcgagatttatagctaaaaatatttatatttagggacgacgagtatatactgtatattatagtggatatttgattaaatctcttaaattaagaaacggcccaaaattcaggcccagtaagcgcaaacagtcccagcctgtcagctcttaagtccggctcggtcgaagcgatggagaaagaaagggagccacgaaacgaagctggaagcaagcaagcaggaaggggaggagaatccaatccaatcatgtaagcccgcctaatcgatccttcctaagctgttcctacgcgcatcctgggatttgttccacaaattcttcatctgatcgaacaaatcggagccattaccgatgaattcgcacttttcgtcagttcatgtagctttaggtgtgaaaaatccagcggtgttctttttttgttgaatttgaagcttttgttgcaggtgggcgtcgattaatcggccgccgaccccgaatcgggaggaggatccgcagaaggagctttccctcagagaaatcatcaacgtcaaggtacggcttgctcttcatcctcttgcagaaaccgtgcaggaatctgcgaaacagtggttgtttttttcttttccccttccaatttgctgcggaattgaagttcttgccacttggtgccgaaaaggcggtggactctccggctaccggtgacgtccaatcacccaagaagagggtaatcttcgattagatttgattagggtttggtttagtggatcttttttgggtgggtgcttttttttttaatctttgctgctcttgtgttcgagtgtggtgactgacagtgaggtggtttttttggtttttgtgaagttggtagagagtggggagaaggagaagctgatggagctcctccgggagcggctcgtcgagtgcggctggagggacgagatgaaagctctctgcaggtttggttccttgtcccaccaaattcttgtatcgtttgtgatgagtttctgcttggtgatcctgaattccggcaacgattccgtgcctaagcctctgtgaacaatgatctgtgtcttctgtttcctagtgcgtatagctaccagtttgcttaatgtacaaagcacaagcgtttgtaaggctttaacatgaatgaatgaatgaaggaataattagcttcaacatattgttgtttcagtcaatatctaaaatttctgcaattaatcacttgttttactcggtatgctgtttctgaaacttgcccggaggtttataagtaaaccagacagcatatgggtctttatacatgctttttggctgctcattgaacattatggggggtgcttttaaacttttcctgcagaatgttactttaactgttaggtttccatggtggctaggccatgtagtacatatagtacgattcttcttaaccctagtatgcagtgttgttatagaccattgctagagagattagaaaacccaaagacttagaccacattacagatcgtcgctgacctacacgtgctacctgatgttgtcatgctgagcccattttggaatttgtacacattccacggtttaaaataggtcactaaggtttttcagcatcaaatagattttgtaccatcattggttctatgagctgttttatttctgtagggcctatgcaaggaagaaaggaagaaataatgttacagtagatgatcttattcatgtcattactccaaaaggaagaggtaaagctatttttgtttctccaatttttctcctacaaatgtgtgaggaattctatttactgagtcgacggcacaccaaatggtctgccaaatacaatataaaagtataattatattatagtaacatactaacatagcactgtcacacattttgttttgtcatcttttctcatattttgctaccaaaattggatttgtgagttaaggccaaataaatggatattaccttttaatgcataaatggatttgtgatgttactaagcttacatcctcacctcaatgcctcatatcatctgttcatcactcggttctcaatgtttattgctggtggtattacaaatttacagtactgggtggggaagttctttttttttcctttcaaaatatctatctctcgtattattctcattatctcttgtctctggaacagcatcagtgcctgattctgtgaaggcagagctcctgcaacgcatccaatcctttctcatgtcttcttcctcacttcggtagtccatttgtcgtaatcactggagccgcaggtatgaaggttcgaagctgatcatgtggggaggagctatgcaggaatacaatgcatcctgtaatatcaacaccaaaacgatcgagtgatatttatagtgttgtcgacaatgtttctcttgtcaggcaggcagttgggcctgttctcagtctgtacacctctttaccctgcttagatgtgaaccttgaaaaatgtattttgaatggaagcttccagcttgttatgctgcactgtgttgtgttggctttggttgcccctggatgatcgaaatcataaaaattatatatcttgatagtgttcatgtgtcacatgtcaaacctgattgattaaagtgatcttaaatggtgggccagagagaaatagagtcaatagacaccatgtttttattgtgtttgtgatactcgtgagaggataatgttaggtgcttttgtgtacaggggtcgtatgggctgccatatctgacgggttttttggctgatatccattggtcctttcatccaaacaaaaaacgagcattcaaattcatttttacctagtcgtttttgcagttcgtagccaggtttgcaagcccaaaataacggtgtagaattcgagttttttgcacatatattgcatcgctgacactaaactgatcaagtagtagttagaaatatcagaaatgacgaaggcaacggtgtaatcatccatatcctggggcagttggcttgtcattatcataagctcgatcaaaagcgctgcacaaacacgttggcgccatcaagcagaatgccaacccacacgaatcaggcttcgattcatggcacaaatgccaaatcacaaattctgcaagatgttacgacacacagccacgctgaattgtcaatgaaaggaaaaaaaattaaaagtttgggacaattggtattgggtagagcaatccaattgtctggcgtcaatcaagctatcccaaacaaaaaaggccatcacaatttgccaatcaatcacattgctaacctattgaaaaaagttggcatggtatcccacatgtcacatgcacttcccacagattgattacaaaattgacaactgagaaaattttatatccataaagattcatccagatatgcacaaaatgatcatttcttgagctagatatcctcaccttacagttgatttaacatggatacagcacatgaattctcaagagtgactattcacttgattattacaaggatatagtgctctcaatactagtcttctttacagtgaactcagggccggatcaggtagtatattgtagatacagctcatagaagggaagcagccatgtcaaacagcacaaggcccaggggtcatcttctgcctcctctcatctaagtctagggtatgaacaaaagccggcaagcaacagcgaccggtgtaccacgccttctccttgcgattcttcgcttctctgatcggcgtcggttctgtgctacacgtggagctggactcagatactggcttcacagctgcagaaacaggctggaattgctgcttctcattcttgctgatgtctggaacagatgcatcggtgctatcttcggaaccattctgcatcgcctcctgcaagagctcggctagttttctccttccagttggagaaggttcaggtgatttggaattctgtacattatcaggtacaaagacattgctcataactgtttgtgttctgggttggtagtttggagtgctgccacgagacggagtaaaatctgcacacgaaaaaacatacattacacatgaattgaaaacaatcaaaatcacttggtacagtagaatatctacttgttcattgaacttccagaatgatgcagaagaaatggagtttcttataatttaagtgtatagcaagacttctgaaataaaggaccccatggaataggtaaccgaagttaaaggtggggggtccaatgcagctaacagattattagatgctagaaacatgataatgccaaaagacgaaatcaaaggcctcaaccttttgtctcaacaagcaatcaaagggctaaaataagccccttagaatccagagagacagataaaactgtatcatcaccaaatcaatcagcgcacatgcaatttggactaaacaaaaagaacaggcctcatgctagtatgctactgatacaataataggatagacttgaaaaggaaacagcatgaacaaggcactggcactacagacatgccagtgagaaggaacctatttactctgcatcattagattacctccattcacactgtagaagtcgtcctcgcaatcagaatctaaccatgcccgcgagtcaaagaacatttcatccttgctacctgcaaattaagttctttaagttcctctatccattaaaaactgcatattcaggtcagacaagcatgtgtaaccatggtataaattcgatcaggcttaattaatgaacacacaaattcaacgaagtgcccaattgacaaacaagaacattagaatacacaaaacagtcaacttgcacatctcgtcgatgattggtaacacaaagagcaagcagttgattttggacaaagtaatactagatacaaacacactgcaacccccccccccccccaggctaatcaaatggccatgaagcaagttcctgatttggatgaacctgaatcgaaaaccagcttgtatgaacacttgaacagaggtccgtttcagttaatatcatcaattcctactgaaacaatcagtctgtttgatcttcggaagctattgttaataccaataagcaatctttttattcttcataaactacttttaacaccataaaacttccctttcaaattcttaaatccagacccaaacaataaatcaatcaataaacaaacccaaaaggcctcttttcttcttcttttttttccacagaaagatcagccaagtcatctactcatctccctctttaacctttcaagaatagacttacctagctaagcaaccaaactgatcaatcaaacaaccatctgaaactgaaactcacttcagaaaaagacccaagagagccaagatcaacgaatcctaccagaaccggggctcctgacgccaacccctgccgccgccgcctgctgctgctcctttcgcttgagatcaacagacacaccgccaccgccacccttcccgttcgcggccttcttctccttggtaggcgacgacgcaagaaacagcttcttggggaacccgaggtccttgtgaaccgaagcgcaagaacccatctctctctctctctctcccctccactccactttctctctcctctcacacccaacctttttcaaaccacagcgacacacatctttctctcctcttccccgtgcaagaacgagaaatggaagcaacaaaaggagagagaagagaagagtagagagagagaggagagagttcttgggagaagaggaagaagagggacagaggagaggagagagtgggagagtgtgtttctttactgggagtagcgcgtgggcccgggctgtcatgctctcattttgggccgttgtgggatgtggacgggccccacgggtgtaactagagacggtttttggcttttgcagcattttggggcttttaattccagcggcgtttttggcaagccacatcggatattatatagagtattgtattggtatttgggtactaataaaaaaactaagtacagaatccatcagtaaatcgcgagacgaatttattaagcctgattaatctgttattagcaaatatttacggtagcaccatattgtcaaatcactgagcaattaagcttgaaagattcgtctcgcaaattagtcacaatctgtataattagttattttttagcctatattttaatactttatgcagattgttcaaacgtttaaaattttcctactgccgtgaaatgaaataataatggatgggagagaaagtagtaacagaaatgacttcagaaaaagtttgttgtcctaacctaaaggtgtgttcagtttctgaaaaaagttgaaagtttgaagaaagttggaagtttgaaaaaaagttgcaaatttatatgtgtagaaaaagtttttaatgtgatatgatgtgatggaaagttgggaataggagatctaaacacggactaaaaatcaaatccagatagaactttatgtgttttcatggtgctcaacgatttggtaccattggtgagaaaaaaaattatagctttgtcgtcaccggattaaatcgtaaattacaccctctctattttcaaacaattgataatgctgacttgttgtttagttttcaataatatttttttaaatggaccaataggaatataagattataggttcaataaatcgataaacgttaacaatatggtatcttttcaggtattcattcttatttgaaaaaaaatatgagcggtgaaagtttatagataaacaattttcgttaccgctaataaaaaacatggccatgttgaaacttagtactttgaaatgtatagtagttctgtatgacttgaataccaccattgagaaaaaacaataaattgcacaaaacaagttgaaaattccagtggtgaaattggagagtagctagtatacatagacccgaaagtgaagtttataggttttctttctcattataccctgtttaaatggaactaaaactttttaagtccctatcacatcggatgtttggatattaattataaatattaaacgtggactattaataaaaccaatccataatcttggactaatttgcgagatgaatctattaagcctaattaatccatgattagcttatgtgatgctacagtaaacattctctaattgtggattaattaggcttaaaaaatgtgtctcgtaaattagcttttatttatgtaattagttttgtaaatagtctatatttaatactctaaattaatgtctaaatacatagactaaagttaagtccctgatccaaacaccacctaattaatctgctagtcccctctctctcctactcctactaagcaatcggtgacaaggcaaagaatttgacacttgaagtgttggtacgtgtgatagctacggagtacaatgcccaacccccctatgtggctttcatcttggaaaacttggcagagacacgtgtgatttttacgttctgtctagagagctagagattctaacaaataggtagtgagtaaccaattgatgagaataaaaaaactaggtttttagtttctaactattaattcgtttcctaaaatctatagcttataattatttgaacttaggtaaaagaagtatgaatgtttgagttgagctggagattccgaggcaatctacagctgctacaaacttttctaaacaaacaatgtttctctcgttctccacgtacacgctttctaaactgttaaacaatgtttttttaaaaaaatctatataaaagttattttaaatattcatattaattcaattttagtttaaaataactaacacttaattaattatatgctaatggctcacctcgttttatgtatcttctcaattttcttttttcttctccactcaggccttgtttagttcccaaaacaaaaacttttcacccatcatatcgaatgttcggacacatgcatggaatattaaatgtggaaaaaaaaaatcaattacacagtttgtgtgtaaaattgcgagacgaatcttttaagcctaattgcgctatgatttgacaatatggtgctacagtaaacatttgctaatgactgattaattaggcttaataaattcgcctaacaattttctggcggaatctgtaatttgttttgttattagactacgtttaatactttaaatgtgtgtccaaatatccaatatgacaatcaaacttaaattttttttcctaactgaacaaggcctcagacactccatagacgtgtacatgtgttggaccacaagtctctcattctcatatattcttcaatagcagatagcaacatccgttgatagtaagtatgcttccatgctcaattcaaagattcagccatccgtctcgtgtcctcatgtgattttgtcgatcgatgcaagatctttttagaccattcatactattcctagtggaaattgatgtaggctctaatttgtcgtcatcttagcacagttcggaagcgtgcaccttgttttcaatcaaatttacaactactaaatcgcatgacttgatatctgataactaaaagagtaaaatacaccagcggtctttaaacttatcggaaggtttcacttaggtccacgaacttgcaaagcgtacatcaaagtccctaaacttggtttattgtttcatcccggtccaaagccacgtttaaccgtggtcttgcctatgtggcacgccatgtgaacaatgacatggaattttttttctccttttttccttctttttttcaccactgcgacagcccctctcctcgtgccgcctctcaccaccaagaaaaaaaagaaggaagaaagaggaaaaagaaggaagaagggataaaaaaataaaaaaaaattccatatcattgtccacgtggcgtgacacgtaggcaagaccacagtcaaacgcggctttggaccgggatgatacaataaactaagtttagggacctcgatgtgcactttataagttcgtggatctaagtgaaacctcctgacaagtataagaaccgctggtgtattttactctaactaaaatcagtactccttctttcaaaaatactaggacgtattctgaacaagttttgataataaatttctcttacactatttcactttcggttacggaatcatagccataagaaaatgctttcaaactgcatatacactatatttgaacggatgggggtgattaattcagataatatgaatccaacaataataatttctttggtcaaaacctaaacattattatatcaatagccggtcaaaactcaaaattggatagccaaaatacgcgctatatttgaacggatggggtaattccattttacgtatagatcaaaatcataattcattttcaaatagaaatgtactagtatctcgttatactacaatctttgatgaaataactactccctccgtctcataatataagggattttgagtttttgtttgcactgtttgaccattcgtcttatttaaaaaattttagaattattatttattttctttgtgacttattttattatccaaagtactttaagcaatactttttattttttatatttgcataaattttttaaataagacgagtggtcaaacattataaacaaaaacttaaaatcccttatattatgtgacggggggagtactaaggttatatgcctcaatgatagacatgtcgatgtctccaatagtagcaatccattataaatttgactgagtcaataatatcttctttggcgtgttacaacttacatgcccgacaccctcaattggctagtaacgcaatacaatattgctcctgacgattaccttttgtctctacctgaaatttttgtcaaacaacggcgaaaaggtagacgcaacgagatgatgataagaaaaggtgacattattatatattttacattttatatttgtaaattccaataggtggaaaatttttccaatatccatgtaagccactgaaattgatcttcaatgttactctaaaaactcgaatacattctcctgcaagggtaattcatacgtattctttattctcatcgatataagatgccatctggatgaataagaataatttgaaagttatataccattttgcatggatgttatataccatttcaatgactatcagcctcatcgtttgcccttaaaaaatcagccgttatcaatttttaaatattaaaacttcaatttttttaggatattttgaacgtagttttttagcattggcatttaagcaatcaaagaccatatataaagttgaaatttaattttttattactaataaaccgttagtcatatgcttaactcttggccaaatgacgagatcctttagaataacaaaaatcgaagcaactagataacatgcacctgtgttattccagaaaacaccatatataaataattggatggataattaatacgcaacagtacatataatcccagctaagttgttttcagaaggacaataatcgagtatcgatcgtgctctctcgatgtagacataagtaatacgcgtagcaagcacagtgtatgttagtcgttacatacaggccacgtcggcaaggtcaccgagtcgtgacatcaatcaaactggcaaatatatgagaaagatatcaacagatcgagctaatcaaagataatattactctcttagtttcaaaaataaaagtatttttataacacgtatcaaatagtggtcaaattataatactactcccttaatctcaaaatacaagtaattttctcataaacgtctcccttaatctcaaaatacaagtaattttctcataaacgtctgattggtcgaagatatacaatttttttcattagtataaatttaaatcctagaaaatatatatttatatttgggagcacatcgaatggcatctatctgcagcgtacacagcggtgagatcagaaacggtgccatacttcgcatgacacttgcatggccaaattcagatcgacagatacgacctgtcaagctgatggaaaacgaccgcctaaatgttctgaaaaatgcagtgaccgatttagtagtaaaactgaaacaaagatagtagaagtgtaactgatcgtcatgtaaggttcatgaacgagagagacatcgagagaattcatgtcctgcacgtcagggaattgaagtaaacactggaaaccctgcaggcaatgcaacacgaccacgacaacggcttggcggttgaattgtggatgaaccgaagtagaacagtagcttttaatatatttgctaatctccaaataatttaaccgtactggtgtactaagagtagtacttgttagctaaactgaaagtcagcagtactaaccaactactgtgagctggcaataagcatgatacagctaaggtagagccttgaatcaccgggcatttcatttatctctctctccatgttacggatcgggtcattcatgagcaactactgctatgatcctatctcgatctgcaagtgtgccactggtacaggttggttgtggtcaacctgcatttgggtgccattttcctgtgaatcactggatcgtcacccttgtatattataggtaaagagaattgtagatgatcctagttgctgcctgctacttgcaagtcacaacacagcatggtgattgccgacctgaaagtgataggtccccatcgtttgtcttattttctaataagtcaaaacggtttattaggaaataaaaatgaatttgtaggtgaaacttttataaatgtgttcttggtgacttaaaaaccaatgttgaaaaagaaactacattgaaaatatctcaaaatcaatcttaaaattaagcttaaaaattcaaaatttggcttttttttggctgattaggccatccgatgggagccatacttttcagaatctctttttcaaaagaaaaggcttttcagaaaaaaaaaagtacaaaatctctttttcaaaagaaaaggcttttcagaaaaaaaaaatgtactggtacttgtaatatcgatctgaattctgaaacgttgataagcttgagttgtgcttcgtctcggttttcggcccactgattccattaggcccatggacttccgtggcttgtgcgaccggcccgagctggaagaggcccgtgggcactgtggagagccggagacccaaccaacacgacggcccacgcaagcgaggcaccgcggcgtgtgcgtcgtgaccgggccacctagggtaggcgcgttcacgtagcctcgattcgattgggccaccgcgttggtgaagtgtttggaccatttttgattgaagtcaaaatgtgccccaccaaaattttcatagcttaggacttgttcagatcgatttcattttaaaccatatcattatttaataaaattgataatcatatggttatattttgtttgttaccaaattttggtgatatctataaaattttgacaacattatattgagcacatcctattaaaacttggtaatttattaaaattttagcattaccaaattttgaaaaagttattttggcatcaatcagaacataattttaaatagaatgttagttaggaatgaaaccaaacaaaatttatagtacccacacttaatttggtcacattctaaaaactttttcactatactactaaaatttagttttatattagcatcgaatcaaacatggactagttaactttcatttaccaaaaaattggtaatgcaaaaaatattttagtactaccaaataaattggtaggctagaattgcgttgcaggagtagtagtacagtacgtacatggtatgatcggtgatatgacaagcgacgaacacaggtatcgtacgaggaaccaccgtcccatctctcccatgctgccaactcagatcatctctcgaatttgtccccagacaaattaaggttcattaggcattataccttcttttaccttagtggaaatgggtgataaagaagcacagctaattgatgggatctctgatgatcgccaccgtactaaacaccttctctaactcgctcttatgtgacagttgattgtctgtggtgacgggagataaaagataaatggtccaaccatcttgactcacacacactccctaagaaagcgccctttcagacctccatgagtcagcttacgcacaatgcgatttgccttcaaacacgttgccagcaaccaactggttagcagatggattagccaccacatgattggattggtcatatatatgaagatgatcgatgataatgatttgacaagtcaaagagatttcattgactaccatgtaatattaggtcacgggaaaaaaaaaaaagcaatatcatcataaaagcattttgacaacctaggtggtgtttgaatctcctaaatattaagatgaaggcttggtttaattcccaactttttctttaaacttctaacttttccatcacatcaaaacttccctacacacacaaattttcaacttttccatcacatcgttctaatttcaatcaaactttcaattttagtgtgaactgaacacacccgaagaaaaagattaagtgattcacgcaaaacaaggtggtaataacgtgtgattaattgagttttaattattacaaacttgaaaaatggattaatctgatattttaaaacaactttcatatggaaagtttttacacgaaacgcactgtttagccgtttgaaaagcgtgtcacgagtatctaaattttcatctattttttatacaagaaacgaacgggaccctaatcactcaatatcttctatgagtattttccgtggtaacacgtgctccgctattccgttcgatcgcgccgtatggacagacctacacagtaggaaattaaaattcagtcacatactccctctatccttaaaaaaaaacttaacctagaaacgaatgtgaccctccttttttccagattcattattctataaggatacgaggttgagtttttttttttgacggagcgagtagttcgcatcatatgcatatgttaatatacatgatgttttgaatcaaagtatagtactcgtctactcgatccgtattgatctgtatacaaacaaattcaacaacgcaacagttgcagcgacgtcaactcaattgtgaaaaaaagaaagctggctacaaaaagttctacgacggaagaaggcgattgccaaatgccaattgccacacgacgaaagcagaagagatgcatgggcagacggatgctctgatcgacagggaagggagaaagggaaatgctgcaacgacagcgattgaatttatcgaatagaagcatgcagagaagcatgaaaattctggaattgtgtgctaagccatcgatcaatcgagctaacctgggatttgcgggtgagagcaacgctatctttagtatttttaaaaatctattattgtcttttagggggaaaatgttttttggggttatttgtaaccagtacttctgttggtaggtttcattttataggtgattaatacagcaggacagcgtatcaaacagccatcggtgagtaagtgatcggatacagatgagaccaatcataacatgttacagtgtttcgagttaataaaacattaatgatccatcctttgtcttatgcttatatttataagtggaactttaaattttaaaacttaattttcaagtttatttaatgggtttactttatcgtagtttattttacaacatttgctttaaattgctaagagtatgtataaaaaagtttactcgtaaagatataaaatatttttttatttgttaataagtactctctctatccaaaaaaaagacaaactctggtttctgtgcccaacgtttgaccgtccgtcttatttgaaaaaaatatgaaaaaaattaaaaagacaagtcacacataaaatattaatcatgttttatcatctaacaacaatgaaaatgcgaattataaaaaaatttcatataagacgcacagtcaaaattggacacggaaacccagggtttgcctttttttaaggatggagggagtactatggataagtgtaagtataaacaaaataattggtctataattagggatgtaaataggcagccccgctacccaaataaaaacccacttgctagttcatttcccacatggtagtacaaaatttagaagaaaaaataaactagaagtgacataagcgggctaaaaacatcccgcttgcccgtcatgtttgcatccctacatataacttacttggaagaatatctccctttagaatgtgtaataactcaacaaagattgttcaattgtttctttatgaagattgtgaatgtatgttttgggtgaatatattccatgaaaattatttatattttcttaaagacatatttttttgtttgaatattggaataaatgaatgtcttgtgataattattcgaaagtaccaacgaaacaaacgaattaactgctataaaattttttaaaaaaacttaaaacaatatttaaaattccacatatatattttgtctattaatccatttacccatatttctcattattccagtgatagatgcgcaagatacttgtggtaactttccgattttatgatgcgctagttatttatagagttagggtgtgtatgttgtacttataaggccataggccttgtttagttctaaactttttcttcaaacttccaacttttccatcacatcaaaacttttctacacacataaactttaaatttttccgtcacatcattttaatttcaaccagacttttaattttgacgtgaactgagcacatgccattgtactgtgttaaaaaatactattgaagtaaatgtgacgagcttttatattaatataaatgtgatgagcttttattgagaagaatagagaaaaataataataataataaaaaggaaaataagggtcagggtcactccaataacgcaccagcaccaccttgcccgaatcacaaagcgaggcccacttccaccttttcctatttctcctctccgttctctccgggttcttcgtcgcctccatccacatcgtcgtcgccaccacccacgccaacctcgcatctctctctcacctctgctccaatcgctcgctgatccccccccccccctccccccctccgaccagacacagccgagctcaggcgacgacgcccccgcctttaatgggctttcctcccaccgacatgccggcgatccccacacccgcgccgcccccggtgacctctcctcctcctccttctccttctccccctccccttccgccgccgcggttgcgcttggagttgggggtggcctcggcctcggcccctctaggctcctcctccacctcctcctcctccactccctcttatagcccaccgccaccggccgccgcgcgcccatggccgccgtgttcttccaccatgttgtcggcgacctcaccgtcgggaagcccgaggtcgtggagctgcacgacaccgacacgctcgacgccgccgcgcgggccatcgcggccagccccgagggcgccgtgcccgtgtggcggccccgggcggcgcccgacgagccgccgtcgggcgccaggttcctcgggatgatctccgcgctcgacatcgccacgttcgtggccgcttccggcgtcggtgaccgggccatggccgccgtggtcggggaggtcgtgcagcccaaccctggcctgctccgggaggtcgatccaggcacgaggtgaggtctccgccctccgcccttcgtttcatgatgactaccaatctccccgcgtctgtagtatggtcacagctgtgcttgtttcgattgatctgcccactgaggtttgggggctattttatcataactataaccaattgtgatgcggcggtgttggattgatcagtaggtatagcgtttgtttcaattgatccatgagcgaaatagaaccttttccgcgttttgggtgctaaatcatgtccaacatgtactttcgacgcgctttgtaggcatcctaaagcgattcatgtcgtatgcagcggtaaattgataactctatataatttatatttatgcactgttgttcgtgttagcttggatccgtcactacttaaaacgcagatgctacatcagcccttttgtttaatgtgatctagttggtgattttgtcttctacgtagctttgtagtttgacgtttgattgtataagcaggtcgaaagctatcactaggtccactagaatttttaattgatcacatgggtttgttgtttatttaatcttggatgtgatgcttttgctgattgcaaatatcgattgtgttcctgaagttgcacgggaccttgtttgaaaaagggttaatgtattaagacaaacatattcattgatttaacacgcaagatctttcagatggaagcataatgaatgccaggtagtcctttgcatcttatcatgctaggccacgatacataattggtctgattgatttctggacggaatttaatagtggatcaagatcaagtgtatatttaagttaaaacatatgctcaagtatgcaaattctattccttttatttggtttctgtacacttaggattaaagtaattttaaaggaatgcatataactgtttttccaactttcttcagtttgtaatttgatggcactgtagaattgattcactgttacgtataactaaaagatgctagaaaaagacgtaggcatgcaaaaaaaaattaatatctagatgaaacttcctatggaatgatgcagctaaatggactttgatttgttatatttcctgtagacagcctatattattcaggagtatgcatcattttttcattagccaaagcagtgccatgcttgatagggtaaaattgcatcttagttatcgtatttactgcaacattgtaggtaatagtcactatcaatattcaatagtacagatgtgttaggttattggcatttatgcttcttcatggttcctctcaagcctgtccaggagtatgactggaatcattcagtctactttaaaagtctcagtcccatctaatgtgacattgagctcttatagtaaatcttacaacatgtatattttaaagaaaatgtgaacggagggataactttgatcctcttttctttaagaaggggctttcatttgcactctatttcctgaagaatcttttgttgaactttacagatctgggagatcaatgtcttaaatagtttcgacgtgaactatctctagatatttctattgcacatatcctacttcttgatttgtttagttgacatcacataacttggattttaagacccccgcaccgccgcactgagaactctggtttgttatgttccgttgttcataccatcattaggtcttttccccctttgtttgtttatatacacaagaatatagttagctggcctgcatcatttgtcttctgatgttgaattgctgagttatcacctgaaaattaaaattctttggatctgttttcttgatgtcatcctctatctgcattttcgttaagtaatattgttaggaaaattgaactccaaaagtgcattccactagcagaagtgcagaaagagtataactgaatatgtttcagtagtaacacctcgagaggatagtacttggttgttggtatcctgatgcatattggcggtgagctgagcagtcttctccttttagtatcatgttgtaaaatgatgatgacccagacttaaacaagctatcagatttcaagcggcttgcccttctggttgtgttatgataagggaacaaagtggggatgaggttctatttcgtggtaatgtaatgccataatcaggaaggtgaaaatctatgttgaagctgtacttcatgctattaatggatcatgtgtgaagacaataatttacatgaacccaacccacacaaacacatgcagagcagaccaatcatggctcaatataatatggaaagactaatatggttagatttgcaaatgattgcatgccaattatttctgcatttgtggaattgttttatgtgcttcagaaaaaagaatatataccctaataaaaaaaagaatctaatgtcttacttattgtaacagcatctttggactatatgcctttgcgctttgtaggtagttcatcttttccaaatgcactgctaggtctttaccctgttactaaatgagtgttattgttttttcttcaaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatccaagtgccgtagctgtagtcgagactacaccagatggaactcgcaagatattaggagatatctctgcctacaagctgtggaaatgtgactatgttgcggctgcatgggcactgataaacctatcggcggggcagtttgtcattggtgccgacgataacgaatcaacaccgatctcagccatcccagtgcctcccatcagctcatcactagtggaagagatcggacctgggcgctcacccagggcaaagaagttcagcagcaggagcatcgggttcctgaacagccaggcgcaccagatggcgttcggtcgaatgaggagcatgtaccgcgggaggagcgcgccgctgatgtgcaagagcacgagctcactcgcagcggtcatggcgcagatgctgtcccaccgtgccacgcatgtgtgggtgacggacgcggagtcggaggaggatggcgtgctcgtcggcgtcgtggggtacaccgacatcttcaacgcggtcaccaagagcgtttatccggcagcatcttgaatctctggatgcttgatccgtaccgtttgctccgttggtggttccttggttggccctagtgcgtgccgtgaactgtacactgcgcctggttggttcttttttgtctttcgagagttggggagttttttgtccgcatgagactgaaactgaagggtatattgtgaattccttgtggatcggtgctactatggcagactcaggcttgtgctttggtacggtggaatgatagtctactcattcgtatatgtataatgtatcgtttctctgtgctcccttaccaatggcccaatgggatcagagatggggtaattaacccagcagctgccatttcttgtcaacctgttcttttcgttctgaagggtataacttgttgataggcatagtatagctttcatcatcagaaacctaattagtctcaagtctgacgtcttaccactaactagtttgttctgaagttgccaatttcagaaagccctatcgcgccgtcgaacaataaacaaagcaacataaaataatttatgtgttgttatggtctaaaatttaatgataaaaataaactacgataaaatactcttaaacaagtttgaaaaaataattttaatataacaagcaattgatgatggtgtcatattgccaagcccacgaactcgatccagccatgggccatggcgagggccgagatcggtgtaaacagccgtggtgggccatggcgagagctcgacaaggcgatgccgtggtgggcggcgctgagtgaatttggtggaatccattgggcctccgaccaccctgcgttcatgttgggccgagtacacgtgaaagctactcgcggaggcgggcctccctcatccacctgcgaatccaaaatttgccgatggttcgcgtccgggcagagcggtgccgcggtggcatatggcacgccaccccgcgcattgacacgcgtgtagagagagagagagagagaccgaaccgacaagagacaaacaacccacgcgtaggagtacgtacactaggctgccggagcagcgtgtcctacatgcactgcacctgcacctggcacgctgggctgaattctgacgccaacaatcgaatcattctcgcagaatcgcgccagggaggaccatagtcacttgaccattttttttaaaaaaaaaaaactcggtctcggccttgtttctgatgcctccgtccgtcactccaggagcatctccgctgccgccggcctcggtatcatcgaccgcgcctcgcatcgcatctctcggaaagcatatgcacaccgcgtggcggcgccgcttcgaattcgtcgtgcactgccgcttgctcggtgcggtgcaccgcgcgcgctccgctgccgacgtcgcgcgcgcgcgaggtgggacgaggaaaacgcacgcaatcttggcgccacgtacgccgatcgagcagctagaggaggaggacgtagcggccgggtggcacgcacgtagtacgcggtgtggcgtggcgtggggttggctcgggaaagatcgggggctcacacaaataatccttcacatgacacacgattcgaacaaaatcaccttttagtcttttacaaaaacacgaaaagatccctgtgatctactaaaataaaaaggcgatttagacacgctgcttcataagcaaagaacaattcggcttagctttagtccggacctagtctctaattacagataaaaatggaaaaaaatccggatgtaaaatcaaagaaaataaagcagagagtactgtaagggtgaaaacggtcgtgaaaattcctgatcgacctaacattgtttccatataaataataccattttcgaccgtacccttttgcctaccattaaattctgaatttaaattttttatcatattaatatcgttattgagtagtttactccctccggttctataacaattgacgttttggataaggttgaagtcaaacttttataactttaaccaccaataactttaaatatatttagtttaaagaaactagaacaacatacataacaacatactacttcagtactcataaaggaagtcgtttagaatagctacacggtctccaaaacacaactttgacttcttgttttataaaaatatttatttaaaagtgatatatgtatacttttatggaagtattttttaagacaaatcttttcgtataatttttacctttttaaattcaataacttgagagttatttatgatttatattcccaagttttgacttaaacgttgtcctaaacaacttcctttattagtatggatggaatacatagatttatctttcaaaacactataataaaagtaaatatgtatttatttattatatatattataatagaaaaattaaggccaaaggtgtatttttaaaggtgtatttttagaccatatcattatccaaaacatcaattaaaataaatctgaagggactaaatgataaatatattaattatcttatttctaaaaagatgctcccgaccggtttttcaccctcgatggtagtatacgggggagagagagagatgagatggcgacataaatcaggggggggggggggggggggg

SEQ ID NO: 62219 - DNA, 1994 bp, Oryza sativa
cacccataatgaaataaaatgagttgattccaatatactactatattctactcctcttggagtagtgtcatacactactacgaaaaccatctttcgtgggggccattttgtgtttccgctggcggaaatcgcagctgccagaaagcaaaggccagtgaaaatgtcgattttcgctagcggttatttaccgccagccaaaatgcatcttcgctagcggccgagaaaggaacgcccaccagcagagagatgtcttcactggcggtagccttaggacggccgccagcgaagacatgtctttgctggcggcggacataacgcagccgccagcaaagaagtatctccacttgcgttagccttaggtcggccgccagtgaagataattctttgctggcggctcacagtattttaggccacgtggcacgctaggaaaaatgaagtaaggcttctgtggatggacacgtggcccgacagcgaagatatggactgtcctagttctaacacgtggcccgccagtgaagatgcaatttttttaaaaaaattaaaacattattatatatactatttttccttttcttcgtgtgcgtatttcagagtcaggcatggttgatataactaattgagctatcgacagagtatgttctctttcgcgtattttagagccacgcattgaggatatatgaagcagaataatatacatatatataaatattcggaagcacctatatatatgtacattgacaaattaaattcgaccgacgacataacatttacaagtattttgaatgaattacaaaaccctagctatattatatgcctggtccagttagacagggattcgttctccggcagggctaagactccttcgttgtcgaaaaaccgcccaggctgatgtgcgcactcacggtggatgaagtagcacatgtccgcctgaatgttctgaatggatgtatcattgagctctctttcagacttggggaattttggaagctgcatcagatcatgacagaattaaggaaattaactattcacaataatacaagttagcgactaatttaacaagtgtgtattacttacctcgtcgtaattcgcacaatatttcccattaacccttaggaactcacaacagtaatatccgcatagtactgttcccaccggttgcttgtgatactttcaacatcaaaataattataaggtataaaaggttattacatggaaacacacaagcatttatgaaaattaagtagtactgtgtggcatccatatatatatgtacttaccggccacttattgcagacggatatgcgttctcttgagtttttgcgttgtccacctcgctggtaataccttttaaatgcactgtttcacggatataattaatttacgttcatcagaggttaaaacacgtcatgctaatatcttacttacagatcgataaatcttagaaattcctgataggtgttgctatctttgtcgagagaatccaagatgatgacttcattgtactttggatagagaagaaagactatccaatggtcgctgcaaacgaaattgttagtcgagccatgattatatgtatatactcttagtgcatatatattacaacttactcaaaggcatatggggcataaacacactccttgtcctgcgtagattcaagcgcaatagctacgtacgtagcgacatcaagcatcttttcaagatgcttttgtgctatgtaagctttcctctcttagggagtcatcgccttgatgtgttccggtagcttcttctcgtctagcgtgtatgtgtggcttacttatcctgcacgggtttaggtaggcgacaggctttttcatcgcttcggcttccgcgtaattcatcctaccaacaatggatgatcaaatgagctacgcatataggtgtagtgatctattaacacgttcaagtgtagcacttacagacaccagaaggcaatcaaattggcgtccagttgcttcccacggtagagggaatgc

SEQ ID NO: 62220 - DNA, 999 bp, Oryza sativa
catacatggctatttttgtcttagcatataagattatttgagttttaatataagattattatatttctaattagacttagtatataataattgactagctagggtcctacaatatacatcacctagacttagcatatatcatcactatttgagttttagtataagattattagatttgtaattagacttagcatgtaagattgtgtagggttctaatatatgacagttacacttagcatacatggctatttttgtcttagtatataagattatttgagttttaatataagattattatatttctaattagacttagtatataataattgactagctagggtcctataacatacatcagctagacttagcatatatcatcgctatttgagttttagtataagattattagatttgtaattagacttagcatgtaagattgtgtagggttctaatatacgacagttacacttagcatacatggctatttttgtcttagcatataagattatttgagttttaatataagattattatatttctaattagacttagtatataataattgactagctagggtcctacaatatacatcacctagacttagcatatattatcactatttgagttttagtatacgattattagatttgtaattagacttagcatgtaagattgtgtagggttctaatatatgagagttacacttagcatacgaagaagagaggaacgaggatccaaaccagtatttgaatgaggaagggaacgtggagagggatgcggaggggaaccaggaggggcacgtggaaagggatgtggaggggaaccaggaggaggaggctagtggaagtcaaccctccgttggacagaagagggcacgtgggcaacgaggtgccgcgaagaagcttgagggtcggcacatcataacgaaactggaagaagatggacgacctagtgctccggcagaagccgccaagaactatgtacgtcacagcggttggg

SEQ ID NO: 62221 - DNA, 5298 bp, Oryza sativa
tcatagattactttcacaagagtggtcttgcccaagcctccaaatccgaaaacggagacgatcttcaacttgctctgatcccccatggacagcatctctatgacctcatcccttggtccgtcaatgccaacaagctttgttgacattgcctttgtgtatggatcatgggtaggatgaccaacagcagtgtaattgcctgcgccatgcttggtagccacatatcgaagtcgctgcttcgcgacggcgtcggagaacatctgaccgtactccacgctcccattgaacagctgatcattcatcttcgccacgaggcgcatcagcatctcaaggtcggcttgctcggggtcagagccgacacgcaaggagatgaggacggtgtcgacgacgtcctccaggtcgtaggacagcatgcgcacatcgtgagcccagagcctgacctgctcgtcaagctgatgatcccgtggaatgttggccaccaagcgtagggtggtatccatggtcttgagacccctagagaactgcctgacccggttccttacgccctcctgcagctggttctcctccaaactgagcagctcggccagcctagagagcaggctgcccatcgccgcggttgctagctccatgctcgatcgatccccttcttgacacacacggcagttggttgagatgattaattggttacttggatgagtgatcgcttagctcctctcgccgttctatcgccaatatttctccaatatctacagaattacaaatgaaaggcatttaaggaagtgaaattcataaagagaggtagctatgtggaattggggaaaaaaatggatgaacactactcaccaagctaacagcaaaccaccatatgcaatttcatcgatccttaatttacttttgcttgtgaatagaatcagaaggttctatcttcttcagctgaaatagtaaagatatagaagctcacagttttgttgtaggtcagacagacgaagctaactgatggatgcgtgaaaggatgatttagctatattgtataaacacacgcatgctgattacaccaatctcgatctgtactgtattattataatttttttcaattggtgtactgtattgtaagttgtaacgccttgagaaattgcatgcaacaatacctccttgtttagtgattaacccttacaaattttgcatatagggactccaatttcacaaggataacagcaaaaataataaatgcataattagtcctcagtgcattatattaaatatgtgcaaaaaagcatccatgttgtctataccaattttttatggaaatctataatgcctattatctggtgagtcaagattatataactgtgcagattgcttgaatgtataatgaactaataaaactatataacgattgcatacccaattctatgatatagtcttagtcttttataaatagaaagaagagttggcacacacaattctaataatctaataataaactataacctatctttgtgcagttatgcggaaaattaatttatctacctatctgaatgcgtatgtaatatcattatattttctagtttaccaaatataagccattagggtatgcctctaaatttaaggagtaaatcatggaagactttctagtattccatttgtaatttaatttttcagcttactttttgatggatgtagtttcagcttattgcgtcttttcaataaaccatgtatatatatttacaaaatgggaagccgttatattgctaagttaacgtaaacagcccataaaaagagttaataggaataataatattgataagcaagcacgtttgctctcactacagaatatttatagcattaggggtacggtggatcaagattttgatgggagcagattgcaaaaagggataaaaaagtgattcaattcatcgagatatccacagttccacactaaaaagtaattgcaaattgctttgaaactactagcggcccaccgataactagctagctgcataaccacaagtaattttcaatggggcagattgcaaaaaaggattataataaatgatttatttagtattactcacttaaaaaggtacagttggtctgaaactactaccgacccactgataacaagcctagctaacaacgagtaattattccagctgaaaaattgaagtacgaaatacgaagtcaacgctaataatatatatccccttgctagcccaagagagggatctatggttctttctcttattatttttcttaaaaataaccatagctgctctccacagttcatctatcacccgaactaaccctgatatcttctactccatggctccatgccagctatatttttctgtgctctctttctcatatccaccaatttccgcaaggagagaaattaatcagaagcggcgagagaagaatcaagcatgagaagaattagcaatatccatcaatcaagtgcaagctaggcagaagtgtgaagtttcggggatggagactgctgtgctgagcactcttctgaacatgctagggccgaagctctacaccttcttgcaagagaaccatgagctgcggcggaacctggaacacgacatacggtacatccggaacgagctccggatgatcggcgcggtgatcgatgagcacgaacgcgggcagatgaaccacggtggccctctgcagggggcttggatccatggcgcgcgcgagctggcctacgacatggaggactgcatcgaccgcttcatgcaccgtatgacaagtggccataggctcgccacaatggccgtccgcaccaagtttgccaccgtgatccagaagctccggaagaaatcggaggatctgtctaagctgagagcaaactacacaaccgctggcaacggcaatggtgattgccaagcaagcacctccgggaccatgtcgtcatttgagacgacacatatccccacagctgacaccgtccctgtgggaatggacgggccaagggatgagattcttgagctgatcatggaaacacaaagccagcccaatcagctcaaggtcatctcccttgtcgggtttggcgggttagggaagaccctcctcgccaagcaaatctatgagaacaccaccatttgcacacaattcgaaccacaggcctgggtttccgcagcagggaagagtgcgagggacgtcctcaaggagatactatgccagcttggcttccaatcgcaagcacaggaggacgatgtcagcaagctcatcacaagtctgaaaaaatgcctccactccaagaggtaagaaatgagaattcattattcatatttctgggagggtattctctcctgtaatgaatatgtgaaggtttaggacaatatttagtcaaactttaaaactttggttataatatttttactagaacagttttataaaatctaattatgatagtactttttgaaggcggatatatgcataacgtttctttacaaaccaggcatctgataaattattcatagccaaaaaatcaaataaaaattgactacattttactcgacgagtaccattaactatataataaaaaaatccacgtgctcactttcttctcatgttgtcattataacatgactcaacattactaccaaagcgtttgtctgcattttaacatagggcaaataccacctcttcaatatgataatctgatgctgctgcaaattacacaggaatgaaaaagtcactaccacaagatggaaagtttcccgagtgcccacaaacacgggaaagttcatgttcctgccgaagtgtgtccgttgccacccatcttttcatatgtcacaaatgtacactcgggaagtctatccatcccgtgtatagcattctgcacacggaaacgtctctttggtttctaaaatactccataatgttcaggacactttcccatcctggtagagaattgagaataatatatacaatccaatattatacatatagctcagtatattaaatttctcattctattgttacaactactgttatttgtttcccttacacagcttcatcaagcgacaaccataaaaattagagtgttttcatggtccttaaggagattgttttaacactatctccctgtgaacaatagacaatgtcacagctcctaaagagcagtaaagagctctacaaattaggctattcacttctttgtgacttgcatccgttttcgatgcatatcttactcagaccactgtccgtgctactagttacaacttacaacatcaatgcttgaaaaccagtatgaaaaaaaaaaggactcataatggcaaaacacaaatcaaattaagaagcaatctgctgaaatgacttatcagtggctaaaacacaaattaaggttgcaatctgcagaaatgacttatcgatggcaaaaaaacaaattaaagttgaatctgttcatggactaattccaaggtacctaagatgacatgaatattgcacatcgagagtgaagattaaataattaagcatagggaaaaggacaaattaacaatgtaagaatatttggtgcaatcagcacaacaatgtctggccttattagacaattattagtaacactatttcatggttccgagaactaatagaaaagaatatgcctaaccatctagagtaaataacctagatgaacacatgtaagacaaaagaaaagggacaaaccaaaagttgcaaatgcagcctacatgtgtggtaagtttaagctatggattatgtaagtttacatgactaataataataagaaaaaaactgctattaccatgtctactaagcactgatccatttaccttatttctaaatacatctctataggttcttcattgtaattgatgacatccagagggaatattggaacagtactataaaagatgctttccctgtagatacaggatcaagcagcatagtgctggtgacgacggccatccattccatagcaaatgcctgcagctctggtaatggtcatgtatatatgatgagcactcttgacaaaaaatactcaagaaaactattcttaagagaagcatcatggggtgactacccacctggttcagaaacagtgctgagtactaaatgtgatggtttaccacttgcccttgtatcaacagcccaattcttgaaaagtaaaggtcaacagctaccacaagaatatgcaaagttgtgtggcaatctgggtatgcatctggaaagagaggatactttagaaagaatgaagcatgtacttgttcacaactataccagccttcctggccatgttatcaaggcctgcttgctctattttggtatttt

SEQ ID NO: 62222 - DNA, 2776 bp, Oryza sativa
gtactgtagtttctattaattgctctgtctgaattgaattatgcagtgggtgaacaaatctttagtcaccaaggtaattaatgttctaggtggcaggatgtatgtacttaccaaggagggttggacacaacatacttttagttgccaattacttggtggcaaattataaatagtcaccaagcaaccttggttattagatatttttagttaccaagtaccacttggttctaaaaaatatatagttaccaacattttcttggtgactgttgcttttacatattgttaccaactatggttggtaagtaatgatattatctttagcaaccgaggagatcacatgttggttacaaaatacatttagcaaccgggttgtagccaccaagatgcgaccaaggttcattggtagcgaaaactcaatagcaaccagcttatagcttattgtcaccaaccaccttggtaactaatggtctgtttccttgtagtgcttggaagatgttggtggtaagtactacacttttttaatcattttaaatcatagagttttctgatttgtcaatgtcgaaagaaccttttttttcaaggcaggagagatgtgccaaatgcaaaacgaaaacaaatagttaatgctttattaacaaaaagcaaaaatggaaaactagagcgccatgtgatgagggaggttgctgagttattcaatgttcacattcgatctgttcagcgcacttggaagcaaggtaaaagttatcttgatcaaggcattacggttgatgtcaatgttgataatagaagacgcaattgcggccgtaagtgagttcaagtagatttatctgtgctagatagcattcctttaaaggaacgaacaacgcttcaagatctttgtgctcggttacatttgagtaaatacaaggtgcaaaatatgataaaagaaggtctcattaggcgtcattcgagtgctataaagtcacacttgacagatgcaaacaagaaagctaggttgcaatggtgtgtatccatgcttgatccaggtagcatgccaaataacccaatgtttaaggacatgtttgatgttgtttttattgatgaaaaatggttctatcttatgaggaaatctgagagctattatttgcgtaaaaatcaagtagagcctacacgtacgtgtagaagcaagaacaacatccctaaaatcatgttcttaactgccgttagtcgtccaagatttgatgccaacggagattgcacttttgatggaaatattgggtgttttcctctagttacttatgaacccgctaaaagaagtagcgttaaccggccagcagggacaatggaaatgaaacctatcgtatctattacgaaggaagttattagagatttcatgatcaacaagatattgcatgccattcgagttaagtggccacaagaagatatgaacaaacctatctatattcagcaagacaatgctcgtcctcatcttggaccaactgatcaattgtttcatgaagcttctcaacaagatggatttgatattcaacttatatgtcaaccgccaaattcaccggatttgaacatcttagatttgggcttttttcgtgctatacaatctattcagtataagaaagttacgaaaacactagcagatcatgttaaagccgttgaagaggtactgccttttctcttttttccatttaaattcacaacaatttggttggagctaatgttgttcacatgaaacaggctttctaggactatctagttcacaagtccaatagaattttcttgacacttcaacttgttatgaaagagacaatgaaagtacaaggaggaaacaactacagaatgccacatatgaagaaagggacccttgaaagacagggttgccttcctttgcagatcaggtgtgagccatcagtggtagaaaccgctatgtctcagatctgaatagtctaccaagatgtctcaggtttgagcaattagaatctttgccatgtatgaatatctaacttgaatcatttcttttctttggaaaataagaaggtagaagaagctttaacatttctgttctaatctcatcaaattcaaaatcagaatgcaccttttggttatgcaagtctcgttcttcttcaatcacctcatcattgttgtcgccagcaccggtagtgacacactcctctttcgcaaaatacctaggtagaagaagcttccacatttctattttaatctcatcaaattcgtgaccagaatgtacctttttgttttgttcaacttcaaccacctcggcagcctcgtcatccatggagtcggcaaccacgaccacttcctcgccagcaatgtcgtccatggagtcggcgaccatgaccacttcctcgccggccgcgtcgtccatggagtcggcgaccacgtgcatttcctcgccggcagcgtcgtccatggagtcggcaaccacaagcagcgcttcctcgccggcctcgtcgtccatggagtcggcaaccacgagcagcacttcctcgctaacctcgtcgtccatggagtcggcgaccacgtgcacttcctcgccagtcgcgtcgtccatggagtcagcaaccaggagcagcacttcctcgccgacctcgtcgtccatggagtcggcgaccacatgcacttccttgccggccatgacgtccatggagtcgacgaccacgtgcatgtccaagactacaagctcttcctcgctcgcctcatccatggagtcgctagccatcgagtcctcatcgtctgcctcatacaagatgtcaggaacagg

SEQ ID NO: 62223 - DNA, 11110 bp, Oryza sativa
gaaacaataacaaacaaacataagagatacaatagctattttcatttgtcaccaaacaaaattgcgcaaactaagcttataggtttcagttgagagaagaatttacccatctgggacttcaatttggggagcagcagtaccatcaggcacgattacctccatgtggtcatcaatgagggccaattccagggagtcaaccgctgggtctgaaccatcggcgcagttgttggctggttgcggcaacaactgcggaggtggttgcagcaaagatggggccggaagcaccaagacgccggcggtggaggcgaggtcaacggcttgtcgcggtgacgctagggaaggtggttgcggcggaggggaaggtagcaccaagatgccggccgtgggtcgcagccagcggccggttgcgcccacgctgctgcatagttggccggccggcggtgcgtggatggggagcctggcgaccggccatgcccgagcgtcgatgaggttcccggcgaccggccgccgctgcgcatcgattgggatgctggcaaccggccgcgcccatgcgtcgatggggatcccggcgaccggccaccgccgcacgtcgatggggagccctgcgctcggccgcgcgtcgatggggagcccgtcgaccggccaccgccgctcatcgatggagagcccggcgaccggccgccgctgcgcgtcgatgggatccctgcgcccagcggcacatcgatggggagccaggcggtgggcggcacgtcggggactcgggcggccggccttccatcgatgggagtcggcgcttcactatgggcagatcgatttgggagtgcagggttagtgttttcagtcaacaggtgctagggtttattagtcaagagtattttagtcattaagaaaaaaatcaatacaccaaacggatgcttgtggacggcgatggcacgcagtagacgttcgggaaatcacggtagcatattattcaacttgataaagtcagtggtatattgtagaagtggaaaaactcagtagcattgagtggattctctctaaataaattggttgacagccaccgggcgtagtcaggctcaggcataggctacttaggccatggtccaacatggaatgtaaggcccaatgcaaactttaaatttggattaagtctatattccctccctcaacttatactcatgttgaattgaatccatcaaccgcaaaaccagatataacccgtcttccaactcacaaaaccattgcaaatcgactcgatcatcgggtgatttgagaggtggtttcgtcagacgtgccatcttcgcctccttgactagctgagtcagtacatgggctccatatatatgtcagtgtcctgtggtactcagtctacctccctagtgttcttcctcctccagccgctctatgcccatgcccatgcacgtattacgtccccagcattctaccttctctagccggtctcctattcgtgcccatgcattgtcgcactgcctctccttccaaattagttgcagaaatggatttctctcgatctcctttccttttcccccaagaaagccccatcgatatcgtgttaaatcccgcgaattttgcccccattcttatcccgacgaacttgggacgaactcgtcgaatccatttgtttctagcctagtctccctctccttcgcctatatatagcttgcccaaggtcctctcttccgattccaaccctagtccgagcgtgtcctgtgccctagctgcctccccacgcgcttgcaaaattcgcgggatttaaccactccagccgagccgcgccaccacatctgtcgttgcctaaggtggctgtcgccaccgtcaggttcggaagacgaaggagaagcttgaccgcacctccgcttcacttgggcatcgccggagcgccaccgtcgacatcaacccgaggccgccaccttttcaagctcggcgccggccactcctatcgccgctcgtcaatttgcaacggttttgagttggaggaaggttgtatccagttttgcagttgagggatgtgattcaactaggggcatgagctgagggaggcatagacttattccttgatttttcaccatgtaaatatttgttgggccaaaagtggaacgggccaggcatccgaggccttggaccatttttgaatccacccctgcagtatagtgatgtgatgcgaagatgtgatttatatgaatgattattaattttgtactatctgtttctgttgttaagagtgccgaaaagcattttggaaaagtacataagggaataaaggaaaagtgcatatgggcgccgcccagtactacgactagcactgctatagctccaacaagccgcgtcacttccccttgtgatgagaagaatgataaatttccctgtcagtcagtgtcaagcggagccatatacatggagtatataatactcgtcccaacatttaaccgtcggtctaacttaaataatttataaataaaataaaaaaagtcacgcataagaaattattcattgttttagcatctaacaataaaaaaaatattaatcttaattatttttaataaaacagacgatcaaacatttaacacgaaaatccataactatacttaaaataaaatggaggaagtactacatagtaatatactatatatatgcaatatgcatgcatcgtcctccacaccaacatggctaactccactcgtacgtacgtgttcgcctctaaatcacgagcactgtactgcatgtcacgtaccgatatctctagctttatatatctatctgttaaacatttctgatttatttagcaaaattaaaattaaaggaaaatgactttcgtgcctttatatgtagggtgcgttttaagcataagacggaaaaggaaaatttaattaaataggaggtacaattgatatcatcgatagacgcagtggcggagctacgtgcactctgcaggatcatatgaccccataggtttttgcaaaataacccaaaaactattgatatttgcgttgcaacaatagaaaacttgaaattttatagctttgaccccacattatttgctgctggctccaccaatagaaaacttggaattttatagctttgaccccacattatttgctgctggctccgccactgaaaatatagaggtatatgaatgtatgcattaaatattaatgcttatacatattgttagatgcaggggcgaaaacaaacctatggtagcttggcttgagctcgaactctacctctataatcatgcttaaaataagtccccttaaatcaccatatatatacgatcttttgagaaaaatcaatatctctcgtgaattagtcgagtcctatttgactccaccgatatatggttgaacggatagagagtatttttgtaaatgctgcgtggcgtggacgcgtgcccgtgctgcgtgcgagcgtggtccatgccgcgggggaggcggcagcaagatgccgatacgaattatgatacgaatacgatggagagatcgatatccccgccgcaacttgctcgcgatcgatcttgtagccgccgccggcgacgacctctctttcggctggatcggacgcacacatcgatcgatccatacgtacggccatcgatcgaatagaatatgctcttctcgtgacgtggactagattcccgatcttccgaaagattctgatagtcaatgatttgaacggagtcgcgacacaaatcgatctggcttcttaaacgaacacgctcttgagccccgcaatcgcagtaccacgtctcctctggttatcacccatatcgaaacgcgtatgacctcgccgagaggctaatccctgtttgcgaatcgaagaacacaaacaagaagaaggaagaatacaaccaaaattgcagatgaatgattaagctcacaagttggggtcttacaaaccgatctagcagcgaaactgttcttggcagaataatctaagcaaaacccaaaccttaaaagttatggtgggtactgatatatagagtttagggtcatgcaaccaacccttgacgcaacactaatgggttccaactaacacgatacgcggtccaaaggcctaaatacggtgacgcagcaccggaacagattcaggacgtcaacttgttcggtcgattttcattgactcggaaataatttggacgtgggaccaaaaccattggaaatgttatcttcttagctttctatcatataaagaacgtcccaatccgagcacgtatgcgacctgggcgtctgttttagtgcagattggtcctggactccaaattgcacttgaagttgacttagtttgggtctccaccttgacttggacgtcctcgatgatcctccatgactctagttacttctccaagtgtctccttgtcctcttcattatttctaatcacaatataatcattaggtagaaatctattttcaaattcgtacaaagaagaacataggaacgagcttacctctaaattcaattgtagcgcgcgagctcttgttatcgatccttaaatgaccggtggaggattgttgtgtgtatccgaagaagtgatgtccgtattatctcgtttgactttttttagtcaaacaagtttggtaaaatttatagcaaaataaagtactaatattttcaatacaaaacaaacattgtatcaaaacatattcaatgttgaatttaataaaactaattttatatcatgaatgtggctaattatttatataaatttaattaaattaaaaaactttaattagaaaaaaaagtaaaacggcttataatatgaaacggagagagtggctttttgcttctcggccggtcagataggagctagccacgggcccagccggccggccgccggcatatctcttcaaagccaccgtcatcgccgtcgacgtcgaatcgatcgatcggaattgccttttgcatcgctataatgcatgcatgggtttgcggcgagcgaggccggtgcgtagctgaagtgccgtcgaccacagtatagtaatccactcttctttttaactgtcggcatagccgccaccggcgcagccatgcttggagccttggagccaggcaaaaatgttttgagaataatctagtcgagacaggcagtttaggtcatgcttgattcactttaggatcattataatctgaattattagtagtaagctgaaacaaacatatagtttattttgacagattattataatctataagccagattattataatttggtaattcactctaaaggtgttttttctatattattgggtggctaacaactaacatacaactaataatccaaagaaacaaatagttaagaggttattcgatatcggtttattataatccagcttatagtaatctggcttaataatctaaattacgaacaagcagggcctaatttgggtggctagcctgcgaatattgttttttcatgcatgcaacgaataattatgataaggacacacaacatatacacgacaaaaatgtatacatgaaacaaataattccgggtgtctctccttcgtactacctctattttttaatagatgctgccgttagacttttttttacatgtttgaccattcgtcttatttaaaaattttatacaaatatataagatataaatcacacttaaagtactatgaatgataaaataactcataacaaaataaataataattacgtaaattttttgaataatacgaatggtcaaacatgtgagaaaaagtcaacggcatcatctattataaaacagagggagtacctgttactaccacactcacaaatcgcaaatgcgtaaacgtctcctaacacacgctgagaaccccgaacacacatcactgtgcacgcacacctatagacgtgtgcttaacacacactcaaaatagacctaagcctgcaacaattctcttataaaattactaccacagttttggccttccgcgataaggcacttttgttgagatcagagaaacttcgtcatggttcgtgtgatggtcttgtaacgaaaggatatcattgtagaagctccgtctgtaattacctacagccgtgataaaaaaggggtcatccatcacaaatgttcatgacgaatcgatgcagttgtagcatttctaggacgaaactacttcgtcaccgtgtgctagctcgactctcttctcatatttacagataggactctctaactattggcccataaagacactgcctaccagattcctatgttttcctccaaatcaaaagagctcctaatatataatttttcacaacattagtgacaactctatttgttgccatcaccactttttatataccacaaagaccttaagtcgtcaccaaaatcagccaaggatgaattttacgatagttttttttaaaaaatttcatgataatcgttctgtcgcagtaattcctatatatggataacacatccatgtacgtatcagcaccaagatttaaatccttagacgtacataaatacacccacgactccactaacacaacactagtgcttcctttgatacaatgttttattttttaaaaataataacgtgattttaagaacactttttaagtgatttttagtcatcttcctagcaataatgaaaagaggacggacaaaagtgacaaaaaaaactttttttagacaaatcaaaatcaaaatcaacaagtttataaaacaaaaattgcgataaacgtatattatattaatgccagaattaaatatcaagaataactaaccctaaatacgagtgcatataccaagttttagagtacataaacttgttgtaagtacgagcacacatgccaaccctagaacttttaatcgggtggacaagttacaccataagtaaccttaccagctgagctagatatatatgttaagttggtggaaaataactttttagatgtgttgcggacatttgagctgtctataataataattatttttatttgattattagagatggtgtgatgaggatgaagattaagttggcgcacgtaaaacgagaaagtcattaacatatgattaattaagttttaattattacaaacttgataaatagatatatttgatatttcaaagcaacttctatatagaaagatttcgcacggaacgtaccgtatagtagttttaaaaagcgtgctaatagaaattaaaccgagataaaatctaaatcttaatcagaaaacaacaggtgtgttcccgtcatacagtgaatcgagtaatccattaaccaactaattcttcaaactaagcatgcattttgatcattggggaccattggatgtacttggtgttcatggtgacgatgatatattggttagtgtcctttcctatgttgccatatactccctccctccgtttcgaaatatttgacaccgttgacttttaccacatgtttgaccgttcgtcttattcaaaaacttttatgaaatatgtaaaattatatgtctacataaaaatatatttaataatgaatcaaatgataggaaaaaaattaataattactgaataagacgaatagtcaaacatatgcttaaaaagtcaatggcgtcaaacacatttcgaaacggagggagtatatatgagaccaggtatatatgttagctccactgcccactttattgtgaacgaattattgttgggccatgctagtctgatctacttttcctttgcggcgcctcgaaccagtgctgtgctgtgctggccatcgatgcagccatcaaataatggaaagaagtatagattccatcatgcgatcaggctgatgatggatatggagatcgatcgcctgaatgaatatatgctggatcactagctagctatctagctgcatgctttaatttgacgatttgtgcatgtccaccctgtatatcatatgcatacaattagtttaatttttttcagatgtgtaaaacatatggactataataagccacgtttgagtgccacttacctactgcacaatcaagtttcagaaatcagattaatttgtactagatgactgaaaagtcactactattctgcaagtgtatgcaataatgtcagaaatctgctggcatattcctgcagggagatcatcagttgttcatcatgttttcttttccactgatgtgcatgaccgtcaattattcatcaagttttcttttccactgatctatatgatgtttcaccaaaaccatactgtttgaagcatcacattttcttctccatatatatgatgtttctccaaagccatactgtttgaagaattatgtgtttactccttattatgagttggctttattatttatgttattcttattgcttaaatgcttgctatttttgagagaatattataataattagatgtagcttcattgaagcaaaggccgaatttaattccattataaaaagaaaactgtttgaagcattgtcgtcacacatatactgttaatttgctcccgtgcatctttaccagttcatagtagcatcgttgccgggttaataagtaaccaacggtagtttttgcaaaatgctaagagacaattcaatatctttttttctatattgctcgttttgcatggcaatgtatttcctttgtttctaatatcctctccccaaaagtccaaaatgctaaaaatatttttggtaattaacttgggttctacctatatctttggaaaaaaaaactggttttacttagtgttagtatactatgttggtcaatttagtgttaccggaatgataaaatatttgattaaaaaaatgtctaacatcatgtacgctatttcttctcgtgttccaattagcttcaatatcagtttatcactactaaaaaattgatttttcatggcgtttggaaaatatttttcatagcagccacgtggaaaaaccgccagcgcagaaaatcgtgggggtgggggtcaagggccgccagcggaaacacatcttcgctagcggtctatttaagaaggccgccagcgaagataggatggaagagatgttgcgtcatgctgaacctgaggatgttgctgggtccgctcgtgggttggataactttgatgcattgaaaaaggcagcgaatgatcttttgtacgatgaggcaaagggctgtgagaaggatttcacattgttgcggacagtgcttgagcttatgagattgaaggccagaaatggttggtccgacagtagttttaacgacttgttggttctgttgaagaaactttttccgcaacccaactccctgccaacaagcacctatgaagcgaagaagcttatatgccctttgtcactgggtgtgcgaaagatacacgcgtgtgttaacaactgtatcctattccgtaaagagtacgaggatttggacagatgtacaacatgcaagaatagtcgatacaaaacaagccgtagccagtccgagggtctggatgttgcccttgacgatgtagaagagtccgatccatgcaaagacagtaacaaaaagaagattccccagcttgtcatatggtaccttccggtgaaagatcgtttgaagtgtttgttctcaaacccgagggatgccgaattgatgcgctggcatcatgaaaagcgaaaaaaggatgggatgattcgacatcctgtagatgcaagccagtggaaggaatttgacataaagtatcataagtttgtagaggacccaagaaacgtaaggtttgcattgagcaccgatggaatgaatccattcggtgacttgagaagctcacacagcacgtgccagtactcctaaccatgtacaacctcccaacgtgggtgtgtcagaaaaggaagtatatcttgttgaccatccttgtatagggaccacaacaccctggcaatgacatggatgtgtttctagagcctttgctggaggatatgcgcgatttgtgggaacacgggatccgagtttgggacgaattcctgcgggagtacttcacgctacatgcaattatctttgtcaccgtcaacgacttgcccgcactgttttccctattgggacagatcaagggaaagacgggttgcattatttgtgtggatggtaccgtgtacaggtatcttaagcgatcgaagaagctagtgtacatgcggcaccgacgtttcttacgaaagaatcactcgtaccgctcccaagcagaatatttcgacggtactattgagaaaggtgtagcaccagaaccatggaagggtgataaagtgttcagaatgaccaaaaacctgaaggttgtttttgggaaggtaaaaaagaaggaaacaaataagcgaaagagaaatgatgccgaagtgccagcaagccctagcgtgccattcaagaagcactccattttctttaagtaccttccgtactggaaagatttagacatacgccattctatcgatgtcatgcacctagagaaaaatgtcttcgatagcaccattgggactatactggaaagatttagaccaaggatgggctaaaatcacgtaaggacctcgtggatatgcaaataaggaaagggcttcatcctgtggatgaaggtaataatggaaaagtgtacctaccgccttcttgctacaccttgacaagagccgagaaaatggcattgtgcaaatccctacatggggtgagaatgcctactggcttctcctcaaacattaagcgactagtgtcgatgaaggatctgtcgctttcaggctacaattcccatgattgtcatgtaatgctcacagtattcctcgcgattgcaattagagcagtcgaaccaattcacgtaaagatggtcatcacaaagctctgttatttcttcaattccatatctcagaaagtaattgatcctgaagagttaggtcctctccggactttcgctatacagacagtgtgcgagcttgagatgtgtttcccaccatcatttttcgatatgatgcaacacctcatagttcatatcatgcctcagataattgcacttgggcccctgtacctgcatcagatgtggctttttgaacgatacatgtccattctaaaaggctacgtacggaaccgcgcccacccagagggatccatgatagagggatacacaaccgaggaggtcgttgagtgttgcattgattacctaaaagatggaaagcaattggtt

SEQ ID NO: 62224 - DNA, 2149 bp, Oryza sativa
ccctacaggcaaacattgcaaacaggctataagactactgaaacaggggacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaatatattccagggctgacgtcatcaaggcggggcgcagcgccgacatgcgggccccaccggtcagcggctcgggagagggaggaaggggcgccggcaagcgggccccaccggtcagcggctcggggagggcggtccacggcggatcgggtccacggaccggggaggagcggcgcaccacgcggcgggggctcgcggccggtgcgcgcgggcacggcgcaaaccggcccggcgaccatggcgcgcgacggcgcggcgcacatgcggcagcggcgcacatgcggcagcggcgcaagacggcggccgacggcgaccgaccggcggcggagagcggcggctagaggtgaagcggcagctacgcggctaagcggcggcgcgacggctaaacggtgcgggagagagagaaagaggaggagaggcctcaccgataacggtcgacgacggcaggcgacggaggacgatggtgacggcgggacgagctccggaacctcctaacgaacaaaaggagaggggttagatggagagaggagagtgcgagagagcgagggcgccggccgaaggcggcggccatggcgtcactcaccagcgcacgacggggatggggctccggcggcgaatctctacggaggaggggtggacgaggtggacctcggccgcgcgaacccaacggcggagacggcgcggtgcggcggcgggtgtagcggcggctagaggcgaccggagtagcggaaacggcggcggcggatgggcgcacggcgcgggagcgatggggaggtcgggagagggaggcgaaatggggaaaaagcgagagggagcgacgggggagcttaaatagggagagagagggccggacgtggccgggagaggtgggaatcgccggccaacgtggaggagtgggggaggtgagagaggcgggattcgaaaatcgaatcccggccatctcgggcgcgggcgcgagcgggagagagaggggagtgggcgcggggaacgcggcgcacgcacgggcgtggtcgacgtggcccggaggaggcggaggcgtggacgcggcggcggtttcgggcgcggcggttgctggcgcggcgtcggctggaggagggagacgggcccgacaggtgggccccacctgtcggcgaccccgagagaggagggaggcgggacggcctggatgggcctcggcctgcggccggcccagcagggaggggggaaggaagggaaaaaaaaaagggccgacagcccattgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaattttgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaaacctaccccccttaaacggaatctcggccccgagattcggaggagctggtgaagaggtgcggatgggcggctttcaactcatcttccctttcccaggttgcttcctcttctgaatgatgactccactgaactcggcaaaacctggtgaccttgtttctggttctcctttcgctggtatcaagtatacgaaccggcttctccacatatgttaggtcctcctggatatcaatgtgttccgaatcagcctgttcttcaggtacccttaagcacttctttagttgggacacgtggaacacgtcatggatgccgatcatattggatggaagttctaactgataagcaacttctccccttcgttccaaaattttgtatggtcccacgaagcgtggtgccaacttgcctttcgtctga

SEQ ID NO: 62225 - DNA, 4902 bp, Oryza sativa
acattgtataagatataaaacttcgtttcttcatttttcgtttgtcctaagtcaaacttttttcatctaaccaagattttaaagaaaacatgctaacacctacaacaccaaattaatatcattaaatctatccttaaatatatttctatagtatatttatttcgtgttgaaaatgttgctatattttttataaagttagtcaaacttgaagaggtttgaattagtacaatgcacttggtgtagtatgacagttctaatatatttgatacatattatccaccaatgttttgttttggggaggggacgtattgcttcggttactatagagcatgtgaaacattgaaagtcttgatttctctttcacaaattttgtaagtcatttcgttatattttacatagatcatagcaaattgaatgaaaattttgcgcattcaatgatgtggatatttaaatttctacatagtaaatgttagtcaattttaaatatattttttgcatattttccaatttgcaggtttaaagttcaacattattttgtagcccttgccaaccatctaggtgctcagatatttgtccacagatcatcaagttcatttgtacctaagaagtccatccatgatcgccacatatgtgaaggtatcctactcagcgtacctacaatgcacataggtattccgatccatcgatttgtacagtcttaataatatttagatactctaattaactttatggttcttaaggtttgttctagaatacttttctaaataaatataaagtcgttattattaggttaaaattttcatatttgacttataataagtggcatgaagaatgaattaaataattcctgacaatgaatggaaagtaaaaaagggaattgatatgcatccaaaacaattttggattacaacatatttcagagatgcaaatccaaaataagaactatacagtatgtcctacacctatctcataataatacatctaatactccaatttttaaattctaagcaatattataattaatatggggtcaaataactatagttaagaatccatgaaggtattcacaggcgtaggacaatttaaaatgctcatttgccccaacaaactaatctaagtttagtatatagtatatgcttactattgatgtagaggtggtgagactttgaatctttatgtcaattttatatgataattaatagttttttacatcgttctatactattagtttagtcaaataatttatcatttaattaatattcattgtcttagtgactacatgatttcgcgagcaaatataatttagcaatataatttttataaaagttgaataataaacacaataaaaaatgttgatgtttatatataatatcaacattcaacaatagtacaaaaatgtaaagaatgttgggtctcccgttttttgtttaccagtatgtcacaattaataagttgaaattaaatataaagtaataattgtgaagttgtatcaatattaattttaatccaaaaataaggtcatcatcacgtcattattaacttgaaatttttttctaagtccaatatgtatgtcaaatattttatattcatgttatgtataaataaatagcccgtgcacggattggcgactagtctatgctaatcgggcgctctgaggaagctctcacgttaactacaagaatctggtcgctgattatttagatcgttcaatcatgaccatagatgttaaaattttatctattgggcctgttataaattctcatgatactgtatatattttatcctctatctagcaattctacatcatacgagagagagcacagatcggaatgattctacaattgtaatgatacagaacagatgcgatctcaaggagatgtggaacgcggcgcgtgagactttgcctgcaactagcttctccggtcatcgtgcctgagcttctccagtcatcgattgctcatgctgatcggcggcgattggaaattaagaacacttgcaggccgctggtgtagctcaatcattgtttggcgtaccttatgttgcttctaaattaattccttgcaggattgtgacatatatgtgcacaacctggcttattgactataattaagatggtgattttctgctgctgttgccgttcctgccgaaccaacaaaccatgcaattgccacaaccgcactttatcggtgtttcttataacagtacaattcttgcctgtttttcttttttttttatttgttatcttgctttagacaacgatatttaatttcctttttagaaccagtattttagcaggatagagtacaagctagatgtgctgcaagaggtaaaactaatatttcactctgtatcttaattagaccttcttggttaactcctttttttttttgcctatttaccgaagaagcacgaatgactaaacttcccgtttcattaattagaagcttacaaaatcataatagtactctctttgtcccactgaatatggcgttcacaagattcaaattttaagactgagttcttttattgaggttgaaaactaacctttcacttacgcaaaacatagttacttattagcacattattaattaagtattatcattttttaaaaaatagattaatatgattttcaaagaaactttactatataatttttttttgcaaaaaatacactgtttagtagtttgaaaagtgtgcacatggaaaaagagaaatgagtgggaaagtaaatgaacgaactcaacctaaatgttggaccaataattattttattaggaattaaatttttttatgaaaataatatgattagattaacctttggatttacaacttttgtttataatatataataaatttaaagtcaaatactagttttgaagagcgcgcattagtcagtggacggagggattacaaatcaacctcgctcaatcttcagcatgcacttaaatattttccacctgtccaggcagcatctttaaacggccagtaagtgaatcttttcttaattatattttatatatcgctaagttacacatatttcatttcaattggcatcatattgaataatcacgagaaaataacaaacacacgaatacatcttttatattatattccactagtagttaatttgaaaattaaggccattagttagttggatggtattatttactatagaacaggatcagaatttgttttaaaataaatatacctttggcgaaaacaaattagtgattaattattcacagtggaactattaaatcatggaaattctataattggggctccaaactgaatacatatgtggatactcactaatatcgaatttcagaatgattaaaacatgaaaaactacaattgagactcttaatcaagtacaactcgatagttgataattaacaaattttggaattattaaaccataaatggctataattgtgatcccaaaccaaaaatgcagttcaatacacttattaattatgagctttagaattattaaaccatgtaaaagataatcgaggcacaatcaaagtacaacttgatatctcttatttatatgttttggtattattaaatttaaaatgatatctaaactgggtttactgatactcactaattctaaatttctatattacatgatagcaaatgctgcggacccaacatcagcaatgtaacagcagaaacataaggatccattctatataagtatttctaattaataattttgatttttggaacataataacaaagtaaattgttccttcttcagaaataaaaaaagtccaagtgttcgttcaccgaaatattgccaacttattcaacatattatttaaaatataatatttacaatttcagtagtaataaccagtgcaacttaattacgtgccgtacaagcactttctcattctctctccatttcaaaatataagtatctctaggattccaattttatatcaccaatcagatgtttggaaaggaaatctaagatatatatttaaactttaaaaattgataactcaagtgacagaaaagaaatctttcgtcctaactgtagtattttctaagcaacctaaaaaaacataatattttgtaacggatggtggatgttactgaaatggcattcgaagcctgcggatgttctcgaagaaaaccataaggcaaacaaaaaatatattaaaccaattccatacaagataggtggtgtaaaaatctgaaattctggggcattggtcagcaccgagttacctttctgaggaaaataacaagctgtttcactgtcttggtatcgctagtcttggagccttcctgtgttgccgcgtatgagaatcctgcccctacgggagaatccacaaaaattatgttgctcacctgcaaaaccatgcaaaattcatccattaaaacctggatatgggcacatgcctttttttcatttgagacagagatacaaataatttgctttgttgccacgtccattaaataatgtaagcaaccttagtccaagtctctggttgatagataattttcggcaatcctccactgtaataccgttttgcggcgaattggaatggtcctataaatgtatgcacatgaataatctgttaaatacaacaaacgttattgtaacatgacctataagcatggtttaccatattgtttatccgaaggaactcggtggaattttttcaataatctgaaaaaaataacctgctagttaatttacctatctcgtgggttaggccagagagactagaacagccaggcccacctgatagccacaataaaagtgggtctacatcaggatccttctctgactggacaaagtagtagaagagacgcacgcccgtactctcgttcacctccacgtatctgcaagagtcatatgtgtgcacacatgatatatatgga

SEQ ID NO: 62226 - DNA, 5645 bp, Oryza sativa
tctatgaaatggcgcattctttgcgccattcaactgcatctttcttttcctctgaatttggcggactgtttcacaaatcaatagattcagttttggcactccattgcttgtcaagtgcaggtcaattccaacttttttcaaagcttctataacgagcctctgagattttggatcatgatcagaacatcgtgatggagtaatgcctgtcagaacaggtttcccacaagtttctaccccattttgcatgccactgcagaagaataaacaatagtaatcagatataaggagaattgctcattaagtaacaagatgaattcttcgaagagtaaattggcatccaaaaagtcattccccattccccttgttccaacaaaagaagtacaactaataagcaacatattattttgcatcctacaaattatgtattatatcaacacagatatttcatacgcatatgatatgcctatttgtgagacctaaaaatccctaggttataaaatacagtagaatgatagcagctgctatacacatgtttatttgaggcaatgttattaaggcggtatggtgaggtgtggtgatccaccaccgccttactgccatagtgagcgataatgaatatggcgtggcgacacctaacgtgcagtgaaaagatagaaagaataagaaatatgggctgtaaatacactaattgggtactctattcatcacagcgcagcccaatagtagtagcccatccaagcactcacctaacctaggcccactactttctctcaacctaccaggtagcaatttaaccctacccaacagcttccttcctagcagccaccacctcaccttcatccagatctctctcccctatcgtgcagcactgcagcaggctcctctcatccacctttctctctctctcctcgatgcagcaagcagaccatcctcctatcctctcttccttcttgcagccagcagcctcctctcctccaccttttctctctcatatggcacaacagcagcagtccctctactccacatcggcacaataaggggagagagcgccaccagggaggaccagcagcaagacagtggacttttcccctctgctcttaacctctctccttcagttcatacctgtaaaggggagaagcctaaggcggaaggacaccttgcccttccgtgaacgccacaacgctatagcgacgccttaataaccatgattggaggattatctccaaatcccacaaattacagtatttgataataatagccttttctaataaagaaataagccaaatcctgcaaatttggataatcgtaataaaaattctgacacccatcaatagttctatagagctaccaagctaacagccgcctttaccaccaatgttatagttaactcgttttgaccacaaacaagtttaggaactttacaagctaatcaggaaactgatgggctattggtggtgtccgttctctctctccctcaacgacgccccaagcatccaccgctgccagcagctgatggccccaggttatccagagaagcgacttgctggatctgatcatcaggccaagagcagctcgcaggatacagggtcggatttgtccttgtcgatcgagctcgctggtgttgggagtaccgtggagcttctggcccatcatgggagagagcagaccccgagaggggaatcgagttggagcaagtgagagaacagaagcctctggcccatttggcatcgtcatgcctcgattgaaacctgtgaatctcacactggtgtgctgctacttggtagctagagcatggaacatttggaaccccaccgctttctttgttggtgaagtgaaggagctgtgaagcaaagggacaaggaagcctggaaggtgatgaaggcttgagagctaggagctggagatcgatgtgttcaactaggagaaagagaggaagaagaggacagccaacttcttgatggaagaaagagtagttgagaataggcatagagtgggcatcagcatttaccacgggcgtgcacagtacatcatttttcaagtatcgtttttcacatatataaaataccaaatatgatctgataattagagtgaaaataattttattttgttcttttagttaccggattcggtgggttatcttcctataaaatcccgttgcaacgcacgggcatttagtaagtctagtaaaaattgatttgaccaaacaaaagactgcataggtatatggactgaagggatgaagtacagacaccaactaagcatgtgagttgaacgctcagtgctaatttcttttcaacactctaacactcctaccgatatttttgtgttggcctccgtcccaaaatatagcaatttttagctatgaacctggacacactgatgtccagattcatagctaaaaatacttatattttgggacggagggagtatgccactagctacagccagcagcggtggacatgcaaatgcatgaagtgaatgaattctccagcctgtacattaccaggttgacaatcgtattcacattaattgattatttttattcaaatatgtatttatcagttctgcatttgttcctgattaacaaagatagggaagggatcctagtttaacaacttaccattgttacgaatgttccttccttaacctttacccccataaaaacagcatataggaattgttgtcctatgcgttaatcctcatactaccggtaataaaagtaggaattgcgggagcttgactgttatccaagtgaggtgtaaactgcaaagagtggtgtattgctaaatagacaggtctacttgtcagcttgtaaaagtccagaagttgtgacaatcacaggaagctttgactagtccaaggtttagccccaaattcaacaaaaggcaaatcaaaatttggagggttgaactaaatgttctcataacatacatgccaggactaaaataataataaaatgattcaattttactaacatcagcaagatcagggtatttgaagctaatcatgaagctcagggacactaagataaatgttgtgcaattagtaagataaaactgtataatttgacccattcatgaaaaatgactacatggaggacggttggacatcattagcttgtaggttaaatggacaatcctacttttgagtcatggcatcgagatactatatctgaatcaataatcctattgagtatttgcctaatttgtattcgcatcggtaatactactaattcaaatccacatatttatcacttctatgtacgttcctgaatatctaataaagggaaactattaaggatagtctaagaaaatccactatccctccctttttttttgtcaccacgcaatataggtatcattgtcctacatattactgtatctcatattatcctaaacagaaaccaggacatggcgagaaaccagctggttcacgccaaaattggttcctgccaaaattgtgttccctgatcgaagcaagtgatacataaaaacctaacacaccatacctgcatcggaagttgttccaccaatgtcttagaaaaaaaaatagtcaatacaaccaccaaagtattcagttttcacatagttttgtgaaaaacatacttattcacgcctcatacacataatgacaaggctgcaagattcttgtaactagatcaatgatacaaactatttttattataaaaaaaacatggcataacatcgcaaattcacatgcagacatgaagtcaaccaaaaaataatcaaaattcacaagcaaccatctcccctaacaatcgcaaccacccatcgcacaatgaacccgaccatacaaccacattccccgcacagaattttacggcgcggcgctgaatcaaaccaaaattagaatatggaagcgtgaaattgcaatgtaccttcggttggtgacgaaggcgcagggcttgtagagcagctgcttggggtcgaagaggatgtgatcgaagcagtaggccgcgaagggcatcgccttggcgccgcaattcgccgcggagcaccccgccctggcagccgcaatctcgacagcagcgccgccgccattcacagccggatgaggaggagggggagcgccgccaccaacggcattcccggcgtcggggctggagccgtgctcccaccagtactcggcgtgcctcgcggagagctcgtcggcgagcgcccaaagctgggcgcggtagagggagtggagctgcaggaggccgcgccggcggcggcggatgacctcctcgcgtgacagcgccgcggcgcggcagagcttggcgtcgcccgaagcgccggcgagcaagaccggccgcggcggcggcggcggcgtgggtttatcggcggcgtggccgtcacccatcggaggcggtggcgggctagggtttcgaggggagggtttaatgagggagaaggtggtgggcctgatgaattcggcccgctcgattgggccggtctgtctgggcttatatggcctaattgtttttgaaaaaagtacaccaaaggtccctcaacttgtcatcgagttagaaaatcgtcctccaaccacacaaccggacacaacgtatcccccaacttacaaaaccaggacagactagatcctcggtagttttgaccccggttttatccgacgtagccactgagtcaccgtgggccccatatgtcaggatgccacgtcaacactctatctctctttcctcctctcccttcctctctctcacacttttctcctctcgaggagcacagccggcaagggagaagtgccggcgcggcgggcgcgccgatggctagcggggtaggagactaggagggctgccacgaccagcagggaggagtgcgacgggcggcagctggcgaaggagatggcacccagcgacagcctggaggcgaacgctatgccgctccactgcgccctgggtcctctccacttgcatcgcggtgacgacgcgagagcaggagggagtcgttggggcgaggaggttcgacggcctgccagcgatgtggtggcagggacgcggcggcggagacacgagagaaggagagggcggcggcggggcgaggcggcgtcggcgggcgagtgcggtggcggaaaggtggcggcggcggcggggcgaggcggcgtcgatgggcgagcgcggctgcggatggggagcagcggcgccgacgactccgcgccgctcggcctcattcttcgctcactgggagggatgactgaggtgagaggacgtcgccagacggttcagcggccagaccgaggtggcgagcatggacgacaacgaggcgtgcgagctggtgagcagcgcagaccttgtcatcagtggcgacatcgacgacgatggcgagggcatccgcgcctacctcctccgcctcccccaccggcgatctagcgccgccctgagcccgtgccgtcaccggccgagcgcgctgccgcctgtgcgagtgtttgactttggatgatcaggtcgccgtcgttacttatgtgccactcatactagttgattgcagtaaaacttgctgaaaaggtggtgtgttttttttaataatagaatataacattcggcctttgctcaaaagagctacagccaattattataaactagcactctaaaaacgagtgtaattcaaataaattgaaaacaccaaaaa

SEQ ID NO: 62227 - DNA, 20195 bp, Oryza sativa
agttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggcgtcctgctgctagggggctcaatcctgcctgcctgtcccgggggttccggccgtaggtggggttgggtcggtactcttgtctatggctaggatgggttggaaactatgtcacgtcttccgtccatataccgtggtggtatgtggcacgtggttacacgtgaggaagatgtgtcttgtgggtaaagatgtatacctctgatcagagtataatctattcgaatagccacgctctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacgaccttgtttaataatattgtatagctctagaatcgtgtttataaaatggctttgggtaactaggtgacttttaaatgcggtttactgcaaaacttaacccctattattatccccttgtacccccttgcattaatcatgcatctgctggtgtgacttgctgagtactgtggttgtactcactcttgctcaatcttttcccccccttcagtaagagaagctttggagaagaagtcttaggtggagtcctggcttataccccagttgagcgcctgtgaagatggagccgtaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaatgcaaattttctcggtcgcgacacttatgtcgatgacttggttgtaaagacgcgtaaccaggaaacgttactctcagatctagcggaaacttttgagagtctccgctccgcccgcataaaactaaaccccgataagtgtgtgttcggtgtacctgcgggcaagcttctcgggttcttggtctctacccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctctggaccgtttacctggacggaggaagccgaaaatgctctcacccagttgaaggcgtatctaagctctcccccagttctggtcgccccggagccagacgagcccttgttactctacttagcggcgaccccgcaagtagttagtgcggcattggttgtggagcgcgatgaggacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagtcggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtaatgcagttcgacggctccctgtctcttcagggcgccggtgcgggggtcacgttgacctctccgaacggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagatgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccaactcccttagattgattgcttggatcgccgagatccaagcatacctcatagataagactctacccgaggaccgcgaagggagtgaacgcgtccatcgcatttccaaacgctacgtgctggtagaagggaccctctatcggcgcacggctaatggaatcctcctgaagtgcattcctcgggaacaaggcgttgtgcttcttgccgatatccatgaaggcgaatgcggagcccactccgcttcgcgcaccttggttggtaaagcttttcgccaaggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtacgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgagcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctccctaacccgtggaacatcgaacaccttcgtcgcttctacccctgagggggggggtcgggtgtcaggtttcgggctcgggccaaccccgcaccccctcgggcgtgtagggttggccgggggctgccacacatgcacattcttatttctttttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggactagaacctgggcacgagcccttattcaagctaagacacaaaaggaccacggcacagatcatcctcatctcatactcatagcaagatgaaattaacacaaaaatttcttcatttttgattacagattaagttgatctatacaaaaaagaggcccgaaggccttagaagaaagaaaagaagaaaaaactgaagaatggcgggggtctgggggctcagtccgatgcgcccggatcgccggcctcgtcgtcactgtcgtctgcaccaccggcattgccctcctcgtcggagttgggggcgaacgcgagccgaggagccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggttactcgaggatgacttaatcgtcttctcgagctcctcggggagccgttggagagccccagccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtctagcgcaccctgcagatcggcgatggtgcgttcggcagctgcgaggcgggcggctaagtcgctttcgcccgcggccgccccgccgctgcgcgccctcgcgtccagctccttcgcccgcgcctcgagctcagcggcccgttggttcagtacggccctctcggcgcgggcaccttccagattacggcgcgcctgctcctcctgcgctgcctcgcggagggacaggctgtccgccagctgttgcgccgcggcctcggccccctcgagagctcgctcccgctcggtgagcgcgtcctcgcggaggcggagcgtgaactcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagtggcagcgtcaagcaccccctgggcggcgtcgagcttcttccctagctccgcctcccagctcccgtattgagggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcagggcctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccgatggaagtgccggactcggggatgtcccccggacccggttggtcctgagcgtcgcccgagggagtgggcccaagcgacgcgcccgcggcctcgtcacgagctgccttggaagtctccatcgcctcgtcctggcgaaatccggcctcctcccgaacggcttcctcggcctggcgggcccgggcgacttcctcccgagcggcttcctcggcctggcgagcccgggcggcctcctgggcggcctcctcggcttcccgtaggcgatccacggcctctcgccggtcagattcccgcctgcgggcctctgcggccgccggatcctcggcctcagactggccagacttggaatggcgggagggacgcgacgggatctcgctgaaacaaaagaaaagaccagaagatgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccaccccgccccctcggggaggagatgggggaggtgttcctccctacttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccaccatcataatggtcaggatggaggcgcggtctggatcgctgcagagggggaggattccttggggaacgagggccgcctctatggagttgagattcagcacccgttggaccaatatcttgaagtccttaggagcccagtcccatctcacttcctggtgggtcctcgtgaagtcttcggacccggtgtactcccaggcgccccgagcgcatcgctggagcggcgcaatccgacgacggaggtagtcgccgtacaccatggcccctgtgagcccctgggatcgcaggcccgccaggcggtcgaggacggcgtcatagccatcccccagatctaccggcgcctgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgccgtgcccggctccacgcttctcgcgcccactatttcgccccctcgtttctcgcgcccacgcttccactaatcccattcgcccgcttgcggcgcatgaggtggatatgcggttgtggcagtcgagatagatcatatcgtgcgtgcgttaattacgctcgccgaccgaagcgacgttaccatatctccagacgaaacgaatcgccatgtccagattcgtgtgctactcaagtaatgtggcggtattgaagagaccgctcattattgacagccgagttaccattgccgatgtgcgtggtttgtgaccgttggttttctgcccaattgtggagaccggtcccacctgtcaccaagccttaggagtggcgtcacgcccgaccgtttcccttaaagagggcgattgccctggcataacgccgggggctactgtcggtgacatgggatcaggagtatcatgactagaggtttgaggcagacacaatcgcacacgtggcctggcacccccgagggacgtcgggcccgagggtgatgtgttcgccctcctcttagtccccccgagggggtcgggccgcacccgcctcggccccgagggccgaggcgccccgacccctcgtgggtttttgctccgagtgtatgggttaggtgagcacagtggggctcacctaaccacattttttgcggtttggctgagcgtgtcacgccgcatgtaacgcagtgcagtgcactcatttatccggtctgtgaccagtcacagaccggtcaaatcgcgggttaggtggcgacaggcgatctgacgcacgcctcgccccatcccgtcaggacgagggcttctaggcgctcgcccccagctggagctagcgtgttacctcccagagatggcacgatagtcctggtcagatatatgccaggcttcatcctaaccattacaagcaagatgttgtgtgaagaagggcgaacatgtagattgctaagctgacacgtggtggacaagaatgaccgacgtgactggtctgacaccggtcatgtcgtcagcggacagccacgattccacgtcgcatctgctcccggcgaaagtggaggtagttgtgggccgtctcatcagaaggtgactcggacggcaactatacaaatctctgtccatttatgaaaaggtggggtaagtccccacaaaaaagagagaaatggtgcatgtggtatccccttaagatataaaaggaggaccttgcccacttagatgggggactggacttttccagattaggaactcagaacaagggagaggctggcatatactttgtagctccttcatacacagatctcccaaaaacacaggagtagggtattacgcttctcagcggcccgaacctgtatacatcgcccgtgtcttgtgtgtttcctgtctcgcgaaccttccacatacagagagcttagaatctcaccctgagtccccggccgaactggcaaaggggggcctgcgcggtctcccggtgaggagccccacgctccgtcagtaggctaagagaaaattacaaataaccttatagccaacaacaggttaacggtattattagccttgctgttagccggacgaaatagcaaggacggtcggcgccgcatggcgtcgctgttgtcgcgggataaataccgtctgtcaggatgacttgccgagagagtcgtacctgcgctctggttcagtttgatgttcccgagctggccaacaagtgagaaccccacggtcgtgcatgctggagtgggcatccttctaggcacgtcgacgccgccatgcaccaccattgccgacccggagtacgtagccgcgcgcgtgcactccttggatcgttaagccggtgatcgtggccaatgcgagcggcaggtagcttctcgacgtgacgagtgacgacacggggcgcacaacgtgtgattgctcacgctctcgggtacgagatcgatgtttcctgctctccatggacaaagctagcatgaactagtcattggtatagacgagttaatataccgcaaagcatatgctctacgtacatcatccaaaaattcatatataattgacaaagtgaagctttgatgcgccggtcatgacgttcactggtggaaaaaccatttttggtcggtcgaccagatttcacaatagtcccggttatattaaaaaccgggactaaaaacatctttagttctgatttaaaagctccagggtatttttcaatctttaattaccaaccgggactaaagatctatttgtagttctggttgataacaccaaccgggaataaagatctccatacgttttactcccgaccaaagatttgtagttccggttggtaccaaccgaaaaaaagatcgacgcagatatcggagagatgtgccgatcggatagaggccatctccgcctctccttttgactcctctcctctcctcaacattatcttctctctcctttaactcctctcctcaaccttatctctattcctctccttatctattcctctccttctcctctccttctcctctctactacagcggcggggcgcggagggccggccggcgcgagggcggcggggtgcggagggccggtcggcgcggcggtggctggcggcctcgcggcggcgcggggcgcggagggccggccggcgtggcggctgcggcatgcggtggcgttttttttttttggagaacttgtgattcgtatttgaaattgttgtgtgatgtatttgatttgtgtgtgatgtgaatatgtgatgaatttttcagaagttgtgatgtaatttttttaagattttgtgatgtatttgagatgatcgatttgtggatttggaggcaatttgaggatgattgatttgggattatggggacaggatggggtgaaatcaatatattaaaaacagtgaagaaaagaaaagaataaagaagcaaccggatctagcctctttagtcccgattggtaacactaaccgggactaaaaatgctttatctttagtcccggttggtttttactcccggttatttcacctgggactaaagatagcgtcccaaattcgtagtcccggttgaaaaaccgggactatataggggttacgaattgggagtaaaaaccacttctccaccagtggttgcacggtaattaatctgatccagcatgtttaataggataattaagattgtgacaaactgaagggttaatctgttaacagaagtgtaattgcacaagtgctaatcagacactacacgtgcatgtgtaaattattatcggagttggtgtaagatcgcttgctgattagcttaataataaatacaagctttagttgcttgatattaatatctctcatcatcattcatatcaatgcatttcaacggacgggcattttctagtatatataaaaaaacaaattcaatgtacgaatagtagtgtaccgttaacatctgaatttctctttttttcccttcatgtatagatcgaatttgaacttgatttttgatggattgatagatatcactatactctacatgacttcattttcatttataaaaaaatcataattttgtatcgaatttagaagaaaaaggtacgcgtgagacatcccctcgagaaattagaatccactcccattgctaaacctagcatcattttttttatatagataggagaaaatgagttgtgatcgtaaagaaaaataagaatggtgaatataaaatgctaaatgatttatgataattttattagtagttttgtgatattttatcttaaaatatatagttgtgtgataaatttattgttcaatttatagtttgtaatattttgattaaaatgtctgtagttttgtgaaatttaccaaaatgaatctggaaatcataatttatatagcatgataataaataaaagctaagctacattatttaggaaaataaaaaagcacacaagaaattaaaagttaaacttcatttgttctgtagttacaattttttctgcaaattttgttttagaacataaaagttcacattttcggttctatactatcaagagttatcggttactttaatagtatccaaagttccctctattccctctattccttttcttaaggactcccatcatgttttcaatcatttgccattcactttgactctgtttaggaagcttatgattattggaaatgtaagcaaccggctgggcagaatgtaaaaacatgttttggaagctttagattctttaaaaaaaaaagctctaaagaagaagctaagctagaaagtttttctagcttttagtttattttctaaatttacagctatagcttcttaaaatctagaaaaaaaaactagaatattcaagggagctattgattttagaagttgtatctaccccaagctaccctagacatgctctagaaaggcaggtttttcaccttctagcttctaattcatttttttaattttacaaatacatcttctaaaatataggcgaaaatatgaaaagtttgaagattctagaaaaaaaaaacaacagcaagaaaacccccatacagcacatttggcaaagattgactatatagaaaattccctttctatccaaaagggttgagcgtccatctatttctgtccccgtcccatttgtccgtaccacaagtacatggacacaccgatgaagaaatcatatctcgatctgtatatagtagaaacaactcactaaatcaagaatatcgagcagataaggaagatgcatttttgaacgatcaaaaaaaaatgcttcttctttgaagacctaggactgcctaaatcagtagacaaatttatccatccaagtccctgaagaatgcgagcgagctaggggtataaatacaccaccccgcaaaggggaggttccatggggaatgtgatacaatgtgctcgatataaattacaagatataattatacgcattttccaccatctcatgcaactcttctatacttgtaaaatgtaaaaacatgaaaacagtatatgcaactcttgttttatggcaactggtcatttctttgagccaaatcgcgttgaatagaggaaccacagaatccacattggagatataacaacaaaatatgcctgcagtttggtcagggagaaacttaaaaggtattccaacaggagtaacaccaacgagacaaagggagttgttgaaaagtactcaccaagcagaacgtaattatctcagttgcgaaacctctactgtaactattggatctcattgcatcctggagaaatatctggacctacatatatgtaattcatgaatttagttacatattcatgcgttggagtcacaggatagcaagttaaccaccgtcatgtgaagcccttttggacccattagaacatgttcaatcgtcaagacactgttgtatgtaatttttcttccacattatttatagacagcacatgagacatgatgtacaataagttgcttcctccgtttcataatgtaagactttctagcattgctcatattcatatagatgttaatatgattaagacagttaaaaacaagtcaaccaaatatatcaagggcaaaggactaaaagatgatattggaagatgggtaccttatgatgaaaattttgagccaataacatgaaaatcttgagttgtttataaggtgcagaaatacatgatcgggagatggatccacccaagaagaagacattaggcttatcaacatcgcgaatatgctggccacatattgccttacagaaccgtgatacctgtaaaaagttggaacatatgtcaggagcaatgacacaaaatcattatccatcaagaaaattaggtaccgctagcttaccaatgcttctacatcagtaatacaaagaacttttatggaagcatgaactaagaaaacttcaaggacttcgagtgcttagcacaatattttcatagataccatccaaccatttcaatatgttatatatatcacttatcagtatattttgcatgcttaatgcagctaggtgagaacatggtttgaattgcatacttacaaatattaataatgcatattgcctaataaataagaggtgaacacatatatgggttcaccaacatggaaacataatcatgtaggcacctcatggtagggtctgttcattgcttgtatgaaactcctgccatgtttatatgtatgagaaaagcaggactttgtgtatgatacccccataagaaaagtgccatgaagattcctgaaatactgcagataataaaaccatcaacaaagaactcttggaaatcagaaagggataaagattccagtttgcacatcatttacacaacaggtgattaatgatgtgtaaattaactgtggtactgaatgactgtagctcaatttgcataatgattctaagtgcctaaataaacttaggaatttaatcccattggcttataaatcatataagccaaaaatctgacttagaaaactaagccaataagcctaagtagcccttagtatggcagtataacgaattttaacataaataagtgaatgtagtcgtattttaaaaatgtaaataatcagagtctcagatgagcgtgtttaattaagctgtgaagaacaaatttctggaaggttttgataatgcgatacaagaccaattcacatcaaaatattgcaataaacttgtaatatttaggaaaagaaacatgcaaaatatatacattgtatttggaccgcaagatgcagaaattatataattcacaagtatatactgaacgcgaacatattaatatatataaactgtcaatataccttaaggactaaatcttttccaggccatttataagcagtctcggataacctgcttctttgatgaacttttgatgtcatcatctgcattcatttcacttgatgaataaactagtgaactacttctgcataatttatagcagcacaaatatatggtaaattaccttcgtcaacacaaatgcctgttcaagttgccgaatttggatccattgttctgcaattacaccttccatctgattcaaaaattgtgaaactaacagttgttaagcttttgtgagataggtataaaataaatctagtagcagtgtagcaccaatgaacattaaggtcaatcataacgacgaatggctgctttataagaatgttcagcacttcttatgtgtaagggtagctctttgaaaactaattctagatagctcaactgaaccacatagtttttgctcttcattgttaagacttaaaacaagctacagaagatgatttatatatttttttacaaatatctttattacaccatagcctcttgataagccacaaatgagcactttgaactttacaaaaataagcattaaacatgttattttcctctgtcgaaataattaatacaggtgacatgagtaatgagtcaaagaaaaaaaaattaaaacagtagcattcaaatcctacagagcatgattctgtttatctgatgacgaagaaggataaaataacttaacaaatttccgaccttgtctgaaggaaagtagatattactctattaaagattcaactgatcagttacataatacctttttgacttctgaactcagagattcaacccttttctcagcaccatttgctagggattctattgagtcagcattctcattcatctttctgaccactctccagaggagctgcacctgcacaggaacactgtcaggagtcacatgatgaattttccaattgaagtctgatctcatcatgttcaaaattttggtggagttttgtttgcaacttctgctaatttgcacttgtggaatttagaaaattctaaaaaatatatatatgctgacaagtaatttatacaaaatatgatattatgtgtgtgatacaacaaagacataattttccaatcttctacaagtttttgctcaaatagattagtgtggcatgatctacatttacatttttttcagaagtttctaaattacacaaaaattaatttgcaaatgtccctgggactagctgcaacttcctcataatattttactaatactaaaacattatactgaaaaatatatgtagctttagccagcagaatatagaaacaagtatatatatgtaatatatcatttcaaagatatgattatataatacacccaacaaaagagggaaacccaattatggcatgttatatcatggataataattaataaattattctaaagataaagcgagaggtacctcatcttccaaagctttcacattgctttctgggtaggatttgctttgagatttctacatccagagagtgtaaatattagcatatgcgaggaaagaaattatatgtacatcagcagttggacaaaatttctagaaagatgacaaatagttgaatacatcctactgcagacattttcacaataggagacataaaatcatcagagtaaatgctgaataagtcagttggatgggtcgtgcagtggtggttaaggtcaaacatacacattaagttttaagcaatccccactaacatgtcatctcactaagccattgaatttcaaatattgatagagaacatagaaactgagatcttttaattgtaaaaaagattcataaaaaatagtatatgaagaaaattatccactcatctacagatctactattgcagtgctcatcttatctgctccccaagtccccactaatatagccatagatatttgtttcggtaagaataatatgaccagctaataaacgaagttatacgagaacgatactgtacactcctttttcaaaaaatgtaatgtgtgcatgtagattttaattgatattctacttcctttgcccctatttatcacatcttctcttagctgcattatgatttaatactcataccaattattttctctcatatttcctttgtacttaagtatggaagacatgattatttcctcttcacttttttctggtttcatacccttcttcatctttgttcccatccaaagtaagtcttatattttgaagaggaggaagtacatagttagcaatgatacatccacaccattattcactttattagtcctaaagtggttttctacaaaaaagaattccatgatttttgaagaagagattatgtacagtgcaagtgatgtttattcatctacagcgagatggctaacttgttacagagcaacataacacaagcattcactgatataaccgcataccttggtactctcatatttgttcattaaaatctcaatatcatgttccatagttccaataagattgctgttctcttccaaattgtttgctttactcttcaaagtttttgtgttttcctccaacaaagattctggaacaaaaaatataaattttgtaaaggttgaaggatgatatatttatcaaaattcaaaacaaatgccattggctcaatcagcagtaaagaattccagatgcaattaaactatattgttgacagtgtcaaagaagcttcgtaagttagattttgcaaacagaactagagcataaagggtcaaaaacatattggaaaaccattacatatggtgttgatatgatatgctaccaggtaagctatttcgattcaaaggagaatacaatgtaaatgtgtgaccacgacgcacagccagctgcagaaaggcaacgactccagcacagcagcagcattttcaaccaatcaggatccggtaaattgattctttcatctctagttctctttgttgttaggattagttaactattgcaacgatccagtccatatttactattccattacaatgggtgttaggacactcggtatgtaatgtggttcgatatcattgatcaggaataaagcaaaaggagattaatcaatctaagtattagatccctattggaaatcccagcatctagcctattctctcccctagctagctagtaaataccacccagctatgacaggctgtcctcccggtggtgtttatcccctaaggatccaataacatattaacatcacaggcaggtaacagtctacagttaggcttaattcaactaagtctaggaaagcttaaccggtctcattgtgatagattgaattcaaccacagaatgaaccgacaacgaataattagaaatttgttcgtcaatagcataccgccatgaggatcatgtttatgggtttcaagttttatgaccaaacccaactgcagaagagtaaaagaccaaatcaatggatttggcaagcagttttaaaatcataacactaaccctgcaggtacaaacaaacaaaacaggaactagaatagcataaataactcacaagtacacaaaatagccagaagaatcacaatcattcaggtccttgatccactttttacttcttggtcagattatagaaaactcattgaattgtgattcttatattcatataatgcaaaaaagtacactgccaataaatttaaatgaataacaaattataagtgcaatggaacttgaaacagagttttcaaattctatgttagaaacagttgtacttttaaatccaattattgtggaaacgtttacattacaaacgattaaaactgcaaatagtgttacaaattaaaatattataacttcaggaatagcatataatgtagaaacaatagcataaataatccctgaacctggagtcaatatcgaaagctgaaataagtacaagcattggtcaaataacattgtagttccaattctgaataagtttttttaaaccctattattcagacggtgtgattcaagcaaagtactcgtcgactcgtcgtttacttagtacgcccacgcaagttttcgagcactaatatgtcagtgtacgcacgatgagcacaagacatttcaaatctaagatatggcaagaacaccaaacagcgcgcaagaaacagcactctgccgaggtgggaaaggggagagggccaaagcaagcggtgcctcacccaaatgcagaaccctgagcctgagctcgtcgacctccgaccgcagggcgtcggcggggcgcgactcgatggttgcggacgcggcatgggtggtggcggtgaggagcgcggcgactaccacgacggcgagcagcgccacctcttcggcggagcggcggcggggcgaggggacggagacggagggcgagatgcgtagcccgaaaaaagccatgtggtggtggaggaagaagaggaccgcctccgccgcggcggccatggttttagggttttacggctggcggccaggggggtggcgggggtttgcgctctccgccgccgcggcggtgtccaaatatgagcgggaggcgacagggggggggggggggggggttgagttattaatgtgcactggcagcttaagcttcactttcagtaatcttacattggaaatctataaaaggtgaaaatgaacctatttttttttggagggatccatgatgaagttgaattttgtgcgcattttgccaaaaaaaaaccggggtttctttggccagggtcctgctacgattttggtcatcaaatgagtttgcatttgcctgtcttttttccaataggaggcaaagtgacaaggcaatgaccatatccactccttttggtttggaaatggaaaacatcatttcaggcctaataacttggattccttgggtgcccaccacctaagcaccacatcttattctttcctaggtaatttaattaagaaccccaaaaccctttgggccgttggaagtgggccattcctttttaaggccaaattgtttgtttagcacccaatagaatttcttttaaaaaagccaaccaattggtttctgctttaaaacaaccaatagcccaccttttttttacaggcattaagtgtgccccttttggaaaaatggaatacaaaaatttcccctggttttctttacttttggaagttaacattttttttcaaaacgggcttttggttttttccaagggggaattaa

SEQ ID NO: 62228 - DNA, 1487 bp, Oryza sativa
  unsure (1)..(1487): unsure at all n locations
cacgccgtcgaaaccttcgtcaaagcgtaagactaacggtttcaataacttggtaagatctctagtagttagatggtgaaatattaccagctttgatggcatttctagcggccacacggaagtcctcgacgatctggactatctcccctgtttccagcctttgaggtgccgccggggccaggtcatcggtatttccaaaatagctgacttgaggtgttactggattatctgtgtttgaattcggggcatgaagggaagtttatgtgaaacaataagagcatatataccgtaaaatgttctctttccaatactcccttcctagagaaaaaaaagagttgtaataaagaattaaacatgttaatatacccgttgaaaacacgcgaccgttgtgccagatttggcagaagaagagtgcgcccttggcgtgcacggcatcaacgatcggccgccaggcctcgatttgctcctggttccaaagtccaggcgcgtctagggacgacggaagcgtgtagtggctttcttcagcaccaccagcattcccgctctcgtttaggcgtgacatgaaccaccattttgacaggttattccggtcatttacccctgattcagttgctttgacaccatctgtagctgaattatagtctgttaagttcgtgccgaaaagaaagccacggggacctggacgctggccgtggattggaccgttcgcagcgtcgtccttggatcgtcccaacgcagcgtaggagactgcgctggcctctgcaatgaggagggcgcccggcgtctccctctgcgcgtagtagaggagattgtgtggctggggcatgctcccatatgatcnntgaaccttgataccggtgcatgtacaatcctgtaccaccgccgtaagtttccgtaatgaattttagtaattttttcacggatttgctagaaaacttcccccaacagcctgtttggcaagagaagggaagatgaatgggagtttcaaggagggagttggtggtatgattggttatgggagttacatttttagttcccatcccttgtttgcgctgtgtttattcagcgcaaagtttgggttttgattgaaattgaagatgatgtgactgaaaaattgtgtgtgtatgacaggttgatgtgatgaaaaaagactgaaatttagatctaaactttgaatctaaacacagccttagtcgaatcccaccaagtttcacgaattaataggcctcccccaggtaagagatttgtaggaattggacctcttaattccccatctcaaacactctcaaatcccaagtcttccaaccaaactacaaccaaactacagacttaaacttccagatatcataaactcccattccccatcaccatctccctccaaccaaacaggctgcaagttcttttcccccaaaaacactcagatttgtgaccatcgtatcacctcgagatttgtgcacgaatgaaaaaaattgctagaaagaaaattt

SEQ ID NO: 62229 - DNA, 15950 bp, Oryza sativa
tcctgcagccccacaaacagcccagtgtccacaggataccatacggccatagataccgcgaacttgtggccattttcatgctgcttgtccacaaggagaatgctcctatgcttggcaatgaacccagcttcgtattcgatcgcattctgcacatcaaatatagcggctgatccatccgatgcgcccgagagcaggtaccgccgctctatcaaatcaacctgaccatattgtcaaattacaaaacaccagcgggagcgactcaggaattgcacaccaaatacgcaagattccatctacagggtgtacaaatcaaattgatctaaaccactaaggtgagagaaggagaaggggagtgagggagtgagaagggggtgtacctggagagagttgacggcgccgttgtgcggggtggtgaactccttgcggttggagagtgcgagtgaggcggtgcggcgcgcccgggcggcggtctcgaagcgccgtgccccaagctccccgcgttccctccgcctcaccgcctcacaccacatccactcggccgcgcacgacagttgtgtccctcttctcagcggtgacagcgggcgatagaaacggtgcggtgtgccagtgagggatgagcggcgcggccgagcgggagctatgctgaccggagatggagaaggattcggcggctgcactgggaagcttctattaaattaggcagtttcaatccgtgttgatttatgatggctcggatcctcccgtgtcccgtgttcgactcacatatggcctcatggggcacctgatggatgtttgtctctggctaatcatgaatgatgagttgtggtgtgaacattgataaatttacatatactataaaaatacacgtgttgcaatgagtgaatactattttaacattattattgttatatacgaattcgcttggacttttttttaagaaaatcacgagctacaattacaagtccgacttttatctcaagttagcatgtgagtgatttttaaaaaaagatttcttatacgactcctttcgtattttcaaaagcaaacgagcttaaaatctaactcaaacacatatctgtatttctaaaagcgaacgaacttaaaaaatgactcaaacacggatgatgtaccaaaataccgacaaaaacatcttcaacttttataatagcagagatagagaagtgtttcattatatcatcattatttaaatgggcttgatagaatatcataagttaaataaagagtgttcactacgatatcgctcgttcgttttattatcgaaataaaactaactaaatttatactaccaccatcttcgtatatatgacgttggctagttcaaacccggccgcctcacaccacatccactcggacgcgcacggcagctgtgtccctcttctcggcggcgacggcgagcggtggaggacggtgcggtgtgccggtgagggatgagcggcgcggccgagcgggagctatgctgaccggagatggaggattcggcggctgcgcttggaagcttccattgaattaggcagtttcaatccgtgttgatttatgactgctcggatcttcccgtgtcccgtgttcgactcacatatggcctcatggggcacctgatggatgtttgtctctggctaatcatgaatgatgagttgtggtgtgaacattgataaatttacatatactataaaaatactcgtgcattgcaatgggtgaatactattttaacattattattgttatacggtttagataggataaaattcactataggaattcgcttggattttttttttaagaaaatcacaagctacaattacaagtccaacttttatctcaagttagcatgtgagtgttctttaaaaaaaagatttcttatacgactccttttgtattttcaaaagaaaacgagcttaaaatctaactcaaacacatatctgtatttctaaaagcgtacgaacttaaaaaacaactcaaacacggatgacgtaccaaaataccgataaaaacatcttcaatttttataatagcagagatagagaagtgtttcgttataatatcattgtttaaatgggcttgatagaatatcataagttaaacgaagagtgttcgctacgatatcgctcgttcgttttattatcgaaataaaactaactaaatttatactaccaccatctttgtatatatgacgctggatctatatgatttttttaagcaacttttgtatagaaactttttgtaaaaaacgcaccgtttagcagtttgaaaagcatgcgcacgaaaaacgagagtgggcagttgggaacgaggggaaacgaactaagcctaaagctgttactgaaactgccaatcctgaatacaaagtaacagctaacaagtagtcttcacaaataaaggtggggctcactgacttagtgacttctagataaaggggatcatgtttcgctactcctctgtgccttaaaccataacatcaaatggtaagctagaaagtcacaatgtgcataaatgatcatcgattagagtcatcaaacaacaaatgagtacagattaaggaaatatatctaccagaacaaaagtgacttaaacttagtgaattagtaataaaacaagtaaaagtgcaactgcattttgttcatgacctgaaaaaaaaaccttgtatcattctaatcaatagaaaaacagaattgtgcattgagctaatattgttaccaaaggacactggaagtaagaatatggccaattgcagtggcaaaagccaaatgaattctaatagccagaacaggaataatgaaacggcaccaaagcattcctgtgacaactgcttttttttctatttgtgcggctattaatttataggtttgtctcacatactatcagaggcacaccatttcctagccacaattttacagtgaaagattgacgataaatgtcaacttacggatgacggcaatgaaaccaaagaaaaaaaactaccatacggatgagactaacatgtgaatatgcagatttagagacctaggagaaagaggacggggagtacaccaaccttgggaatagttgtcgcggactcggggaggaggcgggatgcgacgggcggcggtggacggcggggcgggtctagggttttgtcggcggcggcgggtgacggatttgggttgggaggtgtgggagaaatttcattatgtacaatctaatacgctgaactttaaggctgtgttcgctatgggttgttcccaacttggaacagtagcacggaaaacggagcgatccattagcgcgtgattaattaagtattagctatttttttttcaaaaatggattaatttgatttttttaagcaacttttgtatagaaactttttgcaaaaaacacaccgtttagcagtttgaaaagcgtgcgcgcggaaaacgagggagataggttgggacaatggacgtccgaacacagcctaagagtctagcactcaattcgtaagactttaaaagattttaccactaggatagcgaatttcttcatttcatactaatccagtctagaggtgaaaacggaacgaaaaccatctttattattttcgttttcatattatttttagaatcggaatcgaaaaaggaaaccccggaaacaaatattatcgataccgaacaaaaacgaacaggcgcggatacggtaatgaaaatttatcggaataaaaaaccttttaaactgagcttcaaacttttatcaagtccaattctcaagtctcaacggtcaacaattcatcgtaaaatacaattatatcaaatgaaatattttaatggggcccgactataagctggtccaagatgagtcaagcgctgagggagaggcgtgggtcccactctctttttattttatcttcttttcttttatttctctctttcctccttgtctcttttctctctctccctatctcttttctttctctgcttctttgtgcttctcgaccaggcagagaggggggcggcggcgaggcagggggacgacgcccgggcgtcgggcggcgaggtcaggcggcgaggcgtcatcggtgttggtggtggtgaggaagagtcgccagtgggcatcggcgttgaggcattggtgtcagcggcgtggacggcgacggtgaagcacagagaggggcgagacgccgggggcagggacggcgagtgacggcggggggaggacgacgcgagacggcggtggcgcgagacggcggcggcgtagggggacggcggccgacagcgccagatctggctgcgtgtggcgtgcctgcgtggtgcacacaatgcactaccattgctccaaaatccctagcctctgcctctgactctcactctcctcaactagggttagctgtagtgggttgggctaggcaagcgggaggtattatggactttgtaacttcgaaattccgagagaattttcggaaagtttctggccgattccgagttccgacggaaactgctcttatcattttcgattccgtttccgagaaaatattttcgtattcgtttccgtttctgaaaaattccgatcggccgattccgttttcgaaaacctacccggaatccggaaatattccgtaccgttttcacccctactcccgtcaaatttacagctcattcgtctccttccgtttacaccaatgcagggcgccgccgtctccatctccaggccctcccttgccgccatggcgcacgtctttcgcctttgtttgtcatccccgccatcgtgcccggaggccggagctgcactccatgccattgcgctcgggtgagcataccaccgagtgatgatggcagtggccgagttcgagtactgcacgcgtgcgacgacagtggcatggttggggatggcttcacgccgctgcatctcccctcctcactctggccactgcatcttccctcatcatcgctcctctcccctctctcctctggtacgtgtgggtcccgccgcctgagatgaggaactcgtagccaaaacttactccgcgttcttgaggaggccacgcggatggacgatgtggcaacaaatatttggttttggggagggaggctgaacgccacatcggcgcattgtgaacgccctaagggtgttcttagcttttcatgtcagcttttgccatcttctattttagtcctcacatgtttttaaactacataacgtataaaatttagcactaaacaccctcaatttcagaaacaaggatacaatttctccccttccatcattctctctattccccaaccaccacaactcgatgacggctggcagcacagcgagctccaacaaaggacggcggctccccaacctcctcccaaacagcggctcggagggcgacggcggaggcgcaagaactcgccgagacccctcctctccttgccggcgacgagcgctcgacgggcgacggcggcggcgcgggagctcatcggggcccctcctctcccgggaggcaacgagggctcggagggcgacggcagcagcgcgagagcttctggggccctccactcccagccagcaacgagggctcggaggacgacggtggcagcgaggatccggcgtgagagctcgtcggcgccctccacttccggccggcgacaaggagacggagcgccgagggcgacggtggcggcacggatccagagcgacggtgaccccgacggtggagagagaggtttgtttcgatggtggggaggtgggggtgatggtctacagcctggattccatgcttttatctgctttttccgttgagcttctcatgtcttaagttagggtgtgtttagttctagggatgtaaagtttttgaagtataaggaaacacatttgaagtattaaacgtagactaataacaaaacaaattacagattccgcctgtaaactgcgagacgaatttattaagcctaagtaatccatcgttagcaaatgtttacttagtatcacattgtcaaatcatgtcgcaattaggctaaaaaaattcgtctcgtaatttacatgcaaactgtataattggtttttttttcatatttaatgctctatgcatgtgtcataacatccgatgtgacgtttttagctaaaaatttttgggatctaaacaaggccttagtcccgtgttcctcacaaagaaatggtcccccactgccacgttagcagctgtccttcgtggcgagatgccacgttcctgcaccgtgaaggcctgaagggacaacatcacaaaagtcagtcaacttgagaatcatatgaatcattgaaggcggtgacagccaaaaatatcatcttgacttgtgctacgatttagattggatgaggccagagcagaggactcatagcctccttgctttgcttcttgggtgtatcatcaataggtagcagagagagtagcagacagcctgtgaaagagagcaattgtatggcagaatcgctgcttctccccgtagtgcacggggtgatcggcaaggcgaccgacgcgcttgtccagaaagtcacccgcatgtatggcgtcgacggcgaccgccgcaagctggagcggcagctgctggccgtcgagcgcctgttggccgacgctgagtcgaagagcgagaccaaccccgccatcaagcgctggatgaaggacctcaacaccgccgatgacgaggccgatgacgtcctcgatgagttccagtacgaggtgctgcaccgcgaggccatgagcctcaagtcgctagggcacaaggtacggagctacatgacccccctagagttccattttaccatgagaaggaagcttgccaaagtgctcaagaagatcaacgagctggttgaagagatgaacacgtttggcctgttgctgcgagatgagccacaacaactttcttaccggcagacgtactcagtgctgccatcaaatgaattagatgatatctttggcagagacgacgacaaggaggtagtggtgatcaaactgttgctcaatcagcgagatcagcacaagtgggcccaattgtggggatggggggtttaggcaagacatcgcttgccaagatggtctacaatgactacagggtttagaatcacttcgagctaaagatgtggcactgtgcgtcagacaactttgaagttgtttcccttctgaaatccatcattgaattggctacaaacaaagcatgctaactgcctgaaaccgtccagttgttgcaaaaggaactacagaaggccgttggccggagaaggtttctgctcgtgctggacgatgtatggaatgaagaaaagaagaagtgggaggaagacctgaagccactcctgtcttctgttggtggtggtgatggaagtgttatactagtgacaactcagagccagcgagtagcatctataatgggcaccctagaataccataacccagcatgtctgagtgatgatgattcatgggaattattctcaaagaaagcattcagtaaagaggtacaacagcaagctgaattggtaaccgctggcaaacttattgtcaagaaatgtaaggggcttcctcttgctttgaagacaatgggtggtatgatgagttcaaagcaacaagtcaaggaatgagaaacaattgcaagaagcaattaggggacaatgacaggggcgaagatgatatacctatactaaaattgagctacagacacttattacctaaaatgaagaatgctttgccttttgttcagttttcccaaaggaccatgagatggacaaagaagtgttgatccaactgtggatggcaaatggtttcattcaggaagatgaaacaatgggtttggaacaaaagggggaatatgttttctgtaatttggtttggagatccttcctccaagacgtgaaaccgatcaagacattttctttcactgctgatgagtctataatttgttgcaaaactcatgatttgatgcatgacttagcaaaagatgatataccgaattttcctatgataatgaaatgagtctaacagtgggattgctcaaaatatcatcttctatccacactttgataactgcatggttactagtacatattaatgacttaagacagatgtcattaagagattttggtactgacttgagacttatgtcattaagtgctttgggtattgtctgtattcgggcttgcccttctcatagccaggtgatcaatccaaagcatctacgatatcttgacctttctaggtcttagatggatgtgctgccaagttcaatatgcacgatgtataacttacaaacactaaggctcaacgattgcctacttctgacatatttaccggaaggtatgagaacaatgagcaagctcatccatctttatcttcttagatgtccattgaagaggatgccaccaaatattagcctactgaaaaatcttcgcactctaacaacatttgttttggacactgaacctggccgtggaatcgaggagctcaaggacttgaatcaccttgccaacagattggaactggagagctacggccaagctggaaccggtcggttgggctactcagagagttctctgataggggagagggggaaaatggctggggagcgagcgcgtgagggagcgccctcaccgcccggtggacggccactccggtgtccgacggccacattccaaaccccagtttggttcctggcgcgacatcgtggtggggattggggaccacacgttaggtaaggctgagaaggaggcggcttggatagaggtgagaaggaggaaaggagttcattcaatggcgacctaccggcgcccaaccactcgtccatcagcattcaaggcggtgagggatatcccctagtggttgcagggaggtgtttcaaatgccttggcctagggcatcagaaggcgcagtgtaccggccagattcgttgcttccgttgttggttttcgggccatcttgcgagtttttgcaccgagcatgacgaagtctcttcaactcgcccgtgctcagttgctcagcctgcttccctcgcttctctagctcgcgtgcaccctgctgctcgccccgttcagccgacgccatgtcctgctgctcgtccagcaccgcatacagctgctcctacttctcgccagcgtccgccatccccgtccgctgcttcgggtcgcacgcgtcccggcctgctccgcctgccgactacagagtggttgggcgagctgaggaagaagctcatccgcgggacgtcgtcaagtcttccaaggagatggcaggttttcaaatctgcgcggctagggagcacgcctacatggagggttttcgagtcggcgagccggagctgcggctggggactggccgttgcgtgctgtcctggacggtgggcatggagcacaatgaagcttggctcaaccagcactcgctgttggccatggttctgaagacaagaccatcggtctcaccgggggagatgttagaagccatcgtccagcacaccggcatcaacgagagcaacgtccgtgtcgacgtgacacatacggaggattttctggtgttgttccgcatgctgcaagatcggaaccttgttctccattgctctcatgagattttcgtgaagggggttcccacgtccttcaagctgtggagccgccggagttgggcagacagctcggacttgaagttcttcaccaagatttcgctcgatgggctccctgctcacctgtgggagcgcgaagtggtgcgcaaccttgtcaacgagctcgagggggagctcatcgagagcatccctgccaacgacaccagatgtctgggcctcttcgcctggttcaagaatcctaacaagcttcctcaacggcttcaggtggaggtgcctaagaagataggggcgggcggctcctggaggaagtcgtcttcgagctctgctcctcctcgagcgcctagagcacggccctcttttactgtatggcgtcttcctccacgttgaagaggtgaacgatcccatgctgctgcatgcccctgataaattctacaacgatgatggtgacgatgatgtgacaaggcgcaacaccttcgactgctgggctaagtggttcaacagcgcaggtctgtggccatcggaccggggaggcagcactcgctatggaggagcatcaggttcagccgggggtttggaatgccaagcgttcgatctcctgccgtcggtgatacagcaaccagtccgtcttttcaacacggaggaagctgtgtcggccatcgttcgtttcggttcgtcggctacgggggaggatctgctcccgtcttctccagacgctgctgctgtcgtcgggacgagggagctgggcacacaagtgccggtaacgcagggtttcgaggtagcggcgacggctgttggtgtggctgcttcggttacccctgaggttggcgctgcttgccgtcgtcctatggggtctggttctctcctcagctgagacgatcaacgcgtcgcttcaggtggcgcaagtcaacgacgtttaacaattctcgccgttgactcaggtgatggtgctggtctcgcccgaagtggtggtcgacactgtcgaggtgatctcgccgtccctacctcgtgtgttcgagcttgctgtaccgggtgcaggggcgatatgatcccctgttgctgagctcatgttgccaacgaggtgctcgcctgttgtctccgattcgctgcgtctgacggaccaagagcaaggcggcggaggatggtgcggcggggtcgaggtacacgccccgacagtctcgttcgtgttggcggtcgaggagcaaggcggaggttcacggtgcagttcgccgatgctggcggacgagaaacatgacggtggcccacggtacagagaggtcacgaggtcaacctctcctgtggcacaccattgcactgtggacaaggttcacggtcgcaactcccaagacgaagagagcagtccaaggccagcctcggcgcctgcttcctgctggtcgctgcagaccacaccgctccctgctagacgcctttgcttcgacgacctctgtttggatcctccattaataggggcggttgaaggcagcagcccccaaggtgggaactcagcgggggaacattttcgagctggaggtccggctcctactgaagtcgtccgtgggttgtatttggcaattcctcaagtagcccaggaacaggtggtgccttttgaccgtgtctactctcgacgaaaggaggccggctctaaattgggcatgttgccaactcagatcgctgtgtcggcaacccaggaagtgcagagcgcagccgcagcggcccaggaagcaatcctcgttgcggccgatgagaacatgtgcgtacaagtcaacatcttcgtcgacgctatctccacgccgtcctcatcgtccgtcctcagcaagccgcctgcctccgtcccaatcaccaagagcagatgccgcccggtgatcccagttgatttcaagccttggagaagcccacggctggctctgcaaggctcaggcgcccgacaccactccatctccaaggcacagcgggtgactatgaagaatctgggaatcattgaagaagaagaggaagcaaacgatgaggcgatggaggaatatgttcaactcttcgacgaaccgctgccgcctcaccattttgaggccttggcggagctgcttcatcttgaactggcggagccggagttccaggcgctagcggatgtggcacctttggcagttgcttctcctgcttgattttgtatgctgtgttagccgggggctgggggtgtctggttgttgtaatgtcaggagtgagtttcaatcttctagtatggaatgtaagagggctaaacaacgctgtgaagtgctccctggtgaaggagtctgttgtttcctccaatgcgttggttgtgtgtttccaagaatctaagttagaagttgttgatcgtgtcactgtctttgaactttgcggccctgattttgatcgttttgaatttcttcctgctcttcaaactagaggtggaatcattgtggcgtggaagggggatctattccagggcactcttgtccatgttggacaatggtcggtgacagttaatctggattggcgccagggagggagatcctgggctgtgacctcggtgtatggccctcaaagggatgatgagaagctgttgttttcggaggaattgtctgtcatcaagaattgttgtttgggggaatggatgatagccggtgatttcaacctcattacagcagccgaagacaagaataacacaaggatcaatcggcgcttgatgaatgcttttcgcagtaaggtgaacgatctagaattaaaggagatgtatctttttggtagaagatatacttggagcagtgagcaggcaatcccaactttggtgaaactcgacaaattgttcatttccactcagtgggaggatctcttccctgaagctcatctgcaggctctaagttcttcaggttcagaccactgtcctcttcttttaacctggggtaaccgagtccctaagcaaaaaaaaggttcaaatttgaaaccttttggacaaagcttgatgatttcaatgacgtagtgcaggagtcttgggggagtgaggtcgatagctctgatcctttctgtattttgtatgtgaagatggcaagattaagcaaggcacttggtaaatggggacagcggaaaatcagctcgttcagattacaacttcagattgacatcaatggcactttaagtgaccccttcaagcctatgagggggctaagacaaggggatccgttatctcctcttccttttgtcctggtgatggatactcttcatgctatgttgtagaaagcaatgtcagccgggttgcttgataaagttaaccaccggagcagagcaccaaataattcgctctatgccgatgacgcagtcatcttctttaaaccggttcgtcatgaggccatgctagtcaaagccgtgcttgatctctttagtgaagccactgatcttcttcccaacttctccaagagtgcagtttcaccaattcgctacacagaggaacaaagctccttggttcaggatattttacattgcaaacttcagaaccttccaatcctctatttgggtcttccgctctccgtgaggaaaccaacaaaagcagagttacaacctctttttgatcgcttggctaaaaaggtggcaggctggaaatcaaagttcctttcacctgacgggcggctctgtctgatcaaatcaattttgatggccattccggttcactttctctctgtgatgcagctgccaaaatgggccatcaaggacatcgaacgccgctgcaggggtttcttgtggaaaggtcaagaagaagttaatggggtcattgcctagttgcttggagagccgtcagtatgccagttgaatttggtggtttgggaatcagggatattgagcttttcgggaaggttttacgactgaaatgggagtttaacaggcttgaacatgaagataggccatggacaatggctaattgggaatctgataaggatgtccgcgacattttcagctcgattgcacagcacatggtaggagatggccgtcgcatcaatttttggagaggtaactggctgcctcgtggggaaagtattgtaaataattggcctatcattttctgctttgtcggtcgaacgaagatcacagtggctcaaggactgacgaacaacaggtgggttagagacttgcaggggtccatttccaatagggcccttgctgactatctgaatttataggatgagctgcaacaagtgtctcttcaagacgggcagtcagattcggttttatggaggtttacagcaagcggcgccttctcggtttcctctgcatatgagttcttcttctacccttcggtgaagtgcccccacggtgagctgatttggaagaccaaagcgccggcgagagtgaggttcttcctttggttagctgcgaagggccggtgtcttacggctgtcaacctcagcaaacgaggctggccacatgatacgacatgtacactgtgtcgagctgcgccggaagactgcatccatctgtttacaaaatgctctttcactaacagagtgtggcatcagttgagaacttagctgaatgtggcgtttccccttcctgatcagctcggtctacagcttgcagaatggtggctgcaggtgcgtctctgttttcggtcaaggtacagggccgcctccgattctctgttcatgttggtctgctggaagctttggaaagaaagaaacgcaaggattttttatgacagatcaagggtggtagaacacttggtggcagacatcaaagaggaggtcctgatctggagagcggccggaattttttcttgcggggagtagcagcatgttttttggccccctgtaaatagttttcctgttctttttcgaggtttccctcgactcgacagtataatgttgtgtatattgtattaccctcttttatcttaatgaaatttggtcgacttccttccgccgacccagcaaaaacaggttggaactgtacaatttgagtaaaataaatagcagggaaaatggaaaagatgccaatctccatctgaagcaaaatctaagtgaactagtactttcttagggtggtagtatattttgcatgcctgaaaacaagggatgcaacgaggaagaagtgttggagtctcttaaacctcacgctaagctcaaaattttggaactacacggatatagtggcctaaagatcccacaatggatgaaagacccacagttgttgcagtgcctaacaaatctccacattttcaactgtccaggatgtaaggatctatcgactgtgtggtttttggtctcgcttgagggtctgttcttatctaaaatgaaaaacctaaccacattgtttatgaatgtcgctggtgtgaaagccgaatgatactacatccctctgcaaattttcccaaggttaaaggatatgactctatgccagttatcaaacttggagaaatagacagaaaatactgttggcgaggccgatactattttggttacgtttccggagctcgcaaagctatatatcttcgattgtccaaaacttgcaagtgttccagattgcccagttctaaaagaattgaactcagctagatgttgcagtcttgcaatgagctcacttgcacatctaacaactttgtctgaactcatttatgaggacaatgagcgtgtgagaatgtcgttgggctcatggccatctctcacgaaactagatgttagttcgtcatataacaaaatgtccactctggaggtcggtacaaaccaaggcccactagaaaaccttcggagtttaacgctatatcgcctcaactgcttcacagatgtatctggtttctcaaaaatacatcttgggctatgtaaatgctttgcctttgtggaggacttgtctattagtggatgcgacggccttgtgcgctggccaatagaggagctcatgagcttgattcaccttcgatccctgtctattgaaacttgtcgtaaccttgagggaaagggttcatcatcggaggatggtcaattacatatcccgatgctgcctgcatccctcgaaaagctatgtctagtatattgcccaagattggtggcgcttccttcgaagcttggaaatttggccaggctaaagattatgagtttgcagcactgttatgacctgaaagagttgcctgatgggatggatggcctcatttcacttgaagaattgaagatttggaactgcccagagatagagaaatttctgtagggtctcctacagcagctccccacactcaaagagctacttctatggggatgccctagcttgcaaagactgtgcagagaaggcagtgagtattttgatctggtctcgtccgtccaacacatagacatttcaaaaccagaaacagaactggccgaatggcccgaatcagaaacagaacagaccgaatcaagatgtaacaagaacaagcagcttgtaaagaggctcctcccctct

SEQ ID NO: 62230 - DNA, 667 bp, Oryza sativa
ggcgacatcgacgacgatggcgagggcatccgcgcctacctcctccgcctcccccaccggcgatctagcgccgccctgagcccgtgccgtcaccggccgagcgcgctgccgcctgtgcgagtgtttgactttggatgatcaggtcgccgtcgttacttatgtgccactcatactagttgattgcagtaaaacttgctgaaaaggtggtgtgttttttttaataatagaatataacattcggcctttgctcaaaagagctacagccaattattataaactagcactctaaaaacgagtgtaattcaaataaattgaaaacaccaaaaaaaaaaacttgatatcataggtagtagcagaaagacttgatattttgataattcgtggattaaaacgatcattgaattcatctgcaatataatgtattcaagcaaaagagaagtgtaagaatttgtaaccatgcaaaatgaaatgggattttttcgcaggcacaacgatccttttgctctgctactactgatatgctttgacattaacatccaacaatctagtggagaaacaaagatgaatttgcattgtttggctgacacagaacgggtgccgatggagccacggaggagcggtcgatgcagcatcgccggaggtggcagtggcagtggcggtacgtact

SEQ ID NO: 62231 - DNA, 18513 bp, Oryza sativa
cactatttacactctcacttaactgtgtacttctcatacctaatgtgaacacatccttcatgtaacattcagcccatttttctttcaccttgtatatactatccaaccaactttgcttgctcgcctttgcccttatggtgctaaatgcttgttcaaatgtttcctcatcttcgtactcaaacatacatgcactaaaatctgtgagaatactttgttcttcctcgttgtcttcggcagtctgtttgggagaattactggattcttcatcctcgagttcagctacatgtttaacagcattctgcatgatatggaaagtgcacaaaccatgccatgattctaaaaacactttcttaattgcttttcccattgcagaatcctgatcagtatagattgttttaggttgcttgccattatgtgcttttaggaaggtctcaaataaccacttgaaggactcatatgtctcatcatacagtagaacagcaccaaaaaccattgtttccctaaactgattgaacccaacaaatacaccaaaaggcctactttccttgtttgttccaaaagtagtgtcaaaactgacaacatcaccaaaatatgcatagtcagtgagcattttagcatcaacccagaatatgtttgctatttgctcctcactatccatctgcaatgcatattgaaatgatgggttcttagcaattttatcttgaaaatgcatgagcatgcttcctgcttgaccatataccatctctcgttggcgtttgccctgtaaataattcttggggtcacggagaatgtaattgagattaagtgagccaccaacttggatactagccaactgatgtgctgctttgggcccaatgcccgcatcgtcagctgtctcaatttcaaaaccttgtaactctgaaattttcctttgagacaccatcaagtgcgaggtttctggcaattgaaggatgtgattgtgttccaaaactagatcagccactttataattccctttctcctgatctagcacaacacccatgcgaacttgacaatcggttctcgtttcagctcttggacactttgttagatgatcccttttatcctcctttctatgaccctcatttgcacaaacatatctgcatgacctaacctttccatctgatttccttttgattgagtacctttttctaacctcgaaacctttttgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagctttacagacctgttttcttccatcttaaatatgcagattttgctggaggcttctttgatgaattattccaacactgtctaatggaggaggtggaagacaatcacataatttgctgaaaaaaaggaagagaagaggccatattacttcacctgtgcttgatcaacggtggaatccgtgctgaaaaaaaaggaagagaagggttcagatgatcgcctggcgctgtggcctcgtttggcgccaaaaaggcgagtgcgccgccaaaacgcatctgttcgcggtaaaaaggaataggagcgagacagacggcgctggagaacgaggcttgttggcccgcccttggcccagactcacaacgcgggcgtgcgctttttggggcggacggttcgatcaaacgtggacggctggatgacctcggctgctctctgccgtcgtgagggctgaagtcagaggagctgattccggaggggaggggggatctttgggggtttggattccgattccttgttgttgtgcagttgtagctcaactgcagcttgggcagttgggtcacagaaccacacgatctgaaacgggcggcccagattaagggcatgtttggcagggagctgcagagcccaacggggccctcgtttggcttatttagggaatatttgcaaacgaaaataatctgtgaataaaattttcatatgtgtgttctcggtggtttaaaagcaaaggctgaaaaataaactacgatgaaaaaaccctaaaatgaactctaaatttaaagttaaaaattaaaattttgtcttataagcataaacgaaatgataaagttgtaaagctttaaagaaaagtttaattggacccatatcattacaaatatgccatattaaaattcatgcaaaattaaaaccatgccatcgccatcacgttttccgtcatcatatataccaaaatacatctagaagtgggaccaacaaagtcagctctatctttttcctccaccaacctatcctctttattccccatctctcttcaccttgtttttaaatgcggtgcccagcgaagagggtgtgcctctatgtcatcgtcagcgaccaaacacttgtcagtccagatccaattgccccaccacccaagccaagccaagtaaaagctgcagaaacacacaaacatggtacatggtacaccggagacaggtgcacgaatggtggtcgcagctgctatccgtccccgcggaagtaggcctgcctgaccatgaacatccccatgggggcacgcatcaccggccagtacgacccgcgcgcacctccacgaccaccgctcgtcaccacacggcgccacccatgccgcgaggaatgctcttgccgcgtcggctctccctccctcccgcgttggctctccctctgtgaccagatgccaccaccgtgagcatgaggacgatgccgacgtcaggcagcaccaccatgatgatggttgtttccctctctgcgtagctcaatcttaggggtttagtaaaatttgctaaaaaaaagagaaagagagtagaatgagatgaaataatctgaaaaaagaaatatggaggagactcaactcatataattatatttagaagttagattcatatcaaataaaccctaagttaacggttgactattaacgcggccatcttgcactggtcataagcaaattcagagatcagtcacgagagaaaataaattacaatgtaaggccctgtttagttcccacacataaattttatactccatcacatcgaacatttgaatacctgcatgaaatagtaattataaggcttaaaaaataactaattgcacagattgcgactaatttgcgagacaaatcttttaatcctaattgctccatgatttgacaatgtggtgctacaataaacatttactaatgatggattaattaggcttaataaattcttctcgcggtttactaacggattctataattagttttttttattagtgcccgaatactcagtacgacaccctatataatacccgatgtgacacacaaaaactttacatccctatatctaaacaccccctaaataccatctgcatttactttgcatcataaccaatgctaaaagatcagccataacaattatgtacagcatattaaaaacagagagatttggagggagacggttttggtagatgaaagagggaattgcgatagtggatatgaagaggaaattatgagagcggacgttccttttagaagagtagagtccaaatatactcttgaacaagtaagcgtaacagtggagtactatggtggtgaacttaatggagtaagttatttttaagaagaattttttttagaagaggagttctatggtggcgaaattggagtgagttattttaagaagaaatttttagaatagtagaatctaaatatagtattgaacaagtagacgtaatagaagttctatgatggcgaagttaatgcagtaagttatttttaagtagaaaatatgtgcgtgttaaggattgaacatggaattttgaggttgaaaacacacattttttgccactgcactatcaagtatataactccagcatatcaactatgtccagcactttaaatcctcttccatgacaaatctgcgttatctaaaaaaatcaagcaagtttttgttgagcctcacacaaggctgcgttatctttaaaaaaaaaaaagcaagtcttttgagcattattaagctctcacgcagggcactaaagctctgttcgtttttgcttttagcgccatatttttcgaactactaaatgaaaaaaatattttatatatgtttttctaacaaataaaataaattatttttaagtttataatagttaatacggatgtccgtgccacccattacctcatctattccgatgttttaatgcgccctaaggctcatagtgctacactattgtattatatttttctcaatatattaattatgtcatccctagtgtatttttaagtcttaaaagggtatccatgatggtgccaaatcatctcataccgtattattcacttatggcgatagactattggatgtttttttttgattgaggtaaatgtaaatagtatggtgcatttgtcagctattaacacttttggatctaaaatgaacaagtgatatgataatgttatagggaatcactttgtttttcaaacgtaaacagaagatataaagtgtccactagtacgagccaaccctaatgtaagtgatcaacacaccccattaggaatgcagagtacccacctttatcactgttcatttcatgctttgaatcactatatctaacttagggtgtgtttagttcacgccaaaattggaggtttggttgaaattggaacgatgtgatggaaaagttggaaatttatgtgtgtagaaagttttgatgtgatggaaaaattaaaagtttaaagaaaaattttacaactaaatacggccttactttactgtccttccggtgtcgtaatgcagaggattcagatccattatgtcttgtgtttagtatttaggaaaagttacggagtctatttacaatcactttttttttctaaaaaaggtgctagattgtaaaaaaattgtacaaccgttttaccgctgctgacatgattgtatggttagcctttgttggtttgttattttttttttatgtaagcctttgttggtttgttgacaaatgacaactatctgcaggtatcgaacttaccgaagctgtaggggtaaacgatagaagtgatttcacactccaagaggcaaatttcgtgctgcagtaatgcttgcaacagggtcgacaggtgcatccatcttgttgcagtacgccagtacccactccatgagtgaagaaaaatcacctctcaaagagctctccactctccagagcgacaacaggaggaacaaagactacacctacaaaatcaagaaagagattttctctccctctctctcttggcttggaactgtggactcattcttcattcttcaatggccaatggaatttgttggataggaagaacctacaccagaaaaaaaaataaaaccttttgaatcaagagtgaagcagcatatttaaggtacgctttatgcttctactcccttcatttcatattctagcattgcccacattcatatagatattaatgaatctaaacacatatatctagattcattaacatctatataaatatgggcaatgctagaaagtcttataatatgaaacggaggaagtacttagttttaatgattaaaagcaacaagcccgagttgaccaaaacaatgaaagagctatcaactaattctaaattaagttctaaaattcaaaattatctaccaaaacgagtagttgagaactttctgttcaaaagaagaaaaaaaaagaacacatgaaaatatcagagcatatggatgccatttggcaactgcaacaatgcttaagaacaaaacggctagtgattcaatatcccaccaaatgtacgccttatattcatccatcttccatatgttcaaaaaaaaaaagatcaaaacattgtgcaggtgggaacaacccacgattcaccaccggcccggccagggtttgccagtcttcgcttccatgaaaccacagagctaaagcctaccaagtttaacaagcccaattttactattttttttttcacatgaagtgttcagatcactagcaagtttctgccatttggcttttctaggatgattacttagccagttagtatcaaaattttgaagcatgaggtacaaactatacatcaactcatctcgcagcagtgctcttcaagatgactgagagaagcagaaaataagcctgttgacttggttatctacttcttagagttccttcggtatcgttgacccttcagcgctgtcatcctgaggtgggaagagtagttccttgatgccgctaacaagatctttggtttcctggttgtgcttgatagagttcctttcataagtctgcagtgtattcacaattccagcacatcaacacaaacttcggcaacaatttcaactatcattaggtacaattcaaacaggcatgcagctattttgataactcgcgagacatatgtagatattgagtatataattactgagtacctctgaagaccacaagttatcgccttttctacggggaatgaggtgaacatgagtctgcaataatacatttctcttagaaaacttgatatgcacagacagacattctacattgagaagcttaattagacaaaacatctagggtgggcaattatagaaagtatgatgttttactcacgtgaaaaataacctgccctgctacctttccattgttgacaagcacattgaatgcatctgtacatgttacaaagattttataagtcaaagcaaagtaatatatgttggcgtaaagtagaaaaatattttggcatatacaagggaatcaaacacagtccaacacaagggaactatgtctcatctggcacatataaatatatcctcaacatcaaggagacaagggtttaacccaaaaaatagaatgaatgggatcagttctagcatttttgtttctaatatatatgatattcagttttagattgcttgaaaggtcaacttgagaaggaagaaacatagaatatgagttatctaatttatttatgtacaaaatgccacaaacaagactacattcatcattgcactgctaatatagtagtaatgtatagtctaacaaatatttaacatgtaggtggacaatgggaaacttggaaaggtcccgcacagacaatacttacaagacaaaatggggcagaaagataaagatagagctcagaagattttctacatagttttattaaactactttacacgagcaaagccacttttggcattctttagtgccatcagaggacagtgcaaaacaccagcataattgtcctaacaattgcaaagttgtaggcttgtagtgcacataccacattgagtagccttcacgattgcactggaaataagtgggagtttacaacatatagctgctattacctgtatttttttttaaaaaaaaaatcaaaccagagaaatttcccagttgtgtcaagtagaggtaaagcaaaacaagcagcatgcaatttctaatgactcctatcgtgcaatgtttactaattactatcaaacacagagtagacaacaaatggaatgaaacatataatgcttttataggggttacaagtaattactgagaagagaatatgccccaatacaagataataatttaacttcataggggtttgctaatattatcaataaaaaaaagtggtcaaagttgtattttgaagactgttccatgtccaaaaagacatgttctcgtggccagaatgggtatatggtaatctgcaaaatctctgtcctataaattttgttaaaatgtaaatgttcatgtacggtctgcataactatcaagatcattgtcatcataaccaaaacttacagatggcggtgttgcctgtagtgatggaaagtgacgttttggaatgatcagtgaatgcctacaattgtaaacagaaaggactgatcatgagttaagcgcaaaagcatcttggcatgtgaaaaggaaccaattcgttaaatctcagatagaaatactatataagggtagattcaatgcagaaattatttaatcagtcagttggcccaagctgcccagagttgccgcattattcaaaaatactttggaactaattcaccacattttatgcaatctatattcaatttgtaatagtttctattaacttttgttctgttctgtcaaaaacaggcattagaacataaatctgcaaccagtatcagaatcacaacaatgcaaacttttcttcataaaactgatatatcagctcttccatttcgtagtttaagtattaaagactaaagagtgttaaagaggtcaagacaagaaaggaccgagagacaactagtagagcagccgaagaggatggcttgaggagggaagcaagaataacatccattaagcaaaggctatgacaacagaggtctgaaactacagctctcagtgaggcacagacatttttatcattctgactctgatattctatctctaagcacaattattaggttaacatgaaaaacatcactggttcttccatgattggcttcccaatccttcaaatttacccctaaatattcagtttggcttcaatttggactagggattgacccagcaatatggccgatcatctcatccccacaatgatcatacagcaagccacatcaacagcaaactggccaaaaaaaagctatgttgtacaccactatcaaataggtaaattgaggtttcagcgagcagaaccattatcttgttcttttaagttttataagcaaagtagctatgattgcaaatacaataaaatatttgaccaatactgatgcaactttaaactttattatttcccatttttaaacggtcttaatactagggaccatgatatgaccaatggaccatcatactagactaactggcaacaaacatttggtggcatcaagcacatgctcaaattcgattgatgaaaaatgacattcacatttccaataattttggggaaaaacatgcaaattcatttctcacaaagggatctttacatcaagattaagatggcatacagactacaaaacattagttccttcacaattttacaaactgcaaaagcagaaaaaaatggttgatgtagtaagtatttaaattttccaacagatcaaataatcatgcccagacatccagcagtcgtattttacattgatcattaatgatgtcaaacaaatgcaacatcttaaatgtctcatacttattgaacacatgaatgtaaagcaccccaatacagcatagagtatgcacatccaagcagaaccaggagttaatcatgttgacctgacgcactatgttaaatttgtactctctccggtttcattttaattgacgttttggacaatgacacggtctacaagatatatctttaactttatttttctactataatatatataataaataaatgcatgtttacttttattatagtgctttaaaagacaaatctatatatgttgttctagttcctttaaactaaatatttttaaagttattgatggacaaagttataaaagtttgacctcaaccttgtccaaaacgttaattaatatggaaccggagggagtaatgaactagtaaaagcatcaatggcatgcaatttactgaactaccaaaaaccaaaaccaccataccggaccagtagcaatattacagcattgggagatgtacaattcaatttcatcaactgaaaatgagtacaagacgtaactatgcaaccatcacacaattgatgcatggtataacgtgttgccacgtgtgccttgcatacttcaacaacatggaaaatatggagtattattattttttgttcaacccaccacattagtgaaatgaaaaaaaaaacaaagtgccatctatattgcgcacatgaagaatacatgcagcacataatccaacacaatggagaagttagcgacgtaccatgcaggcatgcacaaatcacaaatgcacgatcagtttattcatccaaacggaatctagcacttattcattcatgcctactcatcggcgacacaatcaaaggtgttaaaactcaaccaaatttcactagaaatttaacaagagagacaaaacgagtcatggattttaaaagttgcagagacgaaatcgagagcgaggacacgcaactagctagcgccttacccagtgctcagtggtttggtgtccaggatgcacaagcacacatcgtcctcgtagagctgcaaccacacaaaaacaccaaaacgattagtgacgcgaaagaaaaaatgttgatgcgcagagaaggtgagagccttcaccgcacgaaatggcggagaaacgcgaattgaagaagcagagaaacccgagaccagagcagggacggtgactgagcagctgcgctgcgcgtgagtagtaccttgtaggctggcttgttgcccttcacgatctcgcagaacacgcagcgctggcctcccgaggtctccccgctcccgtcggcggcgcagggagacgcggcgaggccgcccgttccctccgcctcccgcacccgcaggtcgtggtggtggtggtggtggttgccccgccgcgcggccggcggcgcgcacgggcggaggtgggagaggagcaccccgaggcgccgctcctgcaccggcgcccccgagctcaccggcggcgacatggggcgcggcggaggcggcggcggcgcgcgcccgtgtgctttggagttcgtgcgcggcgcgaggagagagagagagagagagagagagcgtggttgcttcctcgtgtgtgtggtctctgcgttttatccggaagcgtggggccgtgtgggccacgtgggccccacggatatgtcactgacaggtgggtccaggaagtgtttgatcggcctcctgggccgcctggtgacctggtcgggcccaccggggtttgtctggtgctgcggaggcagagagttcgcgggggtgatacgtgttactgccactgacatgtggggtcagttttgtggaggtggggtccactgccagtgaggttgcgtgcttttttgagtggggaccatgcgctgttgcggaagacgccagtagcggttgcaaagcgtgacgtggaatacgggatactagctcatgctcactgacaggtgagagaggctcccatcggatggtctaataagccaaaaaaaaaaagctaaaatttaaattttcaagcttaattttaatattaattttaagatatttttaatatatttttttcaatattagcttttaagtcactaagaacacatttataaaagttttacctacaaattcatttttattttctaataagccaaacggcttattagaaaataagccaaaggatggtgactagagggatttcgttggctttcccttgcacgtggggcttattaaaaaaatgatactaataatgatattattttctactaatagatatcatagagttgtttttcttctttattttctgatgattttttttgtattttctttgttttcctttgaaaatctattagattctatgtgaatctctataataagatgatacttttctaaagtacagcctccatttcatattatatgtcatttgacttttctcttagctaaagttctttatgtttgactaagtttatcgaaaaaatatagcaacatctataacatgaaattagtttcattaaatttaacattaaatatattttgatacaatgtttgttttgtattgaaaatattgccatattttcctacaaaattagttaaacttaaataactttgactataatatttacttcataagtactccctccatcaaactttttaagccatgaataacaatattatcaaagtttcaaactttttgcttgaaattgaaaacctcaatgtcaaatcagtcttatttttttcaacatgtataaaattattctaaaagatattgagaaataggagataggttataatgcatccataaatcttacttcctccgtttcacaatgtaagtcattttagtattttccacattcatattaacaaaatgacttacattgtaaaatgacttacattgtgaaacggagggaataccaaatagttggatgcattatccaaaaaagaattgatagtaagctgaaccatttcaatagtttggagactaaagtttaaaggtttccggcgaaatatactcctaggtcagggagtaaatggacttctgtttttttccaaaggaaaagcataagttgtaattttccttgggctgggctagcccactactcatcagcccacgttaacacgcgttctccggtggccgagttcctcttcctctgcggcgtctccgcccgccgtctcgtctcgtttctcatctcaaaatttcgcgcctcgtcgccgcgccgcgcggcgggcatgtcttgacggaatcgcgtcgacgcacaggcaccgggggccatggcgccgacgcctcccgttccactccccaacccggcggggtcggcggcggcagcggttctgccccggccggcgtggaacaccaaccggaacctggtggtgacccacccgctgctctccctcctcgagtcgtgcgcctccttccgccgcctccttcagctccacgcgctcctcaccgtcacgggcctcgccgcgcaccgcttcccggcgtctcgcctcctcgccttctgcgcgctctccacgccgccgcgcctcgcccacgccgccgcgatcctcgcccgcgcatccccggggcccaacgcctacatgctcggcaccatgatgcggggcttcctccgcgcccgcctccccgcccgcgcgctgggcctcttccgccgcgtcgtccgggatcgcctccccgccgacgcgcgcacgttcgtcttcgcggtcaaggccgccgccgccgccgccgagtcggagcacggtggaaccccctcaggcggcgaggccatccactgcgcggccctcaagtgcgggttcgttggcgagagcgtgctcgtggggaacgcgctggtacacttctatgcgaaccacaagtcactggatgatgcaggcaaggtgttcgatgaaatgcctgagagggatgttgtctcttggacgacgctggtggatgggtatgcacgggcagggttggctgacgaggcatggaggctgttctgcaggatggttgttgttggaggcatgcggcctaacgcggtgacgctggtggctgctgtctccgcgattggtcagatggggttgctagcttttgggatcatgctgcacaagtatgtcacagagggtggtgttgctcggagtgtcaatttggataatgcgctggtggatatgtttgggaagtgtgggtgcgtgagatatgcaagggaggtttttgatggcatggaggttaaggatgtctactcctggacgagcatggttaatgcatacgctaagtgtggtgatttggaaagtgcagaacagctattcaaggatatgcccaggagaaatgtggtttcttggagttgcatgatcgcagcttactcacagttgaatcaacctgaagaagcagtatggttattcagggagatgattgcagcaagtgtggatccaattgatgctacccttgtgagtgttctgtcagcgtgtgctcagttaggttgcttggatcttggcaggtggatatatgagaactacattgtgagtaataagattgggcttactgttaatttaggtaatgcgctcattgatatgtttgcaaaatgtggggatgtaggtgaagcatcaaaattatttgatgagatggcagagaggaacgtagtgagttggaacactatgatcatggcccatgccgtgcatggtcagtctgaagaagctattcgtctctttgagcagttgaaaggagagaatattgtgcctgatcagatcactttcctgggattgcttgcttcatgcagtcacagtgggttagtttcggaaggacgacgatattttaaagaaatggaaatgttttataggattgaacccagggtagaacattatgcatgcatgattgatcttttgggtaaagttgggcttctggaagaggcatttgaagttgcaaggggtatgccgatggaagctgatgaggctggttggggtgctcttctaaatgcatgcagaatgcatgggaatgtagagattggtgcatgtgttgcagataagcttgtagaactggatccttcagacagtggaatctatgtacttatgagccaaatatatgcaagtaaaaataaatgggatcaggtgaagatgctgagaatgacgatgagagatagaggggtaaagaagaatcctggctgtagctctatcgaggtcgaaggaaaattccacgactttttggtggcagatgtttcacatgcatgttcagaagaaatctattcagcattgaagaatatttacttccatttaaaacaggaaggttatgttcccccaacttgactgtgctgaaaactccttgttcttcgtcattcatgaacctcttaatagccttcactgtagaaggaaaaggaaattctaccagaagacaagattttactaatctaatgctcagcttcctgctgacagacttttattaatgccctaccttacgttcatgaataatggcctggagctgagctggaagtgagataaaatttgtactgtcttcatagaggtatatgtcaaatgggcagaaaaaaggtagtgcaaatctgatgaaggattgcatgtactgtcttcatagagatgtatgtcatgcgatgaggctattcttgatttttgtaagatatgtcatggcaaggaactatagggaacttgattgaacccaggtttctttcttttcctttttcttataaacaaactgtaagttctcattgaggttcttgttatctctgtttttataatgtaaacactctgtttattatgcagacagttttagatggcattgctacggagcttttactgggtgaaccagatcctctgcaatccccttaattcacatccaggaaagccttcttgaggtgatcagttccaggtatattgcatgagatttttctactagaatggttatgaggatggaaaccatataactaatgctaccgtatgctgttcccccatttttgtgtgataataaatgcatctatttggcatggaaaagaaccatacgaaattaagaatcaacaaactctgataccctgtagcattgatatgtttagggttaataattggcttaacgattacaaagcacactgatggaataatatcattctgattctgtgcctgctttactgttctgcttgaaggtgtgcactgatcatttagatactttgtaaatgccacacctgtagagtgtagacttgtactttactgactgtttgatattgacaagaccactcatgaatcgacttctcattttctcttggaccattagtgcagtaacaatcgtctagtacctctgcagtattagttggttatggctgagcaagttcgttccagtcataaatgtgaactaataagctgttcccttctctgcggtgacctagattgtgtacccctgaaggcctatccagattcatggatgtacaactgaaaccacctaactttcttgccaacaagccgcttaatatggtataaacgccaaaaccccaattgaatgctgcctttgcggcgtatttacacccatctccggtacattgtggcaccacagatcacttcacagaaacatgtcaaccattcatgggttgcaactccaggttcactgtgcacaatttaacccggcacatgttcactgctcaccaccaccaccaccatctagctcataaatcatcttctattctgccacatagatgaaacacctagcttaaaatgttctgtgacaaagaaacagaacttttctacctagagccaaaggtgtgagagcagatgatccacgccctgattgctggggaaataggcgatgagaatggtaggccgtgtggtgtactggcctgacgacctgcttggacatgtccacatgaagattggacgccttgccttccctgggggagtgccctggctttagtttctcaggactgatgtatgcatagctttgcgatctgcacttgcacactgcaacaactccctccctccccacctagctaggacccttgaactttttgctagctttatgcagtatcactgtagttcaggctgttatcctctcgagtcagtgcttaaacccccgtgtgttttggggatgggaggcaagggaaaagtgatcggatagaatgtgctacaaagggagtagtaggtgtggcattcatggccctcttcactcggcccaaatctaccctctaacagtttgcattcttgagccatggcagatcgacagtcatggcctgcttgcctcccgctgcggcgccgaagagctcggcaccacccttccttaatggagaagacgagagcaaggacgatacattcactgcccagctgattgcctcagtttcattgaagccagcagagcagcgcagagctgtactgctgcgcggtgcagtgtactcggatcctaagccatggcgatgctgcacccgtcgtcctcttctccaagctgcaacagtaagtatactcgcacatatagtggaaagcattcatctctagtaactagctagcacatctatcaccattactattaactaattgattgattaataataatacatttatattgcctcctcctcaccctcaccattctatgtcaaagtccctggattaacatagtgatcaatagtccttccctcaaacagtactaattgcccacgtgctactagggttttttctttctacagccacctgccctttgagcacgggggcatgcatgcaagcaagcaagcaccaactgctagctagactgccctaatggagaaggctcaaggtctccagcggcttgacggcgtcgagcttgcggtgcggcagggccggcggcggtggcgccaacggctgcacgaacttgcagttgggacaggatggggaggacttgcagagcatgacgaggaggtggcaattgacacaaggcacggccaccatgttgcctccaggtccagagctgacgatggtgccacccttctttgtctcctctgcaacaacagcaacagcaactggagtagcagcagctccggtgcttcctccatcgataatggtggggacgacgacgacggttggctgggtagtcgagatgttgagctccaggttcacgctctgctccttgggcctgatccagcttttcttcaaggtcttcctgttcaggtaatacatccttccagactgacagaatcatatatacacatggcattagaaaagataaacaacggggactattacatcaaatgataagccaatcatggcagcatcatatcatacaacaagttttgcatcttttggacgttgagcaagtagctagatatcacaagtggcatcatgcacgttgaattaagctgcatgcgttgcccaccaatatccatgtgggtgctgctggtctatctagttgctctgctacttctgccagctcaatattacgtcagtttcacgtacgcacgtgccatggcggtggcaggtggacacttctaagaataggagttgcacgccataaattatatatttcttaaaactattgtttcagagccaggagctatagcttgcatcaaggcataaacacacgacaagataagctaattataatactatatatgaagtataatgtgcaatgtatcatgcttatacttaactagctagtagtaggaatattacaatcattaacaagtctctgcactaaattgtttttcataactatatgtttagatgttagtgtgatggagaggaactcacttgcaggtcaaggcactgctcccagtcgaggggcagggggtcattgagctggagctccaggttggcgtgcgacacgggctcctcccaggtgaagtgcttcctcttcttcctggagctgccgtctgactccgacgatgagctcttggtgctcttggtggtggaggagacgaagcctggcgccggccacgtcggccctagtgagagctccggctgcagctccatcctcttcacactcaggtacttctccactctaaggaattcagtggtcatcttggctgatgatgctagctcctgctcttatatacacacacaagtagttctagggtgtgagctcttgagagctagttgtagtactaagagatggaggagaagagaattcagtggagggaggggggactgcttctcttctacaatgggcttttgattgatggggtcatgcaggggagggcgtggacactaaagaagggttcttaaatggccttcatccaaccccattaaggggagggcaggccgggcattgaagatgacaagtagagtgaccttaaatgactcaaatctctccacctcctccccatttaaggcggccttgcgctgctctacatgcccggactgtacacgtcataatgccacacccagcccaggagagccaccacaaaatctacaaggccccttgcttgccttgtaagttgttgtgtagggg

SEQ ID NO: 62232 - DNA, 14564 bp, Oryza sativa
atagtaagtgacataccatacataaatagttaagtgacatagtgagttacaaattagaaaccttactaccgaaaatactaattgagaaacatatcttttttgtaccttcttacctacattaataaatactaaatacataattaatatttaaataaaaatattattatataatatattaatataaactaattaaaaaataaaaataatttattaaaatataatacttaaaaataataaaaaaaaaaataaaaaaaagttacaataaaaactcaaaatcccttgtatcgtgggacggagggagtatataaattaacaagtcaatcatggagcgcttttgcatgcatgcagcgcgcatgtggaggagagcatatatatatgcttctacgtgcaaatgctaaagaacccatcacaattttttgggtgaaagaactttgaaatctatctagtatatggtgttattacactatagctgtactgtaatgacattttaatctctatataacttacaatgtactccgtacaggatatatagaattaatgtatctttgtttccaatacttatgtaaaatctatatataaattataatacaaaatactcatagaaattatatatgttagttttagtactgtataaaagttaaattttgaaagtgttttaaaataagagataaataactagcctaatattgtccaaataatctacctcaattataggtaaaaggaagaatctatataagaaggtttctaaggtaaaaggtacaaataatctatctcaattatatttctaatgtatgcagactcatccaaaactgctttcgatgagtgacatttcacagctaagaatactgcgaaaaatataatttttggcggaaaagagagacatatgtacacatgtatctccagtttatctaaacaaaggaagtcgtgaagaaaaaaggaagtactactccgctgatgttagccagctcgtgaaatcacagtgttgagaagataagcattaagcattgacgagcctcctagctctctatagaaggagtcagtctagctgaagagaacacaccagagaagcaagagtagtagtttctcctgcctctctaggcagttttacccaaaaagaacacttctctatagatacaaggaccaccggatgcctatacaagatgcaagctaagaataagaactaccaaagaggtttctcaacaaacaaacaatgatatataagaaagttacttcatattaaacaagtaagcttacatacggttttctctttcgggaccccaaagaaaggtacagacaagttttctcaccttagaccgtttatataacatttgttgctcccaatatactagaaaggtaaattattaacattactacaggactaagaggctgaaggttcttaaagactaagctagaggatcttgcttctctggtctgtgctctttagctggaccaactccgtttatagaggctagagaaggaggctttgtcggtgcttcgtgcttatcttctcaacactgtaatttcacgagctggctaacatcacagagtagcacttccttttttttttcttcacggcttccttcatttagctaaagtggagacaactttgtacatatgtctcactttttcggccgaaagttatattcttcacaatattcttagcagtgaaatgtcactcaccgaaagaattttgtgatgaatctgcaaacgttatcactctttgcttgtagtgttcttctgaactattcttccctttacccttgaaatatagttgaggtagtttacttgtagactattaggcttgccacccctgaatgattgataaatccttatcaattgaacctttcttatatattgaactttgaaatctatctactacctatatagtgttagggggcaattgcgtttttgatcctattttaaggtctaactatcaatttaaccctattttcctaagtttgctcttttgactctcttttttaaaaacgaacgttcggtctggccctattccgttaaggcaacgtaacagtgttaattcagaaaaaaatagcctttatgcccccactcattttcatttgactctactttttcaaagtgcttgcctaattttgtgtatttttatctaaaaatgtgacaatttttttactaacataagtgacaaatttaacttaggtttgagtgatttgacaattttgaaatagatctaacttcttttggacgaaattcacttagatttgatatatttttgagaaacttaacatacatttgacagatttttgataaatttcacaaaaaaaaattacataatccctccagcaccagcagcatgccgtcctcctgaccaggagagcaccgggcaagaacaaagagaggcgagagagagatggagagcagcagcaacagcaaaaacaaagcagcaaaattctagcggccagcgacggcgagctcccgcgccgcgcgcctccctacgcgccctcccgcgccgcgcgcctccttccgcggccggcggcggcgagctcccgggccgctcgcctcccttcgcgccccgcgccgtgcgcttcctcccgcgcgtgcgtctccttccgtgcttggcggcggcggcgggctcccgcgccacgcgcctccttcgcttcgcacaccgcggcggcgaggtcccgcgactccctccttccgcgcggagcacgccgagagagatggggttgagagtgactggataggattgggagtgagatgatagtgttgagttcaggggtattttggtcagtttgaataataatttgatcttttttttttctaaatgaaaccctaacggtgtaactttttaaaaagcagaatcaaataagcaaactacgaaaagtagggttagattggtagttagactctaaaatagggtcaaatgagcaattgtcccatagtgttattacactatatagctgtactgtaataacattttaatctctataaaacttactgtataatccgtacaagatatatagatttttcgtttgtttctagtacttatgtaaaatttatatataaattataatacaatatagttatataaattacgttaattttagtgtggcgtaatatagttaatttttgatagttttttaaaagaaaccgtcgcaagatttttcttgatagtcctacttgtgtggcgatagctcacatgtggaagtatgatcgggtctggccccattaacagatttgtggagccatcgtttctcttattcatggaataagcgaaacgacgtatttataaacgaaaagtaatttgtgaataaaacttttatatacgtgttcttagcgatctaaaagcaaaggctgaaaaataaacttcgatgaaaaaaccttaaaataagtttcaaatttaaggttgaaaattttaattttggctgataagtataagcataagcgaaaaaatgaggtccttgagctgtctttcatttttatttttttcctggaaaaagtttgtttttcatccctcaatcatatgacaagtttaattaattcacatctcttaaccgtagaaccaggtataaagactcgcttaacgattgaaaaccggataaatttacctccctacggtggcttccctctcacctcggctggccgtggctcctaccctccttcccggggttggaaatttcggatgaaattacttcaattttttcatgaattttggtaatacttgttcaaattcaactaaattttatttaacatttcggaaattttgaatcgaattttttaaaatttcagtatttcggtgaggcccgatcagatcggcataaccaataggatcaaccctgctccttctgcggctcgctcaactggcaggggcaacgacactggcgcggaggtcagcgacagcgagaatgaagggatgcacgtacgtgtcaaggtgtgagccgaggccgcgcgctcggttcccgctgctgctcgctttcctacggagaggagccaccgacgccgaggcccttccttcccgccaatagccactgccgaggagaagcagtcgtcgtcgcgccgggatggggatcgaggtgggtgcggccgtcgtgctcactacttgctgtcgatgcccctgcgcactcaaccccacgaaggtgacagatgaacacgagcaggaggccgatggcagcggcctcggagacgctgacatagagcaagaggagccatcaccaccggcgcgcggagctactagctgctggcctcgagcgcgacgaggaagttgtacgggaatgccgtggaggacacgaggatcacgccgtcgagaacttcggccgccacagtgcgcctacgcgtcttaggtcgtcacgggtggcggcggcgggaaccttcaattcccgccagcagcgccgtgttggctgtcgctcattatcgtagcaaaagtcgctccgcgaggtcgagctcttcacggcaaagacagtgagcatgcacacgcttgcttgcttgcttggtgccaaccagtatgtcagtggggatcgaactgaagatgggttgttgttgccttgttggtctgattgttgaacagctccatttggggtttttatttgtatcttcttcttttcgattgtaatgcaatgtaagcgtcacctacctgccatgttggacgaatacctggtcgatcaatctgccacgtaagtaccatattagataaaatcatctcgcaaaccatcgagggagatgaattgatccggtttctaaagttgagagaatttttatatcctgtattgtgatcgaggcacaacaattggactggacatataattaccatcgaggagatgaatcgatccggtttctaaagttgagagaatttttatatcctgtatcgtgatcgaggcacaacaattggactggacataattaagggacgcagaatcgacttaattcttttttttccctctgtcacagggctgactcagcatttcaagcccaaacacagttgctttgcccctaaaaagaagctatataataacacacctaataaactaagtgacgtatacgtaaccttgggtaatgtacactgttggagaaaggggctttactcccggttcgtaacccccctatagttccggttttcaaaccgggactaccaatccgggactaaagatcactatctttagtcccgggtaaaaaaaaccgggagtaaaaaatgtatctttagtcccggttagtgttaccaaccgggactaaagatagagctagcctagctagatcggttactttattattattttcttttcttcattgtgtttttaatatattgatttcactccatccccatcccaaaatcccaaataaattatccccaaatccccaaatcggccatattcaaatagatcacaaaatcttaaaacaaaatttcatcataacttctacaaaattcatcacaaatacatcacatatttacggacatcacacacaaatcaaatacacagattcgaatcacaaattcttaaaaaaaagaaaaataacacaggctgctggccactgccgcgccggccgccgcgaggccccccggtccgccgcagcgccgtccgccgccgcgaggccgcacaggcctccgcccgttggcgccccgcccgccgcgggaaggccgccgcccgggcttgtgccccgccacgccgcaaggccgccggccgcccgatctatcagtgggatgatgggtagggaaggagaggagttagaggagagaagttagagaggaggaagaggaagggatgatgggggagggaagttgaggagttagaggagaggaggaggaagaggaagagatgggatgaagagataaggttaggagaggaagaggtgaagagataaggctgcccatctcctcctcctcctcgatctcgcagatggcagatgcctcatactctccgccacgatcttttgttccggttggttttaccaaccgggactaaaaatagatctttagtcctggttggtaacaccaaccgggactaaagatagtatgcatcttttttcccggttggtgttaccaaccgggactagaaatagatctttagtcccggttggtacattaaaaagcagctctaaacttttgaatcgggactaaaaataatttttaatctcggtttttattacaaccaggactattgtagattttggccgaccgagtaaagatggtttctccataagtggtaaccagggtcaatagtctgaacttggccggggagaggacgttaagatgaatcaaacaatatcagtttcaatcaatttgtgaccagacaatggagcttatcatacaacagacgcagcacacgtacatgttgtgtggtttgcaggcctagttctagtgcacaactgctgaccaaaaaagttcatgaacaaccctctccggcaccggtaggcctccccacacacatgcacacgagcggctttattttattggagccgccgtttgcagggcggacatacgtatacttacgggtgcccagaaattcagtttagaaaattttgagctatagtttatctattttcatcatatatatattatgttagtttaaacttagacatctgtatcaagtaaagcaagcgagtggacagtaaaccatatcaacttgtctatgatggcctatctatgacagactgaagtagctatcacagatgacatcatgtctgacgggttaaactaaaacttattgtagataaggctcaaggggatgactcgtcacaggtaagaactcatctatgacagtatgacgggcctatatcagaacacagcacatgacatctctaatgggcttacatataggcccgtcacaggtgaccttcaacctgtggtgggtgttaagtttgcaacctatcaaagatgagatatctcatctcaaacgagttaacatcttatattcgtcagaaataacttaaaaccctcccacccctcatccccgcacctaccccaccccctgtgccccttctcctcccgtcctcatcttcatgtctcatcttcctctcatcactctctccttcacatctccagccgacgcctcccgaccgctggccaccggtgcctcccccgtctcctgaccaccggctgccggatctgctcggatctgcctacggggcacggatccgtccatcgcggcctctcccccaaaggttagccaccttctcctcagccaccccaccgtcggccgcaggatttggactcaacgagtttgggggacacggatctgatggcagccgccttcctactggccactggatctcgtggacttatgggacgcatatccggccaccgcggcctctccccccgaccactagccgccttctcctccgccacctgactgtcaggcgccagatcgggcctccgccacctccattccatagccggcgtccgcggcctcccctcctcccccgattcttcctctgccaccctaccggcagcagctggatcccccaaccgaccgccagcatcctccaccgtctcctttacccaagagcgctgccgccgtttctgactcttgtaggttatgcttgatttttcttatcttgcaaattttcattgccaaatttcagattgggttatattctcggttgcttgtatggatttgtagtttgttaagatggggattattactggtgtgatgtatattgtcactcaagttgtgtaatctgtgatgtacttgtgtggatgtgcttcatgtgtagctatatctctgatgttaacagatatgtcaataaagcgcaaagttacggtgtcttgcatcttgagatgttgcttcatgtcgtgagctatgggtggtgaattaaacctgtcagagatgtctatcacctcagatggcaggaaagagccacccatcacaagtgactctcatctgtgacgggttatttttatgtggcccgttagaggtgttaatcatcattgacaggcttccacccgttagagatgagatgcagtcatcactgccactgatcattgatgcgagagccgaacccgtcagaggtgatgatatgggcctgtcagtaatgtgcggacccagtgtagtgggaactcccctcgttttattatagctcccccgctgatgcttggatcgatccggcccgtcccaccccttggacgtacacagtgaggcgattttgctagatatttgtcatcaaatttctccccctaatatttatcagatgtaattacagtacaatcgtagtgtaattacactgtaacttacatgtaattacaatgtaactataatgtaacttatatgtaactttcaagaatctctcagtaacatgttatttcagtaaaatagaggtcctgggaataaattctttcacatatgtgtgtgctgtgatttttttattcctcaccagaacaaatcttgtaatagatctaactattcaaaattacgtgaaacttacatacaagttacactgtagttatatgtaagttacagtgtaattacatacaagttacagtgtaattacactatgattgtactataattacatctgtcaaatttttagtagaaaatttatcgacaaatgtataggtggtccccagtgaggtactgacgcacaaaacaagtactagtactatttgactcagatgacacacagtgtgtacgaattaaagttgagcgtatatgtaaattataaaactacatcggtgcagtaacttggaatgtaaaacatgcattcacaaggtatacatctgataaacaaaatgcaatgttgtttgtacacaacatattaacagagcgaaatggagcgtgcttgtgcgtagcatatatcgagcaaaaacccaatgtaaattaacgatatgtgcatcgcctgcatcgcatgcatgcctgctcatcaatacgagagcaggctcacggcgaccaccgcggtcacgacccctgcaaacgccgccgcccatcccgccggcgccatcctgccggcggccgccgtcgccgtggcgtccacctccttcgacggcgcttcgtcaggcgccgccgccaccgacgacgacgacgcggtctgcggcttcccgtgcttccccgccgccgcgggcgcgtcggcggcgccgtagtccttcttggcgccggggccgaacatgtcgggcgggaggaggacggcgtcgagcgagtacacggcgagcgggtggccgtcgcggagcggcctcccgagctcggcctccaccaccccggacgagacgcgcaccctgtcctcgccggcggtggtgacgttgacggtgcagacgccgcgctggccggaggcctgggtgcgcaccgggttggtggtggtctcgaacgtgacgaagccgtagtacctggggaggacgtggtacagcaccagctccgcctgcgcctgcgcgtccatctggttgagcgtccccggccggagccgcccgaacgcggcgtccgtcggcgccagcaccgtcagcccgtcgccgttccggtcgttgttcagcaggctgctcacctgcgacgtcacctccgtgtccttgagcagccggacgaaggtgttgtagtgcccggccttcgtcaggatctccgtcaggttgaggggccccgtcggtgccgggcttggcgcttcgccggcgccggagacgacgacgacggagacggtggctagggttagggacagtacaagaaatactgtgcttggggaggaagccattttggatgcttaattaatttgctttctgtatagctactactgtactgtgcggtgttagggctggggtttaagtagggagtgagagttggagaaggagggctttcaataatttcttgcagttaaataacggccaaactgttggttcgaccatcctttttctagttggagcgggagacgtctccagttttgttgtggttatgttggtggtgcatgcttatccatgaaacatatacggagaggggaccaatagtgaggtttgctttgccttttcatcttctgatcagaataagctaacgatcaataatactatactaatgatagggcgccatatattgcatgatggatttattgcgatatattgtatttttctatatgcctctatgtgctagtagctctttgatgttgtaacttccaagtgtcaagctgggctactatagctaccgtactatatcgtgtgatttatgaattagataggaacattcgtgcatgcatgtttatattctgcattttgtagtgggcatgatcaatgacagtaacggatgtttgcgccatattttctcgaaaggacagctgacctagacagtcacattaaccacattgtttgttaagactaacggcatatgtaccggtacatccgtactttttacttgctgttatatttggacatcgccacttcaatacacttaaggctgaaaaacagacagcgacagcagcagcagcaataataataataataatacaaaattatccgtctgaacttacgcacttgttcaatttagccctctaaattaattatagaaccacatttttaaccctcaatacttgtaaacaagagtaaagtaacgaggtgaacagtgggattttacgatgaacatgtttttttttttggctatttgagtcgatcagaccgcgcagtgtgcgctggtcagatcagggttgtgcggatggtcagatcaggtaactcaacggtctaacaggttagctcatgtatggagttagcttccagctgtttagttggatactcatgattacttcatgttatgacttctatatgattactatgcatatgtaatactattgtcagctaatattaggttaagttgagaaagcacttgtgcttggctagtttagattataaatcggataaatagtttagaagaaaaaaaacttttaaagtgcggaagatggaaatatgagaagttagctaactgagctgcacaagggtcttatccttttttaaagagcaattttactgtttttgaggaggtaccatgaggtatcactttttctattgtaaatttggtacctcttggtacctaggtactatgaggtaccatgaggtaccaaattttacactaaatttttggtacctcatgttacctcctcaagaaccgtagatttgctcttttttaaattgtcgcacaaagagactgagggggcagtggctatgcatgtaggtattcatgtatgagagagcatgcgtgtaatgtgtagtagtggacacccgatttttcctcttaagatcaggcgctcgagttgcattcgccaagttttgatttttggtctaccattcatcactcctctagtaggatttctccttgtgtttcgatcctaagcttctcgcgcgcttgccacccctccctccaatggcggtgccggcctctcccagccgcagcgatcggcaatggtttagttgctgccctgctgcccctctccacgacatactggtccccacagtacgtccctctccgcgcagctctgaaccaatccctctttcttggcaggaggacacagggaaggcaggggacgggatccggcggcagcaccatcttcttcggtgatggtggaggtgtcgtgcacacacttcaggtcatggatgagtcaactcgtcacaggaggactggtggatcgagtaaatcgaacttattgcaaaacatcaagcggtaattcggacttcttccaataaaaatccccaaaattaactctaaaattagttttgaaaattcaaaattgatatgtggctgataaccaaccagcagaccatgtgagagcctcacatcattgatttatgacctgttactccatccgtcccaataatatataaacattgctaaatagtctaaaggaagtgcatttatttggattcggcttctagctttaataggagaaattaagggtgaagaagaaaattatgataacacttattaaatgaagaggtgttcaggagtaggagtgtagtggtaaaatagggtgaaaatcaattggatcatgattaagatgaaaattaaattgcctgtactagtgaacattgaaatcccaaaattatattttgggacatagggagttatttttttatttaaaatcttcagttaaattactaagatactcaatagagagtccaaggtactgaagaaaatgaaatatcatataattattgtccttgacttttagaattattaaagcttaagaaaaactaaaattgagactacaggcggagtacaacttggtctagtccacgttagttacaacttactaactattaattaactttttttcttttttgagaaagagaggattcctccccgtgttattaacaaactcatcaagcgactactaactattaacttataaatttaatttaataactattaaatcaataaatattaccaaagcgtcactaggatgagtatacatattattaaatttgaaattttagatatttaaagaaataaaaaattagtttatgatagcactccaaaattaagagtatgcacaattaactttatatttattgtatatgtttaaaataattaagttatggtattacaaaaatcattagagtgaattttcaatacaactttgcaggtatttttgaagtagtaattaaattaaattgttttgttcttaagccttaaagttttcatgtatacaaaatatgcaatgcaaatacactactacataaatgtttttgctagacgagaccctggttaggttgcagacgaaccataactgcccgcgtttgtaaaattcggtcttcattttcgcatacggcatcttaagatgcccgcatgcaaaaatcgattttcgtaaatagacaacttaaggagctgcatgcgaaaataagaccatttttgcatgcggacctcttgagggaccgcatgcaaaaatatctcatttttcttttttcccatccacttcaatttttttacccatctcctgtcaagatatttcaatcctctcctccactcctcgcttcctctcctctcctcaatctctctctccctccaagtgggcggcgacaggcgggcggcggcgccaccgccatccccttcctcattgacgatgacaacgacgacgacgaggaggcgaccagctccatccacaccccccccctgacgctgccaccgctgacgacaaggaggcgacaacagtggtcgacgtcgggcggcaggcctcctcctacccatatctggcaacggtggtgagagcggtcggcggctcagcggtaggagcagcggcggtgggagcggacggtggcggctttcacgatggtgatttgcctcctcccgcccggatccagaagtggcgggcctcctgctgcctggatccgacagcaggaacggcagtggtgggagcggacggcagcggcggctcgcctcctcccgcccagatccgacggtggcaggcctcctcccgcctagattcggcagcgggagcggacggcaatgggagcagagggcacgacgccggcactcggctgacgtgattttttttttggatttttatttttgcatgcggcccacgtaagcaactacatgcgaaaatagcaatttagcatgcgggtgcaacgccctcatgcgaaaatcactatttttgcagaccttctcgtgcagacggcctggccatccgcttgcaaaaaccaaatctggctgtctgaaaaatctttttttaagtattgatagtctatacaaatgcaacgtgtgttgtccgccgactagtctaactgtaatagttttacattgggaagtccatcgagttttttaagtattgatagtctatacaaatgcaacgtgtgttgtccgacgactagtctaactgtaatagttttacattgggaagtccatcgaaccagatcgagaccaaactcgcgttatttttttaggcttgttagctagtgtcaagacaagataagttggttgtgtatgattaattaaatattagttattataaacttgaaaaatatgttttatttaattttttaaaaagctctatatagaaaaactattgtagtaggtcaggaagtgtgtttatagaaaaggagtggtagctgttaaatatgtgatccgaattttgggcccataatatattcggattagtttcctagtaggagtcctattaggtgtctttctattatcccctatatatactcttgtaagccgtacgggaaggggtgacgttcctattatgattcccctacgtttgtaatcatctcctctatagtgatcattgctggtcggcgcccgtggtttttcccgcaagggttttccacgtaaaattcgtgtctccgttgtgcatatatttttataacaagtggtataatagcattggagattcgatcaacaactatcccatcgtcgttctgcaattcggcgagattatccaccagcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacggatcccaaagtgaagaaaaagtagggcaagtcagtcagagccatcatcgccctgttctgtgaattcaatttcacgttgagaattgctatggccacct

SEQ ID NO: 62233 - DNA, 614 bp, Oryza sativa
tttgtttataaccagactgagccacaaactaaaccttacccactagacatgtggaagtacggtagtgctttgcaacagaggcccgaagaccggcccttatatggccgaggtgctactatcaaaaccatgcaccccgagcccagcctaaaaccattttggggattttgaatgagggggaggtgtgaatccaattccacaataatccaacaattccatagtgtccaggtgataagagtattcccaaggtctagagttgtaaaaccacctaatgttgcctaattaaccagcgaagcagctacctaaaatcatactagtggtaccatgagtggagtgtccactagttggggttttgtttaatctagggtgaacaaggtaataataacaataacaataataaggtcataacaaaggtaactaggcatggctagataaaaacagtgataacgcgggaatttaagaaaagcgataatgcaataatttaaatcaaaataattttataaactgggattcaatatgctcaaggataatgtgacttgccttgctcgctttcccaaacgtcggcttcaacctccacgaagagcggatcttccgaagctgcagcgtctacacgacca

SEQ ID NO: 62234 - DNA, 17250 bp, Oryza sativa
agaaaaggaaaaaggattttccctggaattaacaattgcactttagtgatttttaattggttaaaaattatttctagagctctgaaaattccactaaaaatcctgttaatgaattttgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacaaacctaccccccttaaacggaatctcggccccgagattcggtggagctggtgaagaggtacggatgggcggctttcaactcatcttccctttcccaggtcgcttcctcttccgaatgatgactccactgaactcggcaaaaccgggtgaccttgtttctggttctcctttcgctagtgtcaagtatgtgaaccggcttctccacatatgttaggtcctcttggatatcaatgtgttccgaatcagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtccccatctcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttccttgaggtcttgatacattttggtgctgcctgggtgaatggagtactgggtctgatgagcctcggtgagtatcagatccttcagttctttgtcgtcaggtacacacaatctttctcccatccagattgtgccatgctcatcttcatggaaatcccgagcctttccgactctcatgttctttttcagttctgctatttccggatcatttacttgagcggctctgacttgatccacgagcgtaggccgtgcctccaaagcggctacaaacccgtgttcaacaattcccatgttgagatgttcaaattcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcacaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataactagccagtcctagaaaactccgaatctgcgacacggtctttggtggggtccattttgtaactgactccacgttcgatggatcaactgccacaccctgggctgtaatgacatggcccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaacaccacaacaaacttgtccaaaaattctatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctctgctaattcgttggccgccatcctgtatggtctcttgtaaattggagcggttcccggtgccaagtcaatccggaattcaatctccctcttgggtggcatggtagtgaggtcttcggggaacacttccggatactcgcagactatgggtatatcttccaattttctcaagttcttccccacggtgtccactgggatttccgtttcaatttgattcaaggagactccttgctttggtgagtctggtgatttgtacactacggtttctcccttctcgttggtcaaggtgactgtgcgactcgcacaatcgatgacccccttaaacttggtcagccaatccatcccaagaatgacatctaggtctttggattcgagaagaatgaggttggctagaaatggtgatctttggatttctattagcactgaagggctaaaactgactgaggttgaactatttcccggggtacgaaccctcattggtgtgctaagctcgtctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactaccttggttggaccggaattgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcgtggaggtactctgtcacagtcatgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgggggggagggggaccaaactgctggtgctgctgttcggcgtgctgcatcatcctctgatgcatctgctggtgctgctgctgcatctgctgcatcatggctgccatcatctgagtctgatgtgccataacttgggcaagcgtcggattctcgggaagtggtggtggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaaacacttaaaagggcaagcaaatatccttattaagacagccatatcataggcacatgatatcgaccgccgactgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctgagcgactcctggagcctgacggatcggtctcgccgctgccgctgggagtagcagacagccaacctccggtaccactggctgaacctctggcggctgatgctggagcgaaggagagagtgaacgcgggagttggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcgtgatctgctgtgcctcctgatgcctcgaccgccatgttagcgaggcaagtccccacgtagccatggacctccaagcggacacggtaaggaagctcgccactgagcggtgggatggtcgtgtattccggcgcgtcggggtagcccactaccagtgtcatgcgtgccaactctgccacgaaatcaatcatgccttctccgcggtggttgggtgggtgaccggccatctagagaagacaaagaagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttctccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcaggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaacgtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctggaggtacctcggcgactatttcgaagtacaccggagcgtcggagggatcggaatctagcgacatacaaagcaaacattgcaaacaggctataagactactgaaacagagaacaaaaccatttttaatggattctacacatttttcttgatttactgagatttgaatgggattaaacggagctcggatgaattagatatgaattttagaaaattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaagaatggggcggcggcgccacgtggcgaccggaccggcggccccgatctacccaagggtagatcggacggcggcgcgggacctctcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagatggaccatggcgatcgggatccatggccgaaggcggcggtagaggtggcgctcacccgtgcgcgtggagatgagggctccggcgacgaacctcgacggatgaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaaaaggggatgggggaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgggccggcccagtaagggaggggaaggaagggagaagtgggccgacggcccacttgacaaaaaggagggaaaagagaggaaaaaggaaaagaaaaggaaaaaggattttccctggaattaacaattgcactttagtgatttttaattggttaaaaattatttctagagctctgaaaattccactaaaaatcctgttaatgaatttcgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacatccctcatgataaagatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagttggcggttacacgcatctctttgtggccattgacaaattctccaagtggattgaagctaaaccggttgtcacaatcacagcagataatgctcgagacttcttcatcaacattgtgcatagatttggagtgcccaatcggatcattaccgataatggcacacaattcaccggtggagtttttaaagacttttgtgaagactttggaattaagatttgctatgcctcagtggcacaccccatgagcaatggacaggtggagcgagccaatggcatgatacttcaagggattaaagcgcgtgtttttgaccggctaagaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgatttgcaccgattggaagaagcccgcgaagcagctttgattcggtcggctcgatatttacaaggattgcggcgctatcataatcgcaatgttcgatctcgtgcctttttagtcggtgacctggttttgcggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccggtattgtacaaattgagcctccatttgttacattcatactcagtcagagtcagtcctttcatcatcagagttattattactcggctgaagatcgttgttgcggaattgctctacaacatcacttgcaatcttgtcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatattcttgaagtatacatccggtgcaactctcagcttgtcaaagatttcggttgcgtcaagtgcactcggaccactgttattaaggaacatagcttggacaagtggtgtagcgacattggcgacttcgtctcttgctccttcaagtttcttgatcttaccaaccaggacgtcaaactgagcttgagatttgattttacggtctacaaaacacatttataataagaatttgctgcattaaaaagaggaaagttcagattgtcagctggcagtaccttcaacctccttcaaggctgagtccctttctgcagccagttctgctttgtcttttttcaaggcttctatttgcttctccatttgagccatcctggtggcttgcgctgtttgaaatccaaatgtttgaggatccagttatgacagcacaaatgggacagatctagagattaccttttgatgaaccactcagctcgaagttggagtcctgaagctgtgcaattcgatcccttaattccttctccgttttcttggcatgctccttggcctcgtgtagctgttccctaacggcttcaagagttcccaaatgtggaaccagcttttctaaggttgtggtcttggcctcattgcgaagatggatcctctgcacggtggttcatggattagttttgctaacgagacaataaagtcatcaaaggcagtcacctagaagacttacattcacaatgcgagtagcttctccaagtactttcttcagctggcacacttcctcatcttctttttggcgatttatgacaatgccagaaacttgagagttctcgtcccaccatttgagtaagataggaggacgagagtcatcagctgcctttatgcggagaatttcttcttcgtcgccgcctaatggacctgatgcattcccaagacattagacgaacaagctggagttattcagaacggcatcacttgagaatatgagttacctgaggatgtgcctagttgagcgtgaggtgatctttgctctttatccagagacccaatcaccgagtcattgccagcttttggtccttgggaagttgtcgcttgtgctccagcttcaggaatctcttgatttagacccacatccgactggtttccagtcaggggttcttgggttgttgcagtttcagttgcttccgactggtttccagtcggtggctggtcactcggatcggccttgtcatccgaagcatgggcgccagtcggctggtttttggcagtcggctggttttcggcagtcggctcagtgtctttggataaatttggctctgtcacagccggatcaggatcttttccagttggatcaatgtcggatggtttcctgcaaagtgtcctttcaacattcagcgtaatttctatgagagaagtatgtcaaagggaaatggtatcgagaggtttatacctggaagatgttctaatctttggcatttgacggccagccagttttttcctgggcatggtatgctttgggagtttgttgggcgttcccttgtccccagatttgttgctgtcatcgccctcgtcgtcattaagcaccagctttctcttgcgaggacctgtctgcccagccggtttggaggtttgaggttgtgggtctgacctgattgtcggccctccacttccctgaatggtgtgctggcgaggagatcggcgctgagcaattgggggatcagatttcatcaatacgtattcctgaatgagatgcttccacagttagctaactcaacatgaagatgaaattatgttttgaccttgggttgaagattttcagatacatacctgcggaggcggattgaatgcgttgtatggtacaactggcagttgatgtgagtagctgacgacaatagcgttcgagaatatcttgtacatcctctccttcatgatcttaaaatccagagaatctgggtcttcacggtttggatcgtgcttgccgtcaaattcaaatgctgtgcgggatctttctttgattggagctaatcggcacttaatgaaatgccgagtgatttgctctccctgtaagccttgctctttgagtttcagcatgcgttccatcagttctaaggcttgggcagcttcatctcccatgggaagagagttccatgtatcttggtatactgggggaagacaggagtactcaggaagagcgggctcgggattttgaatataaaaccagttggcgtgccatcctttgtttgaagtcttgaaaggcatggagaaatacttttggctcagagtgcctctcagttgaaatccagcccctccaactacgcatggtttgtttttgttcggttgaggcttaaggaaaaatattcggcggaacagagcaaaatgaggtctaatgcccaaaaaagcttcgcagacatggacgaaatttgcaatatggactatggagttcggattcaaatgatgtaagctgattccatagaaattcagtatcccacggaagaactttgaggttggaagagcaaatccgccataaaagaaatgagagaataccacgacctcgtgtgtatcgggggttggaaaggcttcaccgcacgctggccgccacccgatgatctccttgccagggagaacgccgtgcgccaccatctccttcaggttttcttccgtcacgtcggacggcgcccattggccttcaaagctttccttctcttccgccatcgatttttctcaaatgcgctgatttgattcgagggatggcttgggagaggtgaggaattgaggcggtggatcacgggaaggattttgatcacgttttgaaggtggatttgggtggattggtgaaccctagttcgccggcgcagctctttactgtagcgtggagtggggaaaatggcgagcgttccggcggggaagacgaagcatcgcttggatctcggatttcttgttaagggtatcggaagtgcaaatgggcctaggcctgaacagtacctcagcccaatacttttaacagcgtggcccattgtgttccttagggacttaggcattttttgctttggcaatttatgcgcacaatagtgttgcccaatgttgataaaatcctttttatgcggtcatataattctttagaattattgcaatgcagattaaaaggtgcctgacagaaaggtgttatactgctttttgttagctttattaggctacaaaagctgtcttggttaatttggaatgacttatttttatcatagtcacttccttggtatgttatatacctattttcattatggtaaatagtcatagcctaggctattagacttattcattaccataatttttataatacttggtgggtaatctttagaattttatattcggatgtctatcaagtgtgttcattcgtgaaccttttagagtgttaaccactcggatttcttttattatggctaaaaagcagtcggctagaatgcctctttaggcgccgcgtatgcttttgccatctgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttgacatgaaaagtttgaagcactcggactatttttgagatggctacgatggctgactgcaaaggtctcgggggctactgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagattcgacaaacccgaagttcgccgtcgcgttttgatctccggcgaagccctgctgctcctcccgtcatcgccctctgtcgccatcgactccattggattcgcagctgcgaagtgaagcccggccacccctccgttgtcgccgcacatcgccggaaagttgtcgccgccgtggacagtacctcgccgccctttgaagctcgtcgccggccatcttccgtcgctgtccgtcgtcgcgtaagtgttggtaagaatcgccgttgcctcctctttctcccggtgccctccgattgcattatttcgtcggcaatcgccgctcctttgtcgttcaccggtgtactttatccctagggtcttaattccatctaatctaatcttgtttggtcctagcgtcgagccggtcattgccgtgcaccgtacccgctgttgtccgctgctagccgccgcgtagccgttgccctagtgcacgttctgcagtcaccgcgccgctgtcgtgcatcgctatcggctgtgctgtcaccctaaccctagctttgtgtttccgctgagctgccgcctagccaagccaagtcgccctagtgccgccgtgtcgcagctgtgtgccgctttaacctagccgtcgctttagccgttgctcggtagtcaagttgtctagccgtaggtgcatccctaaattcctaccggtctatcgtttgtcgtaccggggcttttctgtgaatcgtttctagtccaccggattagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttaggtgatcccgtgtcacgtagaattgactcgttgagtcggtatctcgtgaggcccgcttgccagatcaatccaagccatccgatcttagtcgactcggtcaatataaatcctctcctcttttcagtggcatattatttctttttaatatatgtcatctaccaaatatgatccaatcttttccggaggttgctttaatcttctgtctcagctataaatcatttgtaaatgatttaattaatttggaatagtctccgtttaataggtttaattggaattaaatcttgtaaaattcataataaattcatatgaaatcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgtcgggagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttaatccttgataccttgggttattataatttgactagttgagctttatatattggttcagctagatattagatgtgattgcttagccatgcttagaaacattagcacactgttgggataacttatgattcattattatttaatgatggtttaatggtagctcacgatggtcaatcgtgattgg

SEQ ID NO: 62235 - DNA, 16118 bp, Oryza sativa
ttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggtatcttcctgggcggcgtagcgtccctggggctgtccgacttgatggagcacagctcgtccgaatcctcgccatctgaagtccgagttatgatcaagtcgtctatgtccagatacatcggtggcagatctgcaaagtttattaattttacagcaattaatgcatgcaataatcaagtaagcaattgaagctatggcaataatgcaagaaatcaagaatcaagaagaagaagaagaagaagaaagctagaagttatataccgtgtttctccctctctcgttgtgtttcactcacgctctgctgcttctgggatgatgaggatccctgactttgctcaccttcacctccatgctgctccccggtgcccttctttctaccagacttgagagctaccctgtgggccgctagatttcctgtaggttccacagccaactcacaggaatattaattttcttgacggggttacttatacccacagaaaaattgtgttatttttgtaggttttcacacagacccacagaaaaatagcgctgacaagtaggcctcaagaaccatcaaataaaactcaggcagccaagtcccaaaacctaattccccacccctcttcccaaaccctcgagccgtcgccgcccctctattctctccagatccgcatggcgagcgcctgtgcgataccttcgacgaacggcgggtcggctaccgagcctccgcccagcgccatcggcaagatgcagccgaccatcaccaccatctcctgccggcgacgagcttccaccatcccctccactgccggtgctagccaccccaaggcccaagctcagaacctctagatctggatgccccaaccctgggaaccacggatccagccgtatcgagtgtgggtgctccagatctcgcggttctcggctccggcagcgccggcaggagaatgggcgctgcccctccttcccctcctcttcagtaagtaaaagcatccaaaaatatgtgtttcaatggtgaggaaacggtttggagcacctctgtccatgctagcatgtgtttccgctgctaatcccaaacaccgatttgttcagatagccgccggcggagatttctaggagttcaatttaatctgctccaaagttgcagccaaccattctccttcaggatgaaaaagtgtaagtcatactagtttacacttgtggattattttggctttgatccgtattacgtgactgcccagtagtagatctagattgggttattggcccttgaccacaagtttaatgattgtcagtggaatgtcagtagatctagattgggttcttgtgtcaaaacctgcgttgctgcattcatcaactaatctagattggattagttgatccattactgttgttgccaattattattttttctcagagctctgattcccagatattaagcaagacaagttggttcccatattgtctacattatgtgatttagtttctataatagaaatttaattttcttggattacttactcctagagtataatatttattttacatctaaatgatttgtttcttgtttcagccttgtaagacaattatgtctggaccaactaattttcctctagccattttgtgaagacctaatgttgtggcatgacagattgacaggtactcccacactagagtccctgctattcataaaactttgtttgtgtctggtactgagttgtttgacatggaattaatctatcagtggattatcatgcactatgctttcttggtcacatttagttagaatgcagatgcttttcttatgctatttttaccttgcaattcatggtaaggattgtgtgaataatgagtattatagtgttttattttctctgttttagtagctaagaaaacatatttttagctcaggttgtatgcatgaaatcattagtgctttctagtctctactagtgcatatacatacttcacaagtccaagtccatgtatatcttttggcaagtcacatactgctacatgtgttggatagatacatgccatcagaacaataaattagtttcagtctcttgtttttaaaattttcttatgtacaaaccctttataatttaccttgttcatggcactttgtatttttcttaacaggccatagcttgaatctttaagtgctgcagttaaatatctacagaacgttgcacatgatgaaaatcaaggtatgcttctcattcagtggatgaaatctttcttagtctaagatgtcctagcatttgcaccatgaaacttgtcatttaagcatccatagaaaatgagtttgatcctattatcctagcatttatgtcttatctgaattggcagagtactacaggaagtattttcatggtcacttttcatttcagttgccatatttcattttcatgctttgtagttgacaaatttatgttgctcacttcagtttttcctgtactaatctatttgtttctctataactggggtattcagaatcattgttatttattttgtaatgaagaaaattatgaaattgaacctcttttttaaaaccttttagcttcctttgcccaaggttgaagcaccacggaacacggactgctgctggaagacaatgttcttttacatatgtttgatgaattgtaactgaacacatttatcttttctatggaccctttgtatattactaaatccggtttgaatgaatttgtatgtactgaacttagatggactatttatgtaagctttgcagacttgaattttgatgtatggattgtgattgatgttcatatatttatccaaatcaccatgtgtttttttttgggcgtggaactcattttttctgacggtggatgatggtttttcctgatgggtccacgtcaaaaataagctttcacaaacctgacgccagttgattttttttgtgagccaaccgacaggaattcccgacagaaatgatatttctgtcaggaaaacgacagaaaaatttattttctccgtggtcttttttctgtcggcaaactctgacggtgcacccacagaaaagtattttctgacggtaattcatattattctgacggttttcggcctacagggtagacctcttgatcttctttttcttctcatcatcctccttcttgtcttccgacgactgtggccgctcagcacggttcttctgcctgtccattggagcttaatttgctagctaactaataactatagctaatagctaggcgctggctaactcgatcgaaaagagctgcttatcccacagcttgtctgcaggttgcgatgacctatatttatagtcagtgtacatcgatcattgaattgatctttgttcatgcttacctttaatttgcttctgacttgctgcattatatataatccaggtcttgagatgaccagatcagtgcggcgcatggatgtgtcaaaagagatcactgaacaagtatagtacatgcacgtgaactagctagctactgtaaaatggatcggagtacattgcgacagagagcacatacgtactgtgaaacaaattaaacatcataatctaattcttgcacttaaatgtccaaatgctagtttctcgcaatctctggttgtagcagaaagagccttaattttggatcttaagagctgctattattacttgatgacgagaagtctctgtactttaattagccgtgcatccaaccaaagagtgcctccatgctggttctcatttcggtttagaagaaaacggagacggcccagcaaaccaaaacgacccatctgtgagcatttaatttgcatgtgtacgccttacgcatttcttcgctaaaaaaatagttaaaatttttcgggcttggttttgtatatatatctctctccctgcccaagctcgtccaataactatcgtgggcctttttttttttggccagacttcttcggccccggggaggcaagcctagggacaatgcatatttataaatgaacaataatccaaatgatttaagttatttatatatattattatacggttggtcagtgttggagaaatttattacttctttccaaaacaaattaaccaaatataaaatgtttaaattcataatattatgatgtatcgcatctcatatttaattggtttattgtaagatagagggaatactattaggtacgcttgatcatgtggtgtgtgccttgcattcatatgaatactactctcttcgtcccttaatataagagattttgacattttagttacactgtttgactacgtcttatttaaaaaatttgtgcaaatataaaaagcgaaaagttgtgcttaaagtactttggataataaaataagtcacaaataaattaaataataattccaaaatttttttgaataggacaaatggtcaaacagtgtaagcaaaatatcaaaatcccttatattaagggacggagagaatagtattcatatcaaatggaccaaatagaggcagctgatagatatagggatgtgctacacaaagacaagctcaatgtttatgtggtgtgatgtaatcttaggagtgagcccatgaatagtgggataatgttaaagcaattcgcacaatgctattgctatggctaggatttaagtaaccataagatagggccacatgagatagaaaaaaaaatacttcagctcttgtttatgaggtgaatgagagagataaaaatattttaattttgtttgtgatagaccttaagtataatgtgcaccataaactaatgctacttaccacaatatatgtgacttattttataagtgtaattattattttaagattatatttttcataaattattattgttgcgctaacgccatatcgatcaaaaaaagtgagcagaggggaatatgcatgatatatagcatatcacgggtatgattttgactgctagctgctgctgtatgtatgataggcacaaagctggttggccatgcatgtactgcgtttgcgtggtccatttgaccagatcgacgtgagccaaagcttaagtgcggtatctccaatagggaagttttttttgctagtatcataacacttatcgttttgctaaaactgaaatcaaactttgtacagctttaactatgaacaaaatttaaaatatttattttagaagcatggaaactatatgtatatattaatattgaaatatactttaataaaatcatacattcatgatatttatttaaatattgtaatagaaaatagtgataaagttgcttcttaagattgtgtcccttgttcaaaacaacaagcatatttttaaatggtactacctccgtcccatataaattataattctagatggttgcatatattaaggattgagaaaaaaaactataatcgatgctccttattaaatgttctatatatagataaaagtggaggggtagttgagggtaaaatagagataaatttgaatgagaagtgattaatgagaccattaatactatattgtgataattattttgggacaaatttaaatcctagaaatataactattataggacagatagtaactagcactctttttaaaactaattaatatgggtgttaaatgctgcgtgcatcttggaatgcgttatatataggagtatactactagtagcttgtgtgcctataaatataatcgtatgtcatatttaaccatattaattgtgatatatattatcacgattgcatgcatggtcaatataattcttttatttattaattaatgtaagagtttctggcatttagagtaaacgcgatgttacctttattttactatgtttataatatatatagtccagtatatatatctgatacattggttgacaaacttagtattacttaaaaaaagatgacatcaatagcagtttatttcacgtacggtaaatcaatgcggcgtacgttgctagacaaaactagtgcgtaaaaagtttcgagcacacgcagtcataataatgcagtaatgcagatgaccaaggtgaatggggtagtgcatgcatatatacacttggtcaactctgtcgtatacagtagtagacatgtaaagtactaaactttattcggtctcgtcatcgatatatcgtcatactactttactgtagttcatcagctctgcatttgcatatgcatgcagatatgattcgacgaccaaaattaattaaggctgtgtttaatccaaagtttgatccaaacttcagttattttttatcacatcaacctgctataaacacaacttttcagtcatatcatctccaattttaaccaaaattcaaactttgcgctgaactaaacacagcctaaggtgatgtcaaccacacgacgaagacgcgcgatatgaagcggtccttgttaggataagacgtactacgagcgatccttttggacctcatggtcagtactccgcatatccgtactgacgattatattgctggatggagcggcttgttgcatttcatttccagtagatatagattaattgtttatttctttatttttttcttaaaaatccagttaattagattgcacagatggttttatatatgatcttcattttggacgtcaacgaaattacaggagagtgaatcgtgttagcctagataaagtatggttgggctagtttgcccatataaatatagtttccgtttggtccactatgaactctgcttgtctacctaccccaccaccaccacccttttctctcccttggtgaataatccaactttttttttcgcgaaatacattacagacggagacactcatatatacaaacgtgcgcatgtaccctatatatctctatgaaatatacaaaaatgccaataaggagtacatgacataaaaattgcaaattagctccatcagcatagactacgaccttcttttttgaaagtcatggggatacgcaaatgcaaagcattcgagtggcaagttatctactccctccttccctaaatgtttgacgccgttgacttttttaaacatgcttgaccgttcgtcttattcaaaaacttttatgaaatatgtaaaactatatgtatacataaagtatatttaacagtgaatcaaatgatagaaaaagaattaataattacttaaattttttgaataagacgaacggtcaaatatgtttaaaaaagtcaacggcgttaaacatttagggatggagggagtaatatagaatttggacggaggacacataaactactattgccctctctgcaaatataccttcgaaacttacttccatctccacacgaaaggcagatacacaagtatctggaacatattagcaacttggatcggctgcgaggagggacttctgaaaggttacaaatacggtgcacaagtacgtggagtgcccacctaaaggtcctgtctagacctacgatggtgaggcgaagactgaggcacagttacacgctgttctattgtgagcatgaatgggatgatgttgcgtgccgggcggctggcttgggtcgctgtgtgtcaacctcggacgacccaatagatagtggaacccgattagagcaaggataatagtgagatatgcttatgtggaggagagagaaaaaaaggtgttggctctcatgcaagagctagctttgcacgtgctccaagacaaatacattaaatgtataaatgagagaaaaagataggagaagaaaaatcaaagataatcttagagctagctctgcacgtgctgtttttcggaaaaacccctttattttttatctttatagcgctacctctagaagcggaattttcttttcttcgcattgtatttctgtgaaataggagggctttttcagaacaaacacaacagggtgttgtccagtctgaggacatatgcgatattttgtgcaaatacgaggagttttttttttttgcaaaatagccttttaatgaaaccggctccaacccacggtgcagacccatagcgcctaaaattgcgtttggccggttaccgcctacaagcggtcactcgtgcgcgcgcgaggagccaactacagcaaatgggcgacgtgtaaatttacgggatagctaaaaaataaaaaacatgagaaaaagggtacggttaggctggttattgattgatgataccccatctaccatggggcatagagagaaacaaccaagcaagtggttgtgccggctcaggtacgcacggagcccagcattgagacctcatacatctacaacagttggtatatataagcagtagatggaaatacattgaaatccctaagttaaggagctgcaaagacagatgaagtagcactgcaaaacaaatgtccctcttaggaggatgaaatggactacataaacacgagtttcttagtgcccaaatatatcaaccacaaaggtctgtaattgagcatagctgcccctgattttagatatgcagaccacagtgaatgattttcttacaagttccaagctaagatcattctacagttaaactcatgatctcaccataatacgctgggttttctctgggttgacaaatacactgattatattcatgaaaatcattaagcagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgttctgctcacatttccttagctcacaaataacagaggatttttatttcgaaaatactgctaaggcttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttctaggagctcctcttctgagtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagatgtgtacatctttacccacaagacacatcttcctcatatgtaaccacgtgccacataccaccacggtatacagacgaaagacgtgacatagtttccaacccatcctagccatagacaagagtaccgacccaatcccacctacggccggaacctccgggacaggcaggtaggactgagcccctagcagcaggacaccggccctgtgccatgacatctcgactaccgggctgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttttggggattttgagtagagggggcggtgtgaatccaattccacaatactccaacaattccataatatctaggtgatatgaatattcccaaagtctagagttgtgaaaccgcctaatgttacctaattaaagcgaagcatctacctaaaatcatactagtgataccatgagtagagtgtccactagttggggttttgtttattctagggtgaacaaggaaataataacaataacaacaataataaggtcataacaaagataaataggcatggctaaataaaacagtgattacgcgggaatttaaataaagcgataatgcaataagttaaatcaacataattttacaaactgggattcaatatgttcaaagatgatgtgacttgccttgctcgctttcccaaacgccggcttcaacctccacgaagagcggatcttccgaagctgcagcgtctacacgtccaacagaaaagaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaaaatcggatttattgcgtcagccgggagagaggagcgcgcggaccgggtccacgggagtggggcccacgcggcagcctctcggtccacggtggaccgggagcacgcggcttacgccggccggcgccgtgggtcccacgcgtcagccgcacctgagggcgcgggcggctgacggccgggccccacatggcagccacggggcgcgcccgaaggcggcctttccggcacagccgacgggaggcggcgtgcccgcgcccctatggtcgccggcggcggccataggcacggcggagcggcggccgagagaggggaggggagggggaaacgaaatgggcggtccacggctcaccccgggtcgacggcgacgacgggaacggcgaccggagcggaagaaggcggcggcgcggcacgggtcgacggggacggcggcgttctggcggtcggcgggcgaaacggaagggtggacgaggtcggcgaggacgcggcggagccgaaggaggcgacgccgaggcgggaggaggtccgaggcgacgacggcggcggaccggagctcggcagtgacggcggagagagagagcgatggcgcgagctcgattccggcggagagagagagcggcgagtggcggaaacggtggagggaggcacggggagcgtttatatagtgttgggagggggagagaacggccggataagggggaatcggccgcggaagatccggccgccattgatgcgccggcgaagttaggggaggagtttccaaacgaatccgagggagagagagagagggaaaagtgggggaaaagagggagggaatcacggggaatatttcccccctcttgattgcacgcggggcggacgggagcggcgggattcgcggcggcggcggcgctagggcacgggcgaggcgacgggtgcggcgggagcggcggaaggtaggggatgacgggtgggccccacccgtcagcgagggtggcgggcgggcccgcccgtcagcggcacacgcgcggggaggaggccgattgggccgcgggggagaggagagagagggagggaagtgggccgagccggcccaagaggtagagggggagggaaagggaactttttagggtttttctttttataaaaccattttaactttgtttatttcttaataattattatttgtgctctgaaaattccactaaaatttatttacgcattttaggcttttaggaaatatacaaaaatcgtccaagccttatttgacttttaactttgcacattttaattgttggaggctttcacatggattttacttattctatgcataattttgaggatgtattttagagtcgttttaggacgcgacagtgagttgaccttcttcctcgggctacaagtgaagcaagcacaagagggcactttcatctctcaaaccaagtatgtaaaggacattctcaagaagtttgggatggaagatgccaaacccatcaagactcctatgcctactaatggccacctagacctcgatgataatggtaaatgtgtggaacaaaaggtatatcgctccatgataggatccttgctttacttatgtgcatctcgtcccgatatcatgcttagtgtatgcatgtgtgctcgctttcaagcggagcctaaagagtgccatttgattgccgtcaagagaattctaagatatttagttcttactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattccattgcattatccaccgccgaagccgaatatgtcgccgccggttcttgttgtgcccaactcctttggatgaaacaaactctaaaagactttggctacaacttcaccaaaatcccactcctatgtgacaatgagagtgctatcaaaatagccaataatcccgttcaacactctcgaaccaaacacatagatattcgccaccactttttgagagatcataagaccaaaggaaacatatgccttacacatgtgagaccgagagccaattagccgacattttcaccaagcctttagatgagaaaagattttgcgagcttaggagtgagctcaatatcttaaattctcgcaacattaggtgatgggtggttggctaatttatagtcaaacatgtatcactaaaatgtaaattaaaaaaaaattgagcttttgtgtcttgagatcacttcttggtagaagatgatcttgataccaggaataaagctcaaacatttcccctttatccaaaaaccccttttgtgataagttttgcaaaatcctttgtgtgccttttattgcgaaaatttggtttttattttcttcttgtgatgtatattgaccatggttatgtaatgttgactgttgactggtcatatgcatcataagtctctgcatgtccttagttctctatttcccttcgttgaattctcatctcctccttgtttttgggcctgactgccctttttctgtcaggccggaagttccgggcctccctgtccggaacctccgggtatcggggagtatatatactcagggggagttagaaaccctagtctctctcctcatttcttctctctccccgacgccagccctagccgccgctacagtgcccctagtggcgatttcctcttccaaccgtgaaaatttgattcttctccgtggaatcaaccacattggtggtaggaggatcttcctgcgatcattctacgatttcctctctcaaggtagcactttttgattccctctctcggttcattgtgttttttatcccgatctcttaatctgtgaacctagggagaaaaccacttggatagtcttgttcctgctaccttgtagatcagcgatctataggatttgttcacatgcactggctatttttgagacccctgttcttcatttttgccggccggaagttccggtgctcttgcacccagaacctccgggcgctgtccagccagcctgcaattcttgattctctcaaattttgcctaactactgcactccaatttgttgattcctgttgcagtaagcactatgcctcgtgagaaaagacagaaagcctctcaggatgtgtctggtgatgagagtcctcctattcggtttcctcgtggtcgtttgggtaaagagaaagtggttgaaggtggcagtggcagcggcactcgtacttctcctaggtttaccaggcaatccagcaaccgtccagttcagattcgagatgttgacagtggtcaaggaagtgatgctccttcttcaagaggtcgtgggagaggtggtggtcgcacttctagggctggaagggcgtctcatgatttccctgttggatctcgtgagaatcccgttcagctctacaagactcttggatttgacaccactcctatgcaccacattggaagacccaagtccaactaccttcatcagcttgccaagtgcagaagggaccgtttgcttgatccagagacacagcctgaggagtcacaggatcctcgttttaggacgttcacccaattggattggtataactcagtgattatagctagagacaatccaatggttgagatgaagtggattgattggacttacataaggaagaagaacaatgaagtgttcaaccaagcaatgcaagtttgtcacaacaagaatcttggagatattcttgccttggagtatgattggaatgaggaggtcattgcacaattctatgcgacagcattgtttggtactactaggaagggaactccttatgtaaagtggatgactgagggtgttaggcacaaaatttccatagcacagtttgctaagatattgggcttagaggatgaggatctcaatagccctaatattcatagtgaagcacccctccccatgatcaagactaagttcatgtatactaaggatgctcctcggacttgtatgggaactactcatggtt

SEQ ID NO: 62236 - DNA, 4430 bp, Oryza sativa
  unsure (1)..(4430): unsure at all n locations
aatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcnnnnnnnnnnnnnnnnnnnnnnntttggtaatctaagtatcggagatgaagaaggaatcgaaacggagttcgagatagagatcgtcccggaaacagagtaaagtcagctgaaatccgaatcggctacgatcaggatcggcagagtccgagttggatagggttagccaattgagttgaatctgacaatgtagcacgatatacgttgtcgggttaggttaacgagcttcatgaggattgtcgtgcatggatagagtcctaagaaggcaattgtatctattaattaggatattttatgtaatttccttagagatatgtttgggcaaaagtctgccacaaagacttatggtattttagagtttgttagagataagaatcgtgtccgatatagacatattttgtaatctcgggtataaatagaccccgagccccatgtaatcaaactaacacacgcatcgccacccttttaacttttgttttgtttcgacgagttcttactttcgggttgagctgcatcggttttgatcttcaacaagaggtaaaacttgttatggtggcttgcgttattaggattagtgcttccatctttatgatactctaatcttatttatgtaatttgtcgagttatcatatatcttacataatctccggcaatatcgctatctaaccgtcaatcggctaacgtctggtacgagaagtcagccgattaggttaaatactgatgttgacttagattatataggatatctactactctatgaaatatccaacggcttgattgtctagaaattgtccttctttttatacttatagctgcatcagttaggtttgatcttataagtcgtgattagaatctcaatctgctttttggttgccaattagggtagtatcggggtttcagccgattttacctgatttagctttatatttcattatgttaggatatcattacaataaaatatgttagcttctgtgtaatgtattttacttgctttaatatcgagtagtatcggagtattagccgatacgtgctagatctatctgatcggttatgctatgaacagatatatagtcttgttgttaatatatattttgatctaagtgatttatactgtctcggcatggcgaccgatctatcccaatcacttgatttaagtatatatcgacataaggactatatattattaatatctacagccgatcgagtagatttagttcttccgtacttattaacatttgccgatcgattcacatatgacatcggctcagagataagtgatatgtcatcggcaattagtcgatcggctatcgtttatgaatttaaccgcggtttctttatctttgtttcttgttgattgcaggatcaaatcaactggcacactcatacacctaaaggcaagcttttagacctgcattggagttaagcagatctcccaggccttgtgtttttacatcaacacgcgctgggatgagactcctctgactttgtgtagtacaactgcaaactgcacaaaggttgtgtttaaatctacgggtgaaaagttttggtgcatcacatcggatatacgggcacacatttgaagtattagacgtagactaataacaaaacaaattatagactccgtctgtaaactgcgagacgaatttattaagcctaattaatccgtcattagcaaatatttactgtagcacgatattgttaaatcatgaagcaattgggcttaaaagatttgtctcgtaatttacacgtaatctatgtaagtagttttttttatatttaatactccacgtatgtatagatctaaacattcgatgggcaaagtcaccggatatccgtggcggtgcgtggaacagttgggcccttcccaatttccattcaccctttcgccgcggcggcagcggccggcagccgagccgcgatcgaaagcaccaccacgatgatggccgcagcgagaacggcgttcgtctccggcgacctacttccactcaacgtctcctcctcggcgtcaatccccaccctggcaaaaacccaaggtatcaccaaatccatctcgttcggttctgggcgccgtcgccggccgcgagatccacagtccatacctaccaccaggcaagcctcctctgctatctagagatattttccgccatattgaaaaacatcacccgaaaaatccaacatatgtactattgctcagatttagtgataatattgatatgcagttcagatagctagtacatatttgcagtttaaagataatattattagtacattattgttccagtgcattgtgaaacatacttctcacaagaagaactatgatagattaccaaagtagttacaaaatatgatgtgcatagattgcgatggattttcttgtgctcagtatcccacctatttcatcttggaccagatagaatcgatgcagagggtggagctgaatatgtggatgggttgtcttgagcagatatcactgaatttgcgttggcaaagctgtaatctaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcgatcaatacattgtctttagccttctctcgcaataaattgatgagctgaacgctttcctctggctgcgaaatatcgatatttttccttccacatattatttccaagagaacaactccaaagctgtagacgtcaactttttcagtgatctgtgatgttagccattcaggtgccagatatccaggtgtgcctctcatcacggtcactactttactttgatccctgtctattagtttggaaagtccaaaatcagccagtttggcattgaatttctcgtctaagagaatattttgtggtttgatatccaaatgagcaatttttcgcctgcattcctcatgaagataacataaacccttggtaatatccagaatgattctgcaccttgtgcaccaatcaagaggagcattgttatggcggtaatagatccacatatcgagtgaccctcttggcatatattcgtataccagaagcctatttgacttctcggcacaaaatccaatcactttgacaagattgatgtgctcaatgctgccaatagtctcaacctctgccaagaattccttctttccctgtctggcaccttccagacgtttcactgcaactctcttttcacctatttttccttcaaagactgatccaaatccaccttcgccgagctttttactgaaatcttcagtgcgttctcttaacttttcaaatgaaaaccgcattggcattccaggcaatatatcgaaatctaattcttcatctagtttttgatacttcctcctccttcgtacataaatgccaacaataataactaaaacaaggctactaattgctgcaagtgtagcccctaaacttaccttgatacgtttttgtgtaggggcagaagcggagggaggaagttgcactttgaggtaaacagaagagttgtaatggagcttttcaggttgtattgattgcaaggagaagacctctgtcacagacttacattctccatcggaatcattatggtaatacctgaagagtacagccctgcaggagcaattctttaagcaggcttgcttgcagtcatctctactttttgcattggttataatgctgccatcaaagtaataaacatcagtaagagttaagaattgatggtttttcatttcttgacaagatattggagtcactggtgcacaaccaagattagccttccgctcgtcaactggctggaagtagcttgaactagaattagtctgaagaggacagatgcattgcccacctgtgcatatcgcgtactccccgcatactgtggggaaagcacagttatccacgtcgattacatcatccatgtggattacatcagataccatggtccactcaaatccagaccactcatacaacctcaaatggccatcatactctaaccttatgtactgggtggacttagcttctggcagtgcaattcttttatctggctttcctgcctgtgtcgactgcagaaagatgctgaggcttccattcgtaaaggtaaccctcgttgggtcttttctgctcttgtttgtgtccaccaaatatttatagtatagctgtggtggtttggatccaacataggcatataaaccatctggg

SEQ ID NO: 62237 - DNA, 710 bp, Oryza sativa
aatagtttctccactttgcttatgacaaataagaggacatactgtttactgcttactgaatggcatacatgagatctttgtagggtttctgttgtttgcaatgatgatgtcaagtagatcaagaggggatccttgagaccggcagcaagaaggaagctggggactcgcgggttgatgggagattctactaaatataattcaattgatctggttccataagctgagcgagacgaagcccacatgttagtgacgacaaacatgatagacccacctgtcagtggcagtgtggcaccacgatgggcttcaacagcgacaggtgaagtatatatctaattatctactccctacgtccataaaaaactaatctagtactggatgtgatatatcccactatgaatctggtactaggatatgtcacattcagtcctaattcgtttttttgacagaggaagtactaccagctacatcgaaatcagcttccgatgtcgttatctattttccgaagagtgtttttgcttgcagaccagacgatgatgataaaacatgctcgcatgtgtgcgtaaattaatatggtccatgccggacggcccctgcgtgtgtgatgcggtgcggtgtgttgcacaaattgaaggagctcgcctatgttgttgggtggcgattggcgttggcccccccattccgaggcagtgaatggatggacggacaggcag

SEQ ID NO: 62238 - DNA, 39710 bp, Oryza sativa
  unsure (1)..(39710): unsure at all n locations
tttttgaatgtcatcgagtgggaatgacctatttcctttgttatagccttttgttattgattacctatactttgtcacctggttaataattggattagctataacattatatggttttggctaaagtaattaggatgcttagccatgcttagagacactagctcatatgaatgggataattaatgattcattattacttaatgatggattaatggtagctcatgatggttaatcatgataggatgattaattaagatgtcaactaaaacatggtaacggtgggttgtgagcacatggttttgatggtcgtgctcatgacaattaaggaccggttcacaattttcggttgtgaaacattaaccgtgccaaccacaagccagcgtgggcaacagctttaccttttgtatagtgtggttcattgtggggcaccagactgagaagtggcggagataagcctacgggggtcgctggggagtccatggtgcactactttgaattgtgttatgcggagggtattgtcacaatctctattcgggtacttgtcaagtatcgcgacgcatggttgacatgatgttgaggttgtgtcttgtgggtatagtggtacacctctagccagagtaaaaactatccgaatagccgtgcccgcagttatgggcgggtctaacaatgtctttcgtgattagtctcacacctctcaccataataaatgatgctgtaattggtaataacttgcttagctcctggtttggagatagaactgtgcagccgggaatggttgtctagaaatgttgggcctatgcaacgggtatgttgtgtagcgttgaattaatattgtttaattaaatactttactgtttttctaaattctgaagtatttattgaatgccatttatgcaaatgagactatattatgccatcctttattatcccctgcacttgcatatttgctgcgtggcttgttgagtatgtcatatactcatcttgcaatcattcatcagagaaggagttctacagtgatgctgaaggtgtggaggattaggcgtagccctggtcaagctgcttgtgggatggagtcgcctgtgctctttattttattttccgctgcttagatctttattgtttgagaggaactatccatctctgtaatgactttttattcgcctcttaattagattaataattgcactctattatcaatttgttattgtgtgcctcagctgattcctggacgagggtttacacacatgtaagcgtttggagttttggatagaaattccgggcgtgacaagttggtatcagagcctccttaaccctaggttatgccaaatggttacctatagaagccctctaaaaatattgaaaaagtagaattattctcctctctttctcttttaattaaaccaagctaatggcacatgcagattatagtctcttcaattgttctcattcaaaatttactcattattcctgtgttgttggtattgtacatctattactgtactaatggcccatttaccagcaaaagttttacaacattatttattttcattcaatcatgttgaaatatcataaacttagcatgttgattttataacactcttttattttatgtcttttgaaacctgttattcaaaagtgcaaaatttgtgatcctgttttcaactgtttcaacttatcttgcaagattagtttactttatttacctttcactttgattttctgactttattcaatttaatccaaaaacttgtgctattaattggataaatgtcttaactccctcctttcacttgtctttagatgccgcgcttcaagcctgagtacttgtttggtattgagggatttgtccaagagctacgtccgatgtcctttaccataggattcgggactgcccctttgtatgcccagattcctcatgatcgtgatgaagagaagttccgtgtcaaggtcaccttgaatagtgatcgtgaagagatcccatcggtgatgttcgaaggctggagggggaagctatcctcatgcttgtcaggaggcggcaaggatcaccataggagagctccgcgaccgttacaatgatctgttggccgacactgagtatcgctactatcctcgtcaaccctagggaagtgaccgtgccagctatgttgatcctgaaggaattgagaatgatgctactacaagacatttggtcgagatgctgtgggccatggatgagtcccgcgctgaaatcgtgtcagctgctcaagctcgtgaagaccagaaccgtggtaagatctgcaagctggaggacaagctaggttgatcgtctggagaaggaactggccgaattgaagggagaagcgtcaccacagaaggccagggtttgtcttaccgcaaggaagagagctctttttgttccccgctacctgctggcgcccaaggttcgtatggtgacaagagaagctatcccagttccaatggatcctccggtcgttaatttaagttatgatgagaaagaagattcagagcgcactcactcaaaggttgagaggggtgctactcaagatgatggggacgagccgaacgagccttcaatcaactctgatgccaggaagacctagacgtcttgttaagtcgttgctttagttcgttgtgttagtttgcttgtttaagtttggttgtgtgtgagggtcttgcatgtggtttacatcattggtgggatgtaaatgcatgcgtttgtttgctttcgagtgttaggaagtttgagttaagtggtgtgagagtcttcagttttatgtaataatgaaactaagtttatatcaataaaagtcaagttagtagaaattaattccatgtcctaagtaggtttttcttttggttctcttcttgtgctcttgcctatgccagatggtgaacacccgcagcaatggaaatgggcccaacaacaacaacaacaacaaccaacaacaacaacaacaacaatggagagattcccacgcttgcccaagtcctagctcaacaggcgtagctcatgaacatgatgatgcaacaactccagaaccaacagaatcaggggaacaatcatgctcctccccagaacaagtgagcagaaattcttcgtgtgaggcttgccacttttttcagcactaccaacaccgatgcgcctacaaccggctgactcgtcagtccgttaccctgcagggatagcggaggatgtgctaggtaaaatacgaagatttcttcatgcccgatgactttgtggtgttggatatggaaacgggaaaaaatacgccgctcatcttggggcgtccattccttagcaccgcaggagccaacattgacatgggaacggggagtatccgtttcctatcaacgggaaggaggaaaagtttgagtttcagccaaggactgaacaatgctccatggtcaaaataaagtatgggccaaacccgcagaatatccgagtggtcgaagtggagcctcccaagatggatagcttggtaaagttcatgtaaaatttcctggagaaggaaacaacaatgcccaggaaccgttattggaagacgccggtaaaatcaagtacatcggccaagaaggtggaacagtcggctcagagaaagccgtctttcacaccaaaaccaaataaggtgtggaaggaaaagccaaagacgcccactctatcacctccatagacgggtggaaaatccacgaactgaaatgaaaggaggtacggtcttgcacgtcggacctaaaatgacgcgaccttcgccaactggtaaattgatatgtatccgcatgtttattttcaacaatttaaattccttgcatcaatgcatgtttggtttttaaaattgcatttaggattttttttttgaattttgaggaaattcttcaaatgaattttttagagcaaaccaaaataaaatttttaacgaaaattcactgtgccatgaccacactgaccgttagaacccaatggccgaaagtggggccggttgggcccaccaagggttcggtcgaacccactggttcggtcgaaccggccaggcaacggttacctgccacttttggcaaggtaatggctagcgggtcccacatgtaatttctgaccgttgtgggtaccctataaaagccagccggccgagagagggaattccaccccacttcaacatattttcattccctctccaaagtttgctcttgagttcattcaagctttgatagtttccctcaaattcaaacacttagctgcatatatacaagttgctttggtgaaactaaccggcgggtgaaactcttgttattctaatccctgccgagttagtccgttctagctccattatgcagaataaggaggcaattgtctcgtctgttcgaggggtccggctcttcgtcaagtcatcatgacgagtctagcgctcgttcatctgctaatgtctcgatggaggatgccgaagctccgcggcgtctcctgaacgacactgacctcgacctagtcgatgatcaggaaagaaaagcctactacatgctgagtgaccgggagtatgctcacacgcgagaatactctccagagctatttggatagctatggatgctgagtgaccgggagtatgctcacacgcgagaagataggtatggatgttgattttcgtgctatttggaaagctgttggttggcagagatttgctgtggtagatgagcctggttctcatttgcttactttgcaatttctgtgcactctgaaagaaatagaagatggaattttctttcgctttttccataaacagtatacacttacatggaaaggattaagtatacttcttggttttcacgattcctataaaattgatctccagaaagtaatttctgggttcgagaaaaataggttttgtgaagatatttctggtgctccaatttgcaagaaacctaggacgaataatatccataatcctacacttagactcatgcacaaatggattgctatgactttgtttcctagaggtgatcttaaacccattagggaggatgaattgattatcatgtttgccatggtttgaaaaatcaaaattgctcttgtgaaatgtatgataagacaatggttagaaagtataagattttctgctcctgttgagtgcacttctctgattactcggatagcaaaagggctaggggtcgttagtgaccagattgcttttatctcagccgcttgtccgtgtattgacgaaaattatttagtgcaaggacatattctgaaacatggagtagatggatctttaatatactttttccttgattgtacaaatgaaattccgttgccaaatgtggggtatcatttgtacaactgtagtgaactaaccattcccctgcagaccatagaagaatctcgtgctggtagagcatacagggagacacgcaacatgggaaggaacaaacaagaaagttcatcatcctctacacccgtgcagatgtatgaggcaggttaggaaccaactggggatgcacccggatggacccagactccacaccatagcatcggggtctcaagctgggcaagtgccaatgaggaccgatggcatgcacctcatcacatacaatgggaggacaaccaaccccccagatcaagtggagtacctccatctacaagtgaatgtcgctcgagttcctctcgttgggacttgggtgaaatcactaggagaatggatacccttgatatgcagacaggagagatccagtacaacctcacggaacacatagcacagacgcaagaatggtaacaaactgctgatgctcagttcgccaacttcaccaacatgatgcagcaatagcatgatgaccttcaagcgtacttccgcttctaggggttcaatccttatcaaggaccttgagcgaaagacaagcttggggggagactccccccactgaggtaacttgtatcacattgcatatttccctttctaattgcatatttgctttccaattgcattttataaacttgaaaacaatataaaaatttgcaaaatagaaaattccaaaaagataggataggtttgagtcattctagttaagataagctagttctctttagtaaaatgatgaatagttgctctgtgttatatctcttatatatgggttcataggtaagtgctctctcaaaggttaaatataagtagccaacaattatctgcgagcctgaggaaaatgagctgcacttgctaatttgagtctaggttgttgcgagatatgatatagtaaataagagttgcgatgatcctgatcctagtttgacttgaattccggatgttttgtttttttcaaaatgataaaaatgagagttcctcatttgatataaattcctacagagccaaaactgtgctatcatgattgaaccatatagattttggttacttgccattccattgaactttgtcaaactcttgtgacttgtggatacttctcatgctctatgatcaagatcatatacccacatttatgcacatgctaaactcctatactaggagctagcattataccattccattccatttccatactaccataaaaataaattctccatgctttcatgtgctttctttttctaaaaagaaaaaaattcttttggaaaaaaaaatagaaggagggaacggaatggatatgaaaaaataaataaagttatgctctcacaagcatgagcatgatgttgaaaaaaaagtgtagccatgccctctcctaatcaataaaagaaggatttttaggagaagaaagtaagcacaaaggagaagcattttctttattttccttcataaaccatttccaccttatatcacacaatttgcacgatcttgatcttgagtatgtttagttatctgctttagtctaagtttttgacttagtaataaatgtgaatgcaagtatgccatgtttgatccctaccgggctccacatatcaaaccttagagtaggaatcaaaaaggcaaaattggtgaggaattcatattgatacacttagagaaactgagtgaatcatttgaggaacttggctttctttgcaaattcatttgaaaacttccggaatgaaagttgaataaagattgggtaattggtgctctaattgctgttatgtttttcaaccgcccaaggcaaggagaagcagtgtctcatgggaatcaggggtaagggtaagccaccgtgccaaagattatttaatctgagagatagtacatataccttggacctgtacctttgagatatacagcatagtagcaactcctgatcaacaaccaagtttttatttccttttgtccttcactcgggacgagcaaaagttcaagcttggggggttttgttgacgatcgttatcgatcagtttcgaccgtcaatattaccaaaatagaggaaaactagtgatgcttgcaatgcatatacatgttagaataataatattccactagtattaggtttactaaccttttgcagagaataaccataaagtggaggagaatcgacatcaactcagatgataaatcaatcggacgatgtcgacgatcagacttatgtatgaatgggccaagaactcagaattgacactaattgggccgaaattcacaagtctacgaagtgaagcaatggaggaggccgccaaccaaaacttgagcttgttgggccggcccctggttcggccgaacgaggggattcggctgaacctcccgtggcgccgatgaatgcagggttttgatggacggctgggattgatccccaatgacggttggagggtattaccgaccattccaaccgtcacaaccgtcattacctgcctataaaagaagttaccattctcacttcacacacacacctcaagcaagagctctctcccattctctcaagttagtttagtgttattatgctaatggaataggaataaagtagaaatcgggagtccggaagcctttggaagagtggggattcggccgaacctcccgtggcgccgatggatgcagggctttgatggacggctgggattgatccccaatgacggttggagggtattaccgaccattccaactgtcacaaccgtcattacttgcctataaaaggagttgccattctcacttcacacacacacctcaagcaagagctctctcatattctctcaagcctttggaagagttcgggtatggctctagtagctttccttttctcttttgtaagctttgtactattattagaatactcttctttatacatttatggtattgaaatactgtccgagtatattaatgccaactttacattatgttcatgttatactgaatatgctgctagcttttctgggagatgctttggtgcgggtataatgtttgcttatgcaattactctatgtcataacgatgatattagagtactatctgatagtttagacgtggcatctagattacgggatatctcattatttggggttatatgctgcggatgagaggtgggccgctgatattgatagctcaataagggtattcctccacgcgtgtatatgatcctaagttaattctctagggagggtactcctccatatttagccccggttgtatggtcatgacgggctgtcgtaaggaactcggtagtcaggggtggcttcgcgaagtaccaggagggtatcggatagagggtattagctagtatatcagatcactagaatgtatgtatactatttatattagaagtataggaatagattatctttctcttttctttccacctagcttatataattttgtatgagaatgagtagcttaagtgcttgtgtgtcacactacccttggattatctcaacccctgcttaggatatgattatcacaagtaatatataaattattagtcaagttctctctacaagatcatcctatgggataaaataaatacgatacccttggaatactctcggtgaaatgctacaatggtatatccgtgcgcttgcggatgaactctgtaaccataatatactaggagtatttttgcgccattgctgggaattatatttctagtaatgtcgttaagaaacaccaacaccggccagatgcagccgtctcccacgccctcggctagccgtccgaggccgtcatgcttccggtgaccgcagtcacggtcaccaacaccgcagctgctgctgtcaaacgcccaccatcttgccgttgccatcctcacctcgcacccgactccttccccgccgccgacgtcgccaccgcctccacagtcacggctgccgtcgccgctgccaccgacgctagtcaccgcctccgcagacctcttctgtgccatcgccctctgccaccaagcagccagcaaacgccctgacgccgccgccatgttctccgtccgccgtggtcagccgacgccgccgctcaccgctgtcaactgttgagaccaccacctgccagcacccctgcaccggtatcgaggncaccacacctccgtgttcagcgcctncgcgccgtcgtgcccatcgccgacagattcggtcacctccgcaccagtcatcgtcgggctctacgaccgcgagttcgggccgtcgtggcatcggcgctgccagaaacctccccgccagatccgcgcaggatctggcgggctggtccactgccgccagtgcctgcaaacctctgccgccatccccccaaataacgccgcccgaacacactaccctgccgcggactaactccccgccagctccggccggacagcgcggatctgggcggtttccgcctcccgacatgagaagttcccctgcccttgtgcggaaagcggagcgaagccccaccgctgccatctatgccatcgcgcggctttgccgacgcccgctcgggtgtcggcgaggtgtagtaggagggatggaggacgggagacgacggcctgggcgcctcttgtgccccccgagaggaggtgacgtgagagtcgtgactacactcagtcacctgaattactgcatatgcatcgtcacaattggtgaaaatggtaatggtaattcacggccaaccggcattcgtttttgactttctcctggccgagccatatggtcgggccttcatttttgactttctactggccgagccatatggaaatggtaaacgactgaataaaatggaaatggtaaaaaatatggaaattgaaatagaaatggttttgccgttataccaatcgtttccgtatttaccttgttcttctgaaaatcaccgtttcttataatatggtaattaccgcatctctaaaaatgtcgatattcataagacatatttctacttgacccacagtttagagattgattgactcttcaatcaaatccctaacttgagtgcatggctaaaatggagttaatttgtaatttatatagtataagcttgaatttatttatacatataacatacttatgtaaagttaaatatatgttttacagtttaatatatgtttccgtatttgttaccggtttctgatatgtatcaatatgtttctgtccatattgttccgattcaggttttccgatattgtttttgttcctcacattaccattttttatttttgaaatggtttaggttgttttccgattgtttccgaccgctttcatccctactgcacacactgatcaagacactacagctccccagcaactcgtacccctcagtgcatctccctgcatacaaattgaattgattttccatgctaattgccagacaattaaaccggctattctacataatatggccagctcaaatgaaaccaaatattgaccaaattatggcacaaacaaagtaagatctagctagtccaatcagcggttccatgtgagaagcgtgtgcactagcttgaagatcacaccaaaaacaaaatgcccccgtttcccacttgtacctctccttgtgtgtcacatctacattttgtttgccttttttctttcaaatccatttgactattaagtagtaattgttgtttttttcatagtactcattattttttcaacttcctttgaatgtagttctttaaaaagtaaatgtgacaatctagtggattaaaagtatattaagtattcggatagttacataaacattttcttgaagtacgtgattacacattgtcaggttacggataagacatacctccaatcctacaatttactaaatataccggattggcaaacctcatatccaacgatatttttccgtatgcaataaggaaatatacaagatattatggaaaatatcctcacgggctgatgattatcaaagtcctactcggagaggatagggactattctatatcgtgcagggttcgttgtctccgagttctacttgaagactaaggcaattcatggtataaaaggcacaccgccagaggggctcaggatcatcgaatcatagcgccaacacacctaccatagtttacaaagccgaagaactcgagccgaagccgccgagagatcttgtcaatcaatctcgacaaggatctcgtcggtatcgtcggattcatctgttccctttttactctgtggttttctatatcaatctcatataaactggattagggctattacctcacgaggggcctgaaccagtataatccttgtctcttgtctactttgatatcgtatcgtatagatcctcgtaccaacgtacctcaatacacattttatccggtctacaggtatcccccatcgacagtggtgcgccaggtaggggactttggtgctcaaggttctgccgacatgacttcaagccgctccgacaacttcatctacatcggccccaatgcaggagatccaacctcaattccgatgatgtggactcaagtcggatccatcatctttccggtctactctgtgataccgatctcgtctggcccaatctctgttaggaacgagaacgtcgcagctacgactttacggaaaaggcaaatttatgtcatcagtgcctccctccgactgtacggaaaaggcaaatttatgtaattggctaggagacatcgtaaaattgcgtcgttgctgatggacaccacaaaattcgtgtaatttgctataggacacccgagacaatattttttatttccgagaaaaaagaggagagagaaattttaaaaaaggcaaagttgccctcagccctatctaacacccctaacccatcggcaaagcaggccaggtgccgacttcgacgactactggcgagccccggggtagcagcttcggcagtggctggcgagcttggcagtggcctcgatgatggtcggcaagcccggcagcagcggcttcgatggcagtggtggtggcggaggcaatggcttcgacggtggccgatggcggcagcggcgggttagacggcggttggtgagtggctctagaaagcacgcagcggaggcagctttgatgatggttcgcgagcccgacggcagtggcttcgaggcggaggtcaaggcgaaggccacagcgggtggtgacaaacggcttcgatgatggtcaacgaggccggcggctgcagttttgatggcagcggtgacggaggcagtggcgggcagcgctgggaagcaggcggggattagatagggccaagggcaattttgtctttttgaaatttctctctcccctttttgataagaaatgataaaaaattgtctcgggtgttctacaacaaattacataaattttatggcgtccatcagcagtgacgtgattttatagtgtcttctagccaattacataatttttgggtgtcctagggacaattttgcctacggaaaaacagacgtcgactacgacaacatctagggaacaacctcaagcggccaacctctggtgcaagaaccttgtgccttgaaggcgtgttccattggcactatgctgtagagacgtgggatgcatctctttttgggcaaatatgcaagtaccaactggaccggagcagcaaacagctagaaaagaagagggcatctcctctttcttgtgtgcgagtaggtgttgcggaagcaagaagctgtgcatagctaagagtggatgaaggctaaccaaggcggcacatgagctcaagagaggggctgggtgcagctaagcagcatgatcacaactggcgaggtgtatagccagaaaagactcgcacataatgcggtctttgatctagatgtagcccgtcagccctcttgctctcttcctcttctctcatctttttctgcttttcttccgtctctcttttcttctctttttttaagcaaggtgacaccaacttaaaaccttgatggaactcatcatgaaaatcttgtcgatcgccctcccccacacttggacttttatgtcatgagacgtcaaaaaccaagtgtctgagactgggatcttcataaagtatgttccaacatcaaggatctccaaaatgaatagttgatgtagctcccatgttcttaggcatcgtatgtccctcgttcttaatcttaacctgaaatggttactgaccaagaatacctgaagatgcatactattttagaactggttcttgcttttattggaaggaaaacgtaccaagataatccgggatatctcccgtagtgctttgtttatggtcacaagctcgaccatggagacatctagctgcaagattagtgccacaaaaaaaatacgagatttgcaatatttctgataaacaaaagcatccacaaccacacttctaatcatgttagaaatgaggaccataaggtggttgtggtcctcgtacaaagaagcggcactaatcggacaagactttggagattccttatgtgagtatcaatcctgaggaactttgaaagaaaaactttcatactcatttgtggagttctcatcctctagagttgatgtctcgaacttgtccttggcttgaaggttctccttgtcaaaagatgtgtcatgcaagatcagggttatttcttgaaaattgttgagaacaacatcttgagggctagagggacaagattttggcttgataggaggttgtgatggcggttctaggattggaagttcaaaagtttcaccggaatcaacttctttttcaatgaaatctgagacatcattttcaagaaatgattcgggggactcagatggcagaacagtcgtcacctcctttgcgtacttatctttaggcagaaagtcagtcaaggcaaatcttgactgcgagaatggcagtgagaattcattcccgcctaaagagaaattgaacctgcctactcgaggggtgttgatgagatgtttctcaatagggtgcccgattagaatattgaaatcctggacttcaaaaacatggaaatccaggataacctcgttgctatcatgaatgactggcatatcttggacaaccccaaatccttcaataatgctcccattgggatgcttgaagaatttgtcagttggtgtaattgtcttatcacttaggtatgcaaacgcaaaggattctgagacaatattgacaccgactattgggctgtagagaatcacaacattattcccctctaagtgacaaggaatgggccgaggagtggaatttatcggaattacttcagaagaaagctcaacctcctttagccattcgtcactcataatagaggtcaactctcgaactgtttccttaagaaactggaattctatcgagtcaggaggtagtgagggaacatatggttttctcttgctaaagtagttcaaggtgtttccgtaatcttcatcaagatcatccctcaacaagagagcacaacccggagtttgaatttcttcggtctcaatgggtcatggctcgggaagaggttctcgggtcgaatcaggagaagtagagacttcaactgatgcctcggggaggggctcattatattcgttcatgaaggaggtgttttttagaattcaatctagaattaccttcctttcaatcggagttttgtgcatgaatgatcctacagcagtgatgtctagatagattgcagactccttttctaaacccgaataaaaatgttgcagcagcacatgatcgggtatagatagggatggcattttcacccgtggggtcaggtccaggggacccgccctataggggtgggggtggggccatttttcaatccgcggggcttcatggccgggggagggcatccacccgtgggtgacccacggggccctggggtggtatgctacatcacaatacacagcccattctaggccgaataagtccgacttgctgaaatagtggcatataaaaggccaaaacctaaccctatcctcactttttcctttcccctcactccatcctcacagctagctgccactccaccatctaggcggcgtcgcaacgaggaccccgccgcaccgcgcactgcctccacacaccagcaggctcgacgcccgcgcatggccctccccatccggtctcatgtcgtcgtcgcatcagccacctgagcccggcgaccaggtaaaccgatgtggcgtgcgggtgggcgatggctagggttcacgcgtgcaagcgccaggcagcgagcagcgcaacgggctgctaggctgtcacaccctaaaaatcctaaatatataaattgttgtttaattggaattattagaatttattttaaaaacctaaaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaatcctcttttggctttgggccgaaagtcctctctctctctctccctcggcccagtcggcccagtccggcagcagccgcccgcgcgcgtgtccgcccgctgacaggtggggcccacctgtcaggcctgtcgtcttcctccggccgcccgccgcccgaaccctagcgccgcgccgccgtcgtctccttccaaattcggccacctctttccgtttccggtgaaatcaatagaggggaaatgatcttcgggatcccctctatcttttctcttttggaatcgtcggctaaaatcgtttggaaatccgtggattcgagttcgattcggatcgatctctctcctccgaaccctagactttccttcgccgtcgccggtcgccgtgggccttcgccgccgccttccaacccctatataaggacccccaagcccgccgctacccgtcgccacccttgctttcgcctctcgccgtcggtagcgccctagccctgtgagacctcgcgtcaccgtcgtcgccgccagccgtgcgccgccgtcgctccagtcgtcgccgtcgctcggggaggtcgccatcgtggtcgccgtcgcgtcgccgtcctcgtccgcccctccgccgtcgctgtcgatcgccggaacaccgccgtcgtcgtcaagccgaaggtcgccgccgcttcttcctcgacgccgtcgccgtccgttgatcttccgccgttgctttggtcaccggtgagttcgccgtgccgtccgctacccgtgggtgctctccgttcgcgccgccgcgccgtcgttcgccggcgagtattgtcacatcctgatttttgtttcaggatttataaatcatttaataaattattattagaatttatattaaatgatctttaacttacaagtgaagttaaatgtgggaaataaaatttcctaaatataaagcatggatggatttaatttttattaaattctccatgattaagtcaactctctgaaatattctcggatttttcagagctcaattcctaaatgatacaaagaacagttcagtaattatttgatcattaatgatctaattatattttttaagagcttttcttgtttaaaaatccttaaattacaaattgttgtttaaaaggaattattagaaatgatcttaaaagcctaaaagagaagatctaattttaatttgttaaatctcaatataaaattgggctagataaaatttttttaaatactttgcttaattctataattcctagatttttctgggattaatttgagctaaggaaataattttaataaatggaattgcatttcatgaataatttaaattgaaaaaggtttttaaaagtctcttttggctttgggccgaaagccggcccaaaacctctctctttctctctccctccccggcccagtcggcccaggccgccgccgctctcctctctctctcgctgtcgctgacaggtggggcccgcctgtcggacccgtcttcctccttcggccgccgccgcccgaaaccctagcgccgcgccgccgccgtctccttcccaaattcggccgcgtctttcccgatccggtgaaatcttttgaggggaaacaatcttcgggatctcctcttccttttctcttatagaaactccggtcaatttcctttggaaataggcggattcgagtttgattcggattcgtttttccccgacctttccttctcgtcgccggcagccgtgggccttcgccgctgcctccttgcccctatataaggatctccaagtccgccgctacccgccgccaccctcgccttcgtccctcgtcgtcggaagagccctagcaccgtgagacctcgcgccgccgtcgtcgccgtcgctccagccgtgcgccgccgtcgtttcggtcgtcgtcgttgctcggggaggccgccatcgtggtcgccaagtcgtcgccgtcctcgtccgccgcttcaccgccgccgaagaccgccggagcaccgtcgccgccgtcgacccgatctccgccgccgcttcttcctcgtcgccgacgccgtccgttgcttttccaccgttgttttggtcaccggtgagttcgccgcgtcgccctctacccgttggtgtcctccgtttgcgtcgccgcgccgtcgttcgccggcgagcatgcgttgccgagccgccgccggtgctgacgtcatcgctgacgtctgtcacatcctgattttttcgtttcaggatttataaataatttaataaattaataatagaatttatgttaaatgttctttaatttacaagtgaagtaaaatgtgggaaataaaatttcctaaatataaagcatggatggatttaattttttattaaattctccatggttaattatactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgattttaaaagcctagaagagaagatctaattttaatttgctaaatctcaatataaatttgggctagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagccggcccaacacctctcttctctctctccccggcccaagttggcccagtccgccgagccgccgctctcctctctctctcagccgctgacaggtgggccccacttgtcggtttcgtcttcctcctccggccgccgccgcccgaaaccctagccgagcagctccgccgccgctttccaaaattcggtcgatcctttccttctccggccgaattgatagaggggaaataatctcctcgatctcctcttccttttctcttatagaaactccggtcaatttcctttggaaataggcggattcgagtttgattcggattcgtttttccccgaagtttccttctcgccgccggccgccgtgggccttcgccgccgcctccttgcacctataaaaggacccccgagctctcctctacccgccgcctccctcgccttcgtctctagtcgtctgtagcgccctagcgccgtgccgcctcgcgccgccgtcgtcgccgtcgctccagccgtgcgccgccgtcgctccagtcggtcgccgtcgccaccatcgggttcgcaaggtcgtcgccgtccccgtccaccgcttcgccgccgccgaagaccgccggagcgccatcaccatcgtcgacccgatctccgccgccgcttcttcctcgtcgccggcgtcgtccattgatcttccgccgctcctttggtcaccggtgagttcgccgtgccgtccgctacccgttggtgccctccgttcgtgccgaagtgccgccgttcgccggcgagcatgcgagcttgcgcctcccgagccgccgccggtggtgacgtcatcgctgacgtcatcgtcgccctctcccgtgagccggtcgtggaccgatcgatctcggccgttcgtcccgtgaaccgctgccgtgcacccggtccaccgcaaaccctagccgctgacacaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaaaaatgatctacatgtttgtttactttttatgtattgtttatttggtttttattagtctttttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaaccgtgcatttattttcgaatgtcactgggtggtgtgaatctattcctttgttatggcctgtttgctttgattactttaatccttgataccttgggtgattataatttgactagttgagctttatatattggttcagctagatattagatgtgattgcttagccatgcttagaaacattagcacactattgggataacttatgattcattattatttaatgatggtttaatgatagttcacgatggttaatcgtgattgattaattaattacttgccaactaaaacttgataatggtgggttgtgagcacatggttttgagagtcctgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgtttataagggggtgattatgatccaggaatggtgcactttggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagattagatctgtacagccgggtatggttgcttcagaatggttgggcctgagcagcatgggtgtgctgttcagtgttgattaaaatttctgattaattactccactgttttacttctcttaaatgttttgctaaaagctgcttttgcaaatgagcctatattatgccaacctttggtatccttgtgcacttgcatatttgctgtgtggcttgctgagtatgtcatatgctcaccttgcaataatcaatcaacctcagttgaagaaaaaggattcagaagaagaagacgtttagcttataccccagttgagctgcctgtgggagtggagccggagcttcgctagattttattttccgctgtaattttcttcctggtgaggactaagtgcctcataagtaagtatttatcgttttagttaatttgataaatctgtatattaaattgtcagtttgtgtacctcggctgattcctggacgaggattttatgcacaaataagttcggaaattactagtgaatttccaagcgtgacaacgtcatcgttgccattccccgtgagccggtcgtggaccgattgatctcggccgtccgttttggataggatcgatctcggccgtccgttcccgtgaaccgttgccgtgcgcccggtccaccgcaaaccctagccgctgacgcaataatcctccttttccttttcaaaaataattcattattgcgtcataattcaattaaaatccacataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcccaaacacaatcctttgagcatgttgatcctatatttaaattctctatttatttcaactatgcatttattttcgaatgtcaccgggtggtgtgaacttattcctttgttatggccaatttgcattgattactttattccttgataccttgggttattataacttgactagttgagctttacatattggttcagctagatattagttatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttaagagtcgtgctcatgacaattaaggaccggttcgcgagctactattgtgaaacattaatcgtgccaaccacaagccagcgtgggcaacggctttacctttcgtatagcatggttcattgcagagcaccagactgagaagtggcggagataagcccacgggggtcgctggggagtccatgccttgtttataagggggtgactatgatccgggaacggtgcgctgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggaaggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttactgagtatgtcatatgctcaccttgcaataatcaatcaacctcagttgaagaaaacggatccagaaggagaagacgtttggcttataccccagttgagctgcctgtgggagtggagccggagcttcgctagattttatttttcgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagtttggaaattacgagtgaatttccgggcgtgacaagtatgcacgcccgagccgccgccggtggtgacgtcaccgctgacgtcatcgtcgtcgttccccgtggcctggtcgtggaccgttggatcttggccgtccgttttggataggatcgatctcggccgttcgtttccgtgagccaccgccgtgcacccggtccaccgcaaaccctagccgctgacgcaataaacccctttttccttttcaaaaataattcattattgcgtcataattcaattaaaatccatataagtgttttaatccgatttaatctttaaaaattcataactaattcatcttagctcggatttagttggttcaagtctctaaatttttctcaaattgagatctacatgttaaaaatatccacatgtactgttcatgcttgtttatgtgctgttttggtattttgctcttttctgtttagattccgacgtttccggagagtccgttttcgcaggagaagaatttgaagagttccaaggccagtaaggcaagtcacccagatcctaaacacaatcctttgagcatgttgatcctatatttatattctctatttatttcaactgtgcatttatttttggatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactcttgggataacttatgactcactattatttaatgatggcttaatgatagttcacgatggtcaatcatgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctagggagtccatgccttatttataagggggtgattatgatccaggaaatgtgcgctgtggtggattgtgttgtgcaaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaaactgcctatggagtggagccgtctgcgtcgtttatcttattttttcgctgcttagatctttattgattgagaggaactatctacctctgtaatgacgttttattcgcttattaattagagtaataattgtactctattatcaatttgttattgtgtgcctcggctgattcctggacgagggttcacacacatgtaagcgtttggaattttggatagaaattccgggcgtgacataggcgagggcaagcaggcacataggcgagcagcaaagcaggtgacggccgacgggcaaacaaaaactcaggaggtgtcgatctaaatttctgtaatgtgttctttcattgtttggtaattatatatcccgatgacttagaacatgattctggtgctttctcagtttgatgatctttggtttgaacgcagaacaccatttctttggatagaatgtcaaagttataaattatttttgatgaaccactgattgttctgctatttttttttttgctaattgaatggtgcggacactcaatcggggccccggtcgggctagggctgcgggctgttttagccccgcaactaacctcgggggcggggggagaagttgggagtcgggggcgggggcgttccagcccaacccgccctcgacccgccctgttgccaatcctaggtatagataaggttgggccaaattgcactagattaggatgtgtttggatggagggattggctgggatagggtatggccacccaaattttggaggtgtttggatggtgggcggtactgggatatggccaccccctagggaatattccctccagatgccggctctgtgcatccggccaattcggccggacagggcggcccaggaccgcgcgcgactcatgcaagtgaagtggtcgcgtgccctcacctcctcccatccttttctctcttttttctcctctgttctcaccggttcacagtggcaaaccctagctctcctccctcattcagcggtgcaccaggcggggtggttcggcggagcgggtggccgcgccggggacgagcggtaggcggggcgggcggcaggtgtcggcggcaccaagtagtgatacgggttatcggaaaaaaggcaagacaaaatctgtctcgcagcttttccagtcaccattcacacatccaatggtagatgtgtatcaatggttcgctctctcgtgaagagagaacggaaacaatttcccctgaacagtattttgtctcatgccacgaatcttaaggcacgaacatagctgttcgaattcccgcaaataatggtaaggattttctcggtcaagaccagaaaaaggattttccttaatcatacgtattaattcagggcagatctcatagccagttgtataaataggctccgatgaaggaggtggctcgtaagattcgcctcgtggagcagatagctgaaaaattgatgatggctccttcggtcaagaaggttttactggaattcttctctagggtagcaggggtgatggtagaagatgaacaaggttcggagatagacagcaaccgttccccgacaacggcggcagaaatgcttgttggtatttattaacctcacagataaaatccgcaagcgcacagaaaataccgatgtagcacttcactgggagtattctcaggtatcgatttccatagggagcgtgtgtgtcaactccagatcaggttgatccaaggacacgaagctaatgataggcaaaggatagagaggaacagtgtctacggaaagcttaactttaatcctaacgcgatacttcgggcactggccagctcgctgctcctagatatcgctctactatgcacccgggcaaggaggacttcagtgatctcgagggttgtcaccacctctacacccacctcacacctactgtgggaagcggagcaaacaccggaaatcaactacctagacaccgcgtataagcagttaataacttactttaatgttagctataaactaaagcactcactatattttactggattatagtgaacgatgatcatgtccgctgattaggaactaaccaagacataattttcaccaagcaaaacaaaattactcaaaagatatttctattataatcagagtaattaacatggcaaaaaataagaagaggattaccgataactccagaactcctccgacttcttctactctactctccctaatcaagtataaaataaagttcaatagagcctcttataattcagcgcaagcttgcagtgtgtgtgtgtgaagtgagtgaggtgaggtccttaaatagggcaggtataacggttaggaaaacgtgacatgtcctttttgcccttcaaccgccattaggagctcatctggaccatacacgccaaaccctagcctgaacggctgagattgtggttcggccgaaccctggccaggcccaacaggcctgcactttggcctgttgcctctcctcctcctcttctatccatttttgtgtgtggaaggcccatttggtcgtattttaatgtagttcttggcccacttgtgatatggacaggaattctccttcacttaagtctatatttcatccaacttcgacggtttatcacctgcattcaaatgtacacaacacttgtggaatatgtcataattaaaccctatcactatgttggatgttttatttccttgatttatgcaggtattttgttaggagctaccataggcagcccccgattacgcaatgcgtatgtgtggacgacgggaggacgaggtcaatagcttcgcctccccggcgccgtgctgtgagatggaacagagagggagagattagagagaacagaggaaggagacagtagatgagattaaatttcttgcttggatttaaccataacaatccacggcttaagtagccttacatgctagcaaactttagctaacaaacttgctaattaaaagggataacagaaacaaattatcaagctgatcctaatccaccgaattcagtggcacgagatactattcctcgtccggcacggtgttcgtccgtccgcccgcaccgctgaaagggaattccccacataacatattggcggcataaaattggcatttagcaactgccaacagttaagttgagggacctccggtgaacttagtccttttaattattgggctgtgtcttctactttctacaaagcccacagatattttttcgggcagattggaaaaagttcactttgactccttcaaatagaggttcgttttgacccaataagtattgaaaccagtgcagaatgactccctcggtgattttgtgggtgattttcgctggcgtggctagttgatttggtctaacctgctgagtcatcatgtaaggcccacatgtcagtgtcacatatgtttccttctctcgttcctttttctctcctccctccactttctctctcaaccttttctctatgctccatgcatctccctcggtgatggcgagaactcttcctctctcgataatcatggaagctgcagccaagacggcgtccaagaaggaaggaagtgggcgacgagcagatccaagcagcgtggtggtccttccatactcccgcctcccgcgccacgccctcggtcgttgtgggcgtgctcccttgaggacgcgtcgccactgctgacgcaaccaacggagccgatgctggcgctgccgcctccgtctcaccttcttataagtcccaacgctaggactcgtgtttgtgctagatctgctggccgaagcaggcgagatagagaaactgctggggaaactgaagcctgctcgagtggatcctggtgacctccagaccttcctcggatcctctgcagcgacggaggagacaatggagttgcgcatgcgagcttcctcctctgccattggtgccagttcatcaaggacgcacgccgcaggcatgaagtagtgggtagcgtagatcgagtataggtacgtatccactggatgggtggtgatcagttcattcctatttcatagatcttgttggtaggctagtcagattttttttatctaaatctctctttttcgaactgcatgagtgcttaaagttttgaatttttcatggccaagttcatgtgtattgtgttgttttagttctaagtttcttgaaccatggttcttctctcctgtgttgtttttgtgtttttcagagccttgattacatcttttgatagcaaagttcaatgtagttgtgcagacattcgatagttgccgccaccgacagccgtatggtagacatcaacgagctcgacgagtgggcagctggcggcggctcaaccacttcggcacttgtgcccatcatccccaccgtgaagaggttgttctcgacggctcgctgaagagaaggtggggaagttcctgacaaactgggcccactctttttttttaattcatatgctgactgggctaacacgtatacaccacgtcaaccaaaaccgctatcaaaatagctgagagagtcgttttgcacggttttcatagttataggggtcgatatttttggttttacgtttaagggatacgaattagatctgacgtatatttgagggagtcaaattgaatttttttccaggtagattaggagcataggacttcattcaaatgtttcttgttttttttgggcttcactgctggagaaaccatttattctcccggttggtaacccctttagtcccggtttttcaaccgggactatgaatccgggactaaagatgcccatatttagtttcggttgaaataaccggggctaaagatccatttttgtcccggttggtaacaccaatcgggactaaatataccttatctttagtcccggttggggactaaagagagggtagcgacagttccatttggtctctttttttttcattgttttttagctggagtttaatccctgtattttctcccaaatcaagtgggatacatatcccaaatcaaacctcaaatcaaagtaacatcccaaaacattcccattacaaatcttaagttacttatacacacaaatcaaatatatcataaatcttaaaaaaattacacacaaaccaaatacatcacagattatacatctcaggtcatgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcccctttccctccctctccctcttgggccggctcggcccatctacctacccctccctctcctctccccgcggcccatccggccttcccccgcgcgcgcgccgctgacgggcgggcccgcccgccaccctcgctgacgggtggggcccacccgtcatccccttcctcccgccgctcccgccgcctcgcccgcgccctagcggcgccgccgccgcgaatcccgccgcctcctgcgtccccgcgtgcaatcagtagggggaattattccccgtgattccctctccctttccccccacttttccctctctctctcgcgttcaaacgggcgaatttgcccccgcaaatctcgccggcgccattgatggcggccggacctcccgcgcctattccttccccgccggccggcctctccccctttcaaccatatataaaccctccccgcgcctcctccgaccgtttccgcctttcgccgcccttcctcctcgacggaatcgagctcgcgccgtcgctctctctctccgccgtcgccgtcgagctccggtccgccgtcgtcgtcaccccggaccatctcccaccccggcgtcgcctccttcggcttcgccgcatcctcggcgaccttgtccacccctccgtttcgctcgccgaccgccggaacgcccccgtccccgtcgacctgagccgcgccgccgccttcgtccgctccggctgccattccgtcgtcgccgtcgacctagggtgagccgtgaaccgccgcttcttttcccccttcccttcccctctctcggccgccgctccgccgtgcctatggccgccgccggcgaccataggggcgcgggtgcgccgcctccccccggctgtgccggcgtggccgccttcgggcgcaccgtgcggctgccgcgtggggcccggccgtcagccgcccgcgccctcgggtgcggctgacgcgtgggacccacggcgccggccggtgtgagcccgggtgcgcccggtccatcgtggaccgtgaggctgccgcgtgggccccactcccgtggacccggtccgcgcgcccctcccctcggctgacgcaataaaccttttttttaattaaaatttaaatgaagaaattcgcaaatattcatttaaagagcatataaacttcaaatggccaactcggaattggaccgttcaagtctctaatttttccttaagaagtcaagaacccatttttgtgctttgtttcagcttgtatatggagtttattagagtaaaagccttttcttttccgttggtcgtgtagacgctgcagcttcagaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattatttccttgttcaccctagaataaacaaaaccccaactagtggacactctactcatggtaccactagtatgattttaggtagatgcttcgctggttaattaggcaacattatgtggttttacaactctagactttgggatattcatatcacctggacactatggaatggtttgattattgtggaattggattcacacctccccctctattcaaaaccctcaaaatggttttaggctgggctcggggtgcatggttttgatagtagcacctcggccatacaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctcggggctcagtcctgactacctgtcacatcctgatttttgtttcaggatttataaattatttaataaattattaatagaatttatgttaaatgatctttaattttcaagtgaagttaaatgtgggaaataaaatttcctaaatataaagcatggatggatttaattttttattaaattctccatgattaattatactctctgaaattttctcggaattttcggagctcaattcctaatgttaataatacaaagagcatttcagtaattacccacatattaaattaatcattaaatggtctgattataattttgttaagtactttgagtgttcaagtattttcaagatttttcttggaattatttgagcataggaagtatttttaacaattcaaagatcatttcagtgattaatttaattggaaaagtatttaaaatccccttctccttttcgggccgaaataggaaaagttcagcttcagtcctcggcccattctcccattttttcggctggccttatccctcctccaaagtctgctttgtgtccctctttcaatcgggccaagaagtagaagcccagccgaaagtctagttggcctccctgcgctactgttcatcttccagctctggacagagcccgagccagccgagcctgtgcacagtgccgccttcttccaccaaatccggcctcctcgttgctcctctttccaaattagttgcgggaatggaatcctctcaatctcctcttccttttccccaagaaatccccaaaattttatatggaaatcctttccaatttcgcggttcaacctttcctttttccggcgaaccctacctaatccgtcgccgattccatccgttcccgagtcgttctctccctcttctggctatataaaggaccccctagtcctcctctttcgtttgccccctctcccgtggtctcccgtgcctcgtagcgccgccaccacgtgctccaccccgccgtcgtcgccggcgccgctccagccgccgtgcgccgtcgccccggccgtcgccggtcagtgccgtcgcctccctcagcttcgcaagggtgagagctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccaaaatccaccggagctccatcgtcgccgtcaaccctgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggaatcaaaccagtcgggagagaaccggctttcagtcccgtttggattcccgaacgcggctgaaagctacttcaaaaccatctcaaccgagtcggcttcaaaccactcggccgagatcgcatcttctccaacgacaccagatcaagatgatggggcttacccaccagtcctgatgaagctccccgacgatttggtggccgtctccatcgcgacagcgtcttcttcccgtaggcctaggcggaagtcggcttcaacactgatttcgcctagcttcagggaagttggcgtcatcctccaaccactcggcacggtttcgacggatcagctagatggcgactacagctctcccaccgtcgactcgcgccccaccaacatcgtggagtacgacgagtttagctctcgctaccacgatccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacgattacggcgtgagcagcaggagcgtgagcggaccgcgaaggaggctgaagatcgacggcagcgagctttggaagcagggcgccgggcgcgtgatctcatcggccagcaagatgttgaagggacgccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcagtcccagttaactccgaaagcgtccacacgccgactggtagccgagtccctcacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtagcttaccgtctacggtcttgcaatccgcgcagcaggaggagacaacaaggccatggcgaactatttaccagtggctttagcagattccgcccgatcttggctccatggattgccccgtggtacaattggatcttgggctgaattaagcgaccacttcatcgccaacttccaaggcaccttcgagcgtcccggcacacaatacgacctctacaacgtcattcagaagtccggagaatcccttcgagattacatccggcgattttctgaacaacgtaacaagatctccgacatcaccgatgacgtcatcatcgccgcattcaccaaagggattcgccacgaagaattggtcggcaagttcgggcgtaagccccccaggacagtcaagcttatgtttgaaaaagccaacgagtacgccaaagccgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaatttgcggatcaatacaccaagactgcacgaaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgttggtcagagattgcaatcaagtttgaccgctcggatcatcctgaccgagtggtccacccggggcggtaccccctggtactagacccagtggtccgtaatgtcaagcttcgcagaaccctcattgacggtggcagtgcactcaatatcctcttcgccaagaccttggatgatatgcagattcctcgctccgagctaaaaccaagcaatgcgcctttccacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcacgagatggcgtctgcccgagaggttatccgactggctgcagccacggcgagcgaaggagaagtgcccgctaccaagatttcaaagaatggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgcgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggtgcatactgctacgtcaccatgccgtttggactaaaaaatgcaggagcaacttatcaacgtatgattcagagatgcttctcaacacaaattggccgcaacgttgaagcctatgtggatgatgtagtcgtcaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagccgactggatgcatggcggcgctcagccgatttgtttcaaggcttggcgagcgggggatgcctttctttaagctgctgaagaaaacagataacttccagtggggacccgaagcacagaaggccttcgaagatttcaagaaactcctcaccgagccaccagtcttagcctcaccacacccgcaagagccgttgttgctgtatgtatcagccacctcccaggttgtgagcacagtcttggtcgttgagcgcgaggaagaaggccatgtccaaaaagtccagcgaccaatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttcttcgacacaacaatgaagccgccgacagacttgccaattttggatccaagcgcgagacggcgccctcagatgttttcgtcgaacacctttatacaccgaccgtacctcatagagatactactcaagatgcggacactcatgacgtagctatggttgaagccgactggcgagagcccttcatacgatttttaacttctcaagagctcccttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgt

SEQ ID NO: 62239 - DNA, 27187 bp, Oryza sativa
tacagctccgttgtttattgcatccaaaaaagactgtgttacaccagcaagtacaggtccagtcatgactgtaccagcaacttgctttggccttgtcctctctaaaatgaacctagttaattcatcgagtcctgcttgaaattcaggccgcaatttctctatctgcgaacaagacaatggtccaatttaagtggtgcccacagttctttcagatatgttgtgcacacttatttcagcatgcatcccacgggaagggcgcatctggactttgggatagaaaggtgggatagagattggaatatggggtgcattatgactcgctccatttccttgttcctatctccactcttttccctaaatccatatgcgccctagtgataacagaagggaaagtgacttacaggaatttgatcaaggcgttgaagttcattctcactgttcaatgggcgcactagtgtgaaacattctctatcaggaaagagggcacggatggactcacggatctaagacaattcaaataaacaattaataaaattgtaaatcacaatgaaaactacaaaaagaaaattacaggtgttagtactctagagtacctcattctttgaagatatatcttttcctctgccttcaagaggcctcagagcgatttcaagataatctcgtggagttatcttcctgtcgttctcaactaaatctaggtaaaaatcctaaaaaaaggtatcttagactagagaaatccttcaatagtttacaaaaaataaatggaaaaggaagatcaaaatcacaaatcaattaccctcagtagccagatgaagataggtgagaattgcccgagctctgatgcagtagacttcccaccatttgcccgcacacggatatgcttggtcatttcagtaacaagtgaaaggcgatcaagagctgcctcatcgataccacccatctgcaaatggaaagaacaaagaacagtaaggtatatttattgtgcatttcaacatgtttagtgccaaaagataaaacacattgcaattatgttatttctcatgccttcgggggtcacatcatcatagcatcaataatagagaaaattgtgatctaacttgacactcaagagtaggatattaacattcctaacagaccatacctctagtttcctaacaaaactgacacattaccaaataactaatacattatacatatgcttggaacataattaattatttggacaataaatattcttattaatactttgtaatctttgtttgtaaaggattgcattgtcttcacacatgtatatatgcatggctagttgatgcaatgcacgcatgcagtttgttgcattcaaggctaattatttttcatttttaagttgaacttatgatatatttaattatttatttaaaacgcactttgggcactacactggtaagagaaaaataaatatggccaaaaaagatactaccaaaaacctcagtacataaatggaccattttgttatcgtctgtccacaagaacagacagcctattgaagccattctagttgcagacagatagtgccaagtcaatcaggtacctttaatccttaaaaagaggagctggcgatcgtgttctctacaccctcaatccagatcttctgttgatatatttatgtatatgcatgtgtgttatattttgttttgccaaagtatttcattatttgcaaatgcatatatgagattgctggttgataatatgatgtatggatttttttttaataacaactgacttttaaaattgaatgtgaaatatttattcaagatcagtcacaacacatgggcacaatgctggttttctatacagcaaggcagcatcaagtcatcaataaaatttttatgtctcgaaacaaccctttcaggtgtttaacagtttagtcattgccaaatggtgaggggagtgcatacaaattgtttgactgtttctttcattcaagtatctacccaacattcttttccaacttaaaaaaaattctgcttctgctttctttctctactctaaaatcaacccctaatgcagcagcagcatcgctatgttgcactaccttaagattccgtcatcaactcaaactcaattaaaatatgaattctcaaaccataaagatacttagacaacctttagccaaagtataaattatctgtgaaccttttcataaattttggcatttgaagtaaatttccttcaataactcacagtaaagcatgcatgatataccagataatactataaggtgtacatagataaggcaagaatgaaaaatcccataatttattaagtgaaattcggtcatatgccagaacggaaggatcaagacaaaagacataattgcaccacacctgattatatataaacatacttgaaagtaggactgccagtgagaatatctgaatgctgtaagtgccctgccaaagaggaaacaagtcagtaatgtatagactacagattaaaagttttctttttcattactacttttcttgcatcatcacaaaaacaaaatcttggacaatgctgaactgttttcagaaaatgcacaagaaaataagggaaatgcatttgcataagccatcaagcaattgttagatcaaaacctcttccattcaataagcaaaacacatgaattgagtgatgatgttaaacaaaaattggggatataaaccagatagatcatctcatcagtgcactaccttgaattcattgagaacaaattgctgccttgttttgaacctctagtcgaccagaaaaacaaaaatgtgaaaatgaacaggaaagcagacagatggatattcagacttcccaagtttccatacttatcaaacgatgatgtatacatgaagcacagcaggtttctatgatctgaaattccgggttttcagtttttacttgtatgcatcatgaaatttcataatttggctcaccacaataaaaaaattattcaaaaaaatatctgttgagatttcatggaaaattgggactagggtacaagaatgaggtcgatgaggtctggtagctaccataccactagggctagtccataaatttaggggaaagtaatcctaaaatatatggaaaggacttcaaagcttgaacatattcctctacttgagcttctatacaagtacacataaactcataccctaagcactaggaaacctagcattttaagcatgaatatgtttgacaacacaccagggcaatatattacattggtaacatcacatgataaaggtaaatttaattactgacctacacatcatacaagcaaaagtcaagcagataaaggtaacagtatcagtatgccataggtaggccagaattgtaagcatgaatatgtttgataacacaccaggagaacactcaattacatcaataactccagatgggtgcagtctgctaaatcatgcatacataaaaagggctgttgcataaacgtcaatgcgtgcatgagacagcataaacatttgggaaatagcaaaggaacaggtgtttgttgaagaatggacaacacatagagaacacatgggatcaatatttgaagaagctgaggcttagcaacaaagtgggatcatcgaggtattactcaatactcaccgtctgatcgtatgcatcaatgccctcagtatcaagaagcaaaagactatattcagttccatcaagtgcagttctttttattggggcactccacatccaaaggcccttggtgcagggccgatgggtgcttgctacttgaaatccgctgcttcttcctagaagctgtcaaaaacacagaaatagagcagattactccttgacaagataattagctggtatataaagtactccgtaatcaaaatcttgatatatatgaatttgctaacgaggcttcaaatgcaagaaattgagatgtcaaaaacagactcttctccaaactacaaagtctaatagaaatacttttacaggtcatgctctgataggagtaaaaggacatctgcagtcatttcacacccaaaaaaaatgaaacttatggtaaaccttgttagcatacatcaattccacaaaatagaaaatataccacacttagtccatcttcctttccgattttattttcaagacatcataatccttaataagtcattatataaataccaaaggatgtttcatggtccactagaccagaatcaatgttaaggtctaacaaatataaaatatcctcaggagaatcttgtaagtgtcatcagtcatccataaattcatcgaatcaatgaccaaagtaaccgggcagcaatacgccaatatggtagtacacacaatgcataagaaaagttggccctctttgattatttaggaaagttgcatgccttaatacacccaacctttatcacggttctgaaagaatgtatagcggaaagaagaaaaaacagggaccaaaactgattcccgcaggtggaaagtttattgagaagaaaaaacacggtaagcaaaagttttacttttgcaatgcaatttctgcacgagacatacaacccacgaaatgttgtcttttcttcctatttctaaatgaaatgtttacgccgccaaccaagaccccaaccttccctaccagtgtcccctacagtgcctcgaactgatatttatttcttccagattcttatcaggatcctactagtgttccagtgccgatccacaggacagatttgttcaaccattggtaaaaagaagaggggggcgagagcgaacctggttaaggatgaagctcttgccctgcctggcgcggccgcagacggagacgaccccgacggggcccttgacgagctgcagcgcggccaccgcctccgggtccatccggaacctcccccgctcgtcgcagtacaccagccgcagcggccgcccacccccaccccccgcgaacggcgaccgcggggaggacgccgacgacgacggggtccacggcgagccgtggcccggcgacgcctcgtccccgccgcggcggccccggtcccggtccttggacgcggagccgcgtagccccagcatctgcatcatcgcggccggccgcggggagagagagagagaggggaatggaatggatcctagggtttggggctcgcgagggtttgggggtgttgggggattcaggggatggtcgcgcttccccaggaagggaggaggagacgagagcttcggtggccggtggaggttgtgggctgcgcctttccttttcgtgaggacggttgccttttttttcgctgtctttggttggaggtggggcccacttgacgcgtgtgaggagaaagttttggatatctttcatttggtatcaatgctctgtgatctgctcaactgttcccagcatcaatcggctgagcgttaatgggagctaaaatttgccaggattggattaaggtccacacctctctcataaaagcacagtcccataaaaggtgatttgtgtcctcgaaagcacatgtgtagaggcaacaaatccagttgcaaggccaatgccttcgcagcagattttgagctgtcaacgttttttatggagaatgagccagccaaaagacctcaattttggttcagctggggccgaccagagggaattaaaatcgacacgtgtgtaggatctttcgaattaataagagtaagcactcttacttgtgtagcaacccacagtagtccaattctaggaaatattatcagaaccttgtggtagttgaacttcttgccgtaaacctcccagctgcactaggtcattgatttcttcaattgatgtaagatatctaaaagaggtaatccagttgttggaagagagttccatcaacacacctttgttttcttttagccagacgaaagcaaagaggtgctatgtctttcggacatttaccttggagccaatgatcgtgccagaaattcatttttttaccatctcccaatacgtttgtggttgctgcttggaacaaccgtctatcagtatcatcacaaggcactttcatgccaacccaaggtttatcctcatctttccactggaaccacaaccagcgtagacgaagaatcctggaaaatctttcaagatcagggaccccaagtcctcctattcttttcggtctgcaaactgttttccaattgaccaagcagctgccaggattagtgtgatctgggtcttcacctttccaaagaaaggaccttcgaaagcggtcgatcctcttgaaaacccatttgggcatgtgcagagatgaaaggtggtgaattggcatggagctaaggaccgtttttaccaacgtctcgcgccccgaagaagtgaagaatcgacctttccaagtgggaagcctttcccctattttttcaatgagggggagaaaatcaattttccttaattttcgataatgaagtggaaggccaagatatttgcaggggaaagatttaacgatgccggggaaagcttgcagcaaagaagcaaggtctacctcttcacacctaatagggaaaatctctgtcttggcaccgtttgtatgcagaccggacactggcgaaaacaattaacagctaggtaaaaatgttaagctcagaaatgttcggctttgcaaacactgcaacgtcatcggcatataacgagcatcgaaatctgacccgatttctatcaatcggggaaagtatggaggtattttcggctgcttatagaatccgatgaaaaggttccattgcaaggataaaaagcattggcgataacgggtcaccttggcgcaggcctcttgcatggaagatctgttgtcccggcgcgccattgacaagaatttgggaagacgtcgcaacaagattcgagatccagttgagccattgagtgcagaaaccaaattgttgaaggacatcaaggaggtaaggccaacataccgtgtcgaacgccttcgcaatatccactttgatgaacaggctttgctttttagtcctatgaaggagctgaaccatattttggacaaaaagaaaattgtcatggatggcccttttacgaacaaacgcactttgattttgcgagactaactcattgagtctcggtgccagccgattggccataactttggtaatgatttttttgaagctgtgaacaaactgctagcatcatcttttttttgggaggagacataaaagccgaattcaaatctgcaaggtgtgaggtattaaggttcatgaaagaagagatggctgccagcaaatcccctttgattatctcccaagctgacttatagaaggcttcgataaaaccatccggtccaggtgctttttctgatggcatctcgaaaattgtgttcctgagttcttcagaaatgtctccttcaagatcagccaagtcccgaaggtatttgtagtgagttccagttcaaccgcacacttctttggaaattggtacccaatctttctttgtagaaacggtaaagttcctcttctttatcttggtttgtgacagcaattccggttggggtctgtaaagactgaatgaaattctttcttctccttgagttggcttttaggtagaaaaattttgaattaacatcaccctccttgatccaggtgagtcgagaccgctgtctgatcttaattttgttaagcactgcaagccctagcactcgagatttcaggttagagattaacagacgttccttgtcagatagacttcttgattcttgtgctacgtcaagctgaaaaatgactacagtcgccaccgcaaattgcagcgcaatgtcccccacctgacttttgttccacctcttaagatcacaagctagtcgacaaagcttgatcctgaaaactgcaagagggttggtggcaaagattgatctgtgccaggattcttgaactacttccaaaaaacctggaattttcaaccaaaaggcttcaaaacggaattgaggtggtttgcttcttttctcttttccaacaaggaaaagaggtgcgtggtctgaacatgtagaggagagggggaaaaggtgtgcttctccaaacatgaaatcccaatcagttgtgataaacgctcggtcgatttttgtttgtgttggatttgtcccatctcccgcccacgtgaagcgacgaccaggaaggtgcagctctttcacttggattttatccaggagaccactaaaacgttgtatcatccttctattgagacgatcattatttttgtcagaaattttgtagataaaattgaaatctccgatcaccatccaagctggtttcatggtgggttgaagtgtctctagttcagccaggaattcaattttttcagcttcgagttgagggccatatacaactgtgatcgaccattgaagcccttcttcgcgcatggttatagtagcagatacagagtattgactgagaaagacatcagagagatagaaataattttcatcacaggcaagcagtattccacctctttgccatcagccggcagtgcagcatattgctatgcaaatctctgtccaagagagttgaggaggatttgggaagagatagctgaaagttttgtctcttgcagacagacaatcgacgcgccgtattgttgaatgagaagttttatagcatcttgtttggctctggcatttagacctctaacattccaattaaagtggaaaacattttcttgagacatggaaacacagatcgactaagatacaaactagcaatccccagttatagccgttcttgccgaaacacaacccagatagacagggagaaacacaacaagaaggggtggagagctgcatacagaggtgatgctgagttgcagacacagtttctaccaacagacacaagacactcatactgaagcaagtccgggacagctgattgcgaagtgagctcgggaaagacttcattaaattgcttggcgaccttgcagcacagctccggtcatgcttataccggcgccaccgcagacttcttggttgtggccttcaggcgaatgctcttgcagccacccttctcgaccaaatgcgcgattatctgcagagacaccagagagagtggtttcttgtacaactgcaagtaaattttcttgatgttatcatcaaaggcagatttatcatcaaacaacccaaaattttttgacaggatttcctgggcaaatgtttcaagttttgcacccgtgcgccgtttacaaagcaaatgctcacttgctacgctcacatgctttgccttctccgaggtctccgatccgagaccacgccttccttcaagctgacacttgcttctcctcgcaggatgatgatgtgctcagcttgctagagcggcaccttgatcccttgattcatgaggcttctgtgcagcactccatctactcgcctgactttgactcccagcgtatttcctcccctgttttcactacttcctttgcagctcagggaggctctgatgctgatcagggggcgaagtaagttgaggcttttgtcaacaacataacaactacaatccagccgccgctccttcccaccccagcaaccaagttcgtcgccctgcccgtaataaggtggtaatcccgattctttctccggtacagcttatcaatttatcatcctggttttttggctcctctattcctgtcatttgacaatgatggaaaaggtgacaagagtgagataatggaagagcaaagcgtacgcacctcattcgagagtcaagaaagaggggaggagcctctttacaagctgcttgttcttgttacatcttgattcggtctgttctgtttctgattcgggccattcggccagttctgtttctggttttgaaatgtctatgtgttggacggacgagaccagatcaaaatactcactgccttctctgcacagtctttgcaagctagggcatccccatagaagtagctctttgagtgtggggagctgctgtaggagaccctacagaaatttctctatctctgggcagttccaaatcttcaattcttcaagtgaaatgaggccatccatcccatcaggcaactctttcaggtcataacagtgctgcaaactcataatctttagcctggccaaatttccaagcttcgaaggaagcgccaccaatcttgggcaatatactagacatagcttttcgagggatgcaggcagcatcgggatatgtaattgaccatcctccgatgatgaaccctttccctcaaggttacgacaagtttcaatagacagggatcgaaggtgaatcaagctcatgagctcctctattggccagcgcacaaggccgtcgcatccactaatagacaagtcctccacaaaggcaaagcatttacatagcccaagatgtatttttgagaaaccagatacatctgtgaagcagttgaggcgatatagcgttaaactccgaaggttttctagtgggccttggtttgtaccgacctccagagtggacattttgttatatgacgaactaacatctagtttcgtgagagatggccatgagcccaacgacattctcacacgctcattgtcctcataaatgagttcagacaaagttgttagatgtgcaagtgagctcattgcaagactgcaacatctagctgagttcaattcttttagaactgggcaatctggaacacttgcaagttttggacaatcgaagatatatagctttgcgagctccggaaacgtaaccaaaatagtatcggcctcgccaacagtattttctgtctatttctccaagtttgataactggcatagagtcatatcctttaaccttgggaaaatttgcagagggatgtagtatcattcggctttcacaccagcgacattcataaacaatgtggttaggtttttcattttagataagaacagaccctcaagcgagaccaaaaaccacacagtcgatagatccttacatcctggacagttgaaaatgtggagatttgttaggcactgcaacaactgtgggtctttcatccattgtgggatctttaggccactatatccgtgtagttccaaaattttgagcttagcgtgaggtttaagagactccaacacttcttcctcgttgcatcccttgttttcaggcatgcaaaatatactaccaccctaagaaagtactagttcacttagattttgcttcagatggagattggcatcttttccattttccctgctatttattttactcaaattgtacagttccaacctgtttttgctgggtcggcggaaggaagtcgaccaaatttcattaagataaaagagggtaatacaatatacacaacattatactgtcgagtcgagggaaacctcgaaaaagaacaggaaaactatttacagggggccaaaaaacatgctgctactccccgcaagaaaaaattccggccgctctccagatcaggacctcctctttgatgtctgccaccaagtgttctaccacccttgatctgtcataaaaaatccttgcgtttctttctttccaaagcttccagcagaccaacatgaacagagaatcggaggcggccctgtaccttgaccgaaaacagagacgcacctgcagccaccattctgcaagctgtagaccgagctgatcaggaaggggaaacgccacattcagctaagttctcaactgatgccacactctgttagtgaaagagcattttgtaaacagatggatgcagtcttccggcgcagctcgacacagtgtacatgtcgtatcatgtggccagcctcgtttgctgaggttgacagccgtaagacaccggcccttcgcagctaaccaaaggaagaacctcactctcgccggcgctttggtcttccaaatcagctcaccgtgggggcacttcaccgaagggtagaagaagaactcatatgcagaggaaaccgagaaggcgccgcttgctgtaaacctccataaaaccgaatctgactgcccgtcttgaagagacacttgttgcagctcatcctataaattcagatagtcagcaagggccctattggaaatggacccctgcaagtctctaacccacctgttgttcgtcagtccttgagccactgtgatcttcgttcgaccgacaaagcagaaaatgataggccaattatttacaatactttccccacgaggcagccagttacctctccaaaaattgatgcgacggccatctcctaccatgtgctgtgcaatcgagctgaaaatgtcgcggacatccttatcagattcccaattagccattgtccatggcctatcttcatgttcaagcctgttaaactcccatttcagtcgtaaaaccttcccgaaaagctcaatatccctgattcccaaaccaccaaattcaactggcatactgacggctctccaagcaactaggcaatgaccccattaacttcttcttgacctttccacaagaaacccctgcagcggcgttcgatgtccttgatggcccattttggcagctgcatcacagagagaaagtgaaccggaatggccatcaaaattgatttgatcagacagagccgcccgtcaggtgaaaggaactttgatttccagcctgccacctttttagccaagcgatcaaaaagaggttgtaactctgcttttgttggtttcctcacggagagcggaagacccaaatagaggattggaaggttctgaagtttgcaatgtaaaatatcctgaaccaaggagctttgttcctctgtgtagcgaattggtgaaactgcactcttggagaagttgggaagaagatcagtggcttcactaaagagatcaagcacggctttgactagcatggcctcatgacgaaccggtttaaagaagatgactgcgtcatcggcatagagcgaattatttggtgctctgctccggtggttaactttatcaagcaacccggctgacattgctttctacaacatagcatgaagagtatccatcaccaggacaaaaggaagaggagataacggatccccttgtcttagccccctcataggcttgaaggggtcacttaaagtgccattgatgtcaatctgaagttgtaatctgaacgagctgattttccgctgtccccatttaccaagtgccttgcttaatcttgccatcttcacatacaaaatacagaaaggatcagagctatcgacctcactcccccaagactcctgcactacgtcattgaaatcatcaagctttgtccaaaaggtttcaaatttgaaccttttttttgcttagggactcggttaccccaggttaaaagaagaggacagtggtctgaacctgaagaacttagagcctgcagatgagcttcagggaagagatcctcccactgagtggaaatgaacaatttgtcgagtttcaccaaagttgggattgcctgctcactgctccaagtatatcttctaccaaaaagatacatctcctttaattctagatcgttcaccttactgcgaaaagcattcatcaagcgccgattgatccttgtgttattcttgtcttcggctgctgtaatgaggttgaaatcaccggctatcatccattcccccaaacaacaattcttgatgacagacaattcctccgaaaacaacagcttctcatcatccctttgagggccatacaccgaggtcacagcccaggatctccctccctggcgccaatccagattaactgtcaccgaccattgtccaacatggacaagagtgccctggaatagatcccccttccacgccacaatgattccacctctagtttgaagagcaggaagaaattcaaaacgatcaaaatcagggccgcaaagttcaaagacagtgacacgatcaacaacttctaacttagattcttggaaacacacaaccaacgcattggaggaaacaacagactccttcaccagggagcacttcacagcgttgtttagccctcttacattccatactagaagattgaaactcactcctgacattacaacaaccagacacccccagcccccggctaacacagcatacaaaatcaagcaggagaagcaactgccaaaggtgccacatccgctagcgcctggaactccggctccgccagttcaagatgaagcagctccgccaaggcctcaaaatggtgaggcggcagcggttcgtcgaagagttgaacatattcctccatcgcctcatcgtttgcttcctcttcttcttcaatgattcccagattcttcatagtcacccgctgtgccttggagatggagtggtgtcgggcgcctgagccttgcagagccagccgtgggcttctccaaggcttgaaatcaactgggatcaccgggcggcatctgctcttggtgattgggacggaggcaggcggcttgctgaggacggacgatgaggacggcgtggagatagcgtcgacgaagatgttgacttgtacgcacatgttctcatcggccgcaacgaggattgcttcctgggccgctgcggctgcgctctgcacttcctgggttgccgacacagcgatctgagttggcaacatgcccaatttagagccggcctcctttcgtcgagagtagacacggtcaaaaggcaccacctgttcctgggctacttgaggaattgccaaatacaacccacggacgacttcagtaggagccggacctccagctcgaaaatgttcccccgctgagttcccaccttgggggctgctgccttcaaccgcccctattaatggaggatccaaacagaggtcgtcgaagcaaaggcgtctagcagggagcggtgtggtctgcagcgaccagcaggaagcaggcgccgaggctggccttggactgctctcttcgtcttgggagttgcgaccgtgaaccttgtccacagtgcaatggtgtgccacaggagaggttgacctcgtgacctctctgtaccgtgggccaccgtcatgtttctcgtccgccagcatcggcgaactgcaccgtgaacctccgccttgctcctcgaccgccaacacgaacgagactgtcggggcgtgtacctcgaccccgccgcaccatcctccgccgccttgctcttggtccgtcagacgcagcgaatcggagacaacaggcgagcacctcgttggcaacatgagctcagcaacaggggatcatatcgcccctgcacccggtacagcaagctcgaacacacgaggtagggacggcgagatcacctcgacagtgtcgaccaccacttcgggcgagaccagcaccatcacctgagtcaacggcgagaattgttaaacgtcgttgacttgcgccacctgaagcgacgcgttgatcgtctcagctgaggagagaaccagaccccataggacgacggcaagcagcgccaacctcaggggtaaccgaagcagccacaccaacagccgtcgccgctacctcgaaaccctgcgttaccggcacttgtgtgcccagctccctcgtcccgacgacagcagcagcgtctggagaagacgggagcagatcctcccccgtagccgacgaaccgaaacgaacgatggccgacacagcttcctccgtgttgaaaagacggactggttgctgtatcaccgacggcaggagatcgaacgcttggcattccaaacccccggctgaacctgatgctcctccatagcgagtgctgcctccccggtccgatggccacagacctgcgctgttgaaccacttagcccagcagtcgaaggtgttgcgccttgtcacatcatcgtcaccatcatcgttgtagaatttatcaggggcatgcagcagcatgggatcgttcacctcttcaacgtggaggaagacgccatacagtaaaagagggccgtgctctaggcgctcgaggaggagcagagctcgaagacgacttcctccaggagccgcccgcccctatcttcttaggcacctccacctgaagccgttgaggaagcttgttaggattcttgaaccaggcgaagaggcccagacatctggtgtcgttggcagggatgctctcgatgagctccccctcgagctcgttgacaaggttgcgcaccacttcgcgctcccacaggtgagcagggagcccatcgagcgaaatcttggtgaagaacttcaagtccgagctgtctgcccaactccggcggctccacagcttgaaggacgtgggaacccccttcacgaaaatctcatgagagcaatggagaacaaggttccgatcttgcagcatgcggaacaacaccagaaaatcctccgtatgtgtcacgtcgacacggacgttgctctcgttgatgccggtgtgctggacgatggcttctaacatctcccccggtgagaccgatggtcttgtcttcagaaccatggccaacagcgagtgctggttgagccaagcttcattgtgctccatgcccaccgtccaggacagcacgcaacggccagtccccagccgcagctccggctcgccgactcgaaaaccctccatgtaggcgtgctccctagccgcgcagatttgaaaacctgccatctccttggaagacttgacgacgtcccgcggatgagcttcttcctcagctcgcccaaccactctgtagtcggcaggcggagcaggccgggacgcgtgcgacccgaagcagcggacggggatggcggacgctggcgagaagtaggagcagctgtatgcggtgctggacgagcagcaggacatggcgtcggctgaacggggcgagcagcagggtgcacgcgagctagagaagcgagggaagcaggctgagcaactgagcacgggcgagttgaagagacttcgtcatgctcggtgcaaaaactcgcaagatggcccgaaaaccaacaacggaagcaacgaatctggccggtacactgcgccttctgatgccctaggccaaggcatttgaaacacctccctgcaaccactaggggatatccctcaccgccttgaatgctgatggacgagtggttgggcgccggtaggtcgccattgaatgaactcctttcctccttctcacctctatccaagccgcctccttctcagccttacctaacgtgtggtccccaatccccaccacgatgtcgcgccaggaaccaaactggggtttggaatgtggccgtcggacaccggagtggccgtccaccgggcggtgagggcgctccctcacgcgctcgctccccagccattttccccctctcccctatcagagaactctctgagtagcccaaccgaccggttccagcttggccgtagctctccagttccaatctgttggcaaggtgattcaagtccttgagctcctcgattccacggccaggttcagtgtccaaaacaaatgttgttagagtgcgaagatttttcagtaggctaatatttggtggcatcctcttcaatggacatctaagaagataaagatggatgagcttgctcattgttctcataccttccggtaaatatgtcagaagtaggcaatcgttgagccttagtgtttgtaagttatacatcgtgcatattgaacttggcagcacatccatctaagacctagaaaggtcaagatatcgtagatgctttggattgatcacctggctatgagaagggcaagcccgaatacagacaatacccaaagcacttaatgacataagtctcaagtcagtaccaaaatctcttaatgacatctgtcttaagtcattaatatgtactagtaaccatgcagttatcaaagtgtggatagaagatgatattttgagcaatcccactgttagactcatttcattatcataggaaaattcggtatatcatcttttgctaagtcatgcatcaaatcatgagttttgcaacaaattatagactcatcagcagtgaaagaaaatgtcttgatcggtttcacgtcttggaggaaggatctccaaaccaaattacagaaaacatattcccccttttgttccaaacccattgtttcatcttcctgaatgaaaccatttgccatccacagttggatcaacacttctttgtccatctcatggtcctttgggaaaactgaacaaaaggcaaagcattcttcattttaggtaataagtgtctgtagctcaattttagtataggtatatcatcttcgcccctgtcattgtcccctaattgcttcttgcaattgtttctcattccttgacttgttgctttgaactcatcataccacccattgtcttcaaagcaagaggaagccccttacatttcttgacaataagtttgccagcggttaccaattcagcttgctgttgtacctctttactgaatgctttctttgagaataattcccatgaatcatcatcactcagacatgctgggttatggtattctagggtgcccattatagatgctactcgctggctctgagttgtcactagtataacacttccatcaccaccaccaacagaagacaggagtggcttcaggtcttcctcccacttcttcttttcttcattccatacatcgtccagcacgagcagaaaccttctccggccaacggccttctgtagttccttttgcaacaactggacggtttcaggcagttagcatgctttgtttgtagccaattcaatgatggatttcagaagggaaacaacttcaaagttgtctgacgcacagtgccacatctttagctcgaagtgattctaaaccctgtagtcattgtagaccatcttggcaagcgatgtcttgcctaaaccccccatccccacaattgggcccacttgtgctgatctcgctgattgagcaacagtttgatcaccactacctccttgtcgtcgtctctgccaaagatatcatctaattcatttgatggcagcactgagtacgtctgccggtaagaaagttgttgtggctcatctcgcagcaacaggccaaacgtgttcatctcttcaaccagctcgttgatcttcttgagcactttggcaagcttccttctcatggtaaaatggaactctaggggggtcatgtagctccgtaccttgtgccctagcgacttgaggctcatggcctcgcggtgcagcacctcgtactggaactcatcgaggacgtcatcggcctcgtcatcggcggtgttgaggtccttcatccagcgcttgatggcggggttggtctcgctcttcgactcagcgtcggccaacaggcgctcgacggccagcagctgccgctccagcttgcggcggtcgccgtcgacgccatacatgcgggtgactttctggacaagcgcgtcggtcgccttgccgatcaccccgtgcactacggggagaagcagcgattctgccatacaattgctctctttcacaggctgtctgctactctctctgctacctattgatgatacacccaagaagcaaagcaaggaggctatgagtcctctgctctggcctcatccaatctaaatcgtagcacaagtcaagatgatatttttggctgtcaccgccttcaatgattcatatgattctcaagttgactgacttttgtgatgttgtcccttcaggccttcacggtgcaggaacgtggcatctcgccacgaaggacagctgctaacgtggcagtgggggaccatttctttgtgaggaacacgggactaaggccttgtttagatcccaaaaatttttagctaaaaacgtcacatcggatgttatgacacatgcatagagcattaaatatgaaaaaaaaaccaattatacagtttgcatgtaaattacgagacgaatttttttagcctaattgcgacatgatttgacaatgtgatactaagtaaacatttgctaacgatggattacttaggcttaataaattcgtctcgcagtttacaggcggaatctgtaatttgttttgttattagtctacgtttaatacttcaaatgtgtttccttatacttcaaaaactttacatccctagaactaaacacaccctaacttaagacatgagaagctcaacggaaaaagcagataaaagcatggaatccaggctgtagaccatcacccccacctccccaccatcgaaacaaacctctctctccaccgtcggggtcaccgtcgctctggatccgtgccgccaccgtcgccctcggcgctccgtctccttgtcgccggccggaagtggagggcgccgacgagctctcacgccggatcctcgctgccaccgtcgtcctccgagccctcgttgctggctgggagtggagggccccagaagctctcgcgctgctgccgtcgccctccgagccctcgttgcctcccgggagaggaggggccccgatgagctcccgcgccgccgccgtcgcccgtcgagcgctcgtcgccggcaaggagaggaggggtctcggcgagttcttgcgcctccgccgtcgccctccgagccgctgtttgggaggaggttggggagccgccgtcctttgttggagctcgctgtgctgccagccgtcatcgagttgtggtggttggggaatagagagaatgatggaaggggagaaattgtatccttgtttctgaaattgagggtgtttagtgctaaattttatacgttatgtagtttaaaaacatgtgaggactaaaatagaagatggcaaaagctgacatgaaaagctaagaacacccttagggcgttcacaatgcgccgatgtggcgttcagcctccctccccaaaaccaaatatttgttgccacatcgtccatccgcgtggcctcctcaagaacgcggagtaagttttggctacgagttcctcatctcaggcggcgggacccacacgtaccagaggagagaggggagaggagcgatgatgagggaagatgcagtggccagagtgaggaggggagatgcagcggcgtgaagccatccccaaccatgccactgtcgtcgcacgcgtgcagtactcgaactcggccactgccatcatcactcggtggtatgctcacccgagcgcaatggcatggagtgcagctccggcctccgggcacgatggcggggatgacaaacaaaggcgaaagacgtgcgccatggcggcaagggagggcctggagatggagacggcggcgccctgcattggtgtaaacggaaggagacgaatgagctgtaaatttgacgggagtaggggtgaaaacggtacggaatatttccggattccgggtaggttttcgaaaacggaatcggccgatcggaatttttcagaaacggaaacgaatacgaaaatattttctcggaaacggaatcgaaaatgataagagcagtttccgtcggaactcggaatcggccagaaactttccgaaaattctctcggaatttcgaagttacaaagtccataatacctcccgcttgcctagcccaacccactacagctaaccctagttgaggagagtgagagtcagaggcagaggctagggattttggagcaatggtagtgcattgtgtgcaccacgcaggcacgccacacgcagccagatctggcgctgtcggccgccgtccccctacgccgccgccgtctcgcgccaccgccgtctcgcgtcgtcctccccccgccgtcactcgccgtccctgcccccggcgtctcgcccctctctgtgcttcaccgtcgccgtccacgccgctgacaccaatgcctcaacgccgatgcccactggcgactcttcctcaccaccaccaacaccgatgacgcctcgccgcctgacctcgccgcccgacgcccgggcgtcgtccccctgcctcgccgccgcccccctctctgcctggtcgagaagcacaaagaagcagagaaagaaaagagatagggagagagagaaaagagacaaggaggaaagagagaaataaaagaaaagaagataaaataaaaagagagtgggacccacgcctctccctcagcgcttgactcatcttggaccagcttatagtcgggccccattaaaatatttcatttgatataattgtattttacgatgaattgttgaccgttgagacttgagaattggacttgataaaagtttgaagctcagtttaaaaggttttttattccgataaattttcattaccgtatccgcgcctgttcgtttttgttcggtatcgataatatttgtttccggggtttcctttttcgattccgattctaaaaataatatgaaaacgaaaataataaagatggttttcgttccgttttcacctctagactggattagtatgaaatgaagaaattcgctatcctagtggtaaaatcttttaaagtcttacgaattgagtgctagactcttaggctgtgttcggacgtccattgtcccaacctatctccctcgttttccgcgcgcacgcttttcaaactgctaaacggtgtgttttttgcaaaaagtttctatacaaaagttgcttaaaaaaatcaaattaatccatttttgaaaaaaaaatagctaatacttaattaatcacgcgctaatggatcgctccgttttccgtgctactgttccaagttgggaacaacccatagcgaacacagccttaaagttcagcgtattagattgtacataatgaaatttctcccacacctcccaacccaaatccgtcacccgccgccgccgacaaaaccctagacccgccccgccgccccccgccccccgcccccggccgtcgtcccatcccgccgctcccccaccgtcgtcgcatctcgccgcccccccaatccatcctccggactccccacatcgccgcgccggcgcccacatcgtcaccgtcgaccgttcgacaccgccgccctcctctctctcgcactcatcccgtcaccccgacgccgccgactcctccctcctccctcatcgcgccttcctctactcgtaccaccgccgaaaccctagacccgcaccgccctcgaccgccgcccgtcgcatcccgcctcctccccgagtccgcgacaactattcccaaggttggtgtactccccgtcctctttctcctaggtctctaaatctgcatattcacatgttagtctcatccgtatggtagttttttttctttggtttcattgccgtcatccgtaagttgacatttatcgtcaatctttcactgtaaaattgtggctaggaaatggtgtgcctctgatagtatgtgagacaaacctataaattaatagccgcacaaatagaaaaaaaagcagttgtcacaggaatgctttggtgccgtttcattattcctgttctggctattagaattcatttggcttttgccactgcaattggccatattcttacttccagtgtcctttggtaacaatattagctcaatgcacaattctgtttttctattgattagaatgatacaaggtttttttttcaggtcatgaacaaaatgcagttgcacttttacttgttttattactaattcactaagtttaagtcacttttgttctggtagatatatttccttaatctgtactcatttgttgtttgatgactctaatcgatgatcatttatgcacattgtgactttctagcttaccatttgatgttatggtttaaggcacagaggagtagcgaaacatgatcccctttatctagaagtcactaagtcagtgagccccacctttatttgtgaagactacttgttagctgttactttgtattcaggattggcagtttcagtaacagctttaggcttagttcgtttcccctcgttcccaactgcccactctcgtttttcgtgcgcatgcttttcaaactgctaaacggtgcgttttttacaaaaagtttctatacaaaagttgcttaaaaaaatcatatagatccagcgtcatatatacaaagatggtggtagtataaatttagttagttttatttcgataataaaacgaacgagcgatatcgtagcgaacactcttcgtttaacttatgatattctatcaagcccatttaaacaatgatattataacgaaacacttctctatctctgctattataaaaattgaagatgtttttatcggtattttggtacgtcatccgtgtttgagttgttttttaagttcgtacgcttttagaaatacagatatgtgtttgagttagattttaagctcgttttcttttgaaaatacaaaaggagtcgtataagaaatcttttttttaaagaacactcacatgctaacttgagataaaagttggacttgtaattgtagcttgtgattttcttaaaaaaaaaatccaagcgaattcctatagtgaattttatcctatctaaaccgtataacaataataatgttaaaatagtattcacccattgcaatgcacgagtatttttatagtatatgtaaatttatcaatgttcacaccacaactcatcattcatgattagccagagacaaacatccatcaggtgccccatgaggccatatgtgagtcgaacacgggacacgggaagatccgagcagtcataaatcaacacggattgaaactgcctaattcaatggaagctttccaagcgcagccgccgaatcctccatctccggtcagcatagctcccgctcggccgcgccgctcatccctcaccggcacaccgcaccgtcctccaccgctcgccgtcgccgccgagaagagggacacagctgccgtgcgcgtccgagtggatgtggtgtgaggcggccgggtttgaactagccaacgtcatatatacgaagatggtggtagtataaatttagttagttttatttcgataataaaacgaacgagcgatatcgtagtgaacactctttatttaacttatgatattctatcaagcccatttaaataatgatgatataatgaaacacttctctatctctgctattataaaagttgaagatgtttttgtcggtattttggtacatcatccgtgtttgagtcattttttaagttcgttcgcttttagaaatacagatatgtgtttgagttagattttaagctcgtttgcttttgaaaatacgaaaggagtcgtataagaaatctttttttaaaaatcactcacatgctaacttgagataaaagtcggacttgtaattgtagctcgtgattttcttaaaaaaaagtccaagcgaattcgtatataacaataataatgttaaaatagtattcactcattgcaacacgtgtatttttatagtatatgtaaatttatcaatgttcacaccacaactcatcattcatgattagccagagacaaacatccatcaggtgccccatgaggccatatgtgagtcgaacacgggacacgggaggatccgagccatcataaatcaacacggattgaaactgcctaatttaatagaagcttcccagtgcagccgccgaatccttctccatctccggtcagcatagctcccgctcggccgcgccgctcatccctcactggcacaccgcaccgtttctatcgcccgctgtcaccgctgagaagagggacacaactgtcgtgcgcggccgagtggatgtggtgtgaggcggtgaggcggagggaacgcggggagcttggggcacggcgcttcgagacccgcggccgggcgcgccgcaccgcctcactcgcactctccaaccgcaaggagttcaccaccccgcacaacggcgccgtcaactctctccaggtacacccccttctcactccctcactccccttctccttctctcaccttagtggtttagatcaatttgatttgtacaccctgtagatggaatcttgcgtatttggtgtgcaattcctgagtcgctcccgctggtgttttgtaatttgacaatatggtcaggttgatttgatagagcggcggtacctgctctcgggcgcatcggatggatcagccgctatatttgatgtgcagaatgcgatcgaatacgaagctgggttcattgccaagcataggagcattctccttgtggacaagcagcatgaaaatggccacaagttcgcggtatctatggccgtatggtatcctgtggacactgggctgtttgtgacagcttcttttgatcagtatgtcaaagtgtgggatactaattcgactcaagtatgctttcatctgctttgtcgattgctaatttttcttttgtcttgcctcctttgtggtggcaatggtgtgatcctgatgttctgattttttgcctggttttcttttctaggtcgtaatggattttaagatgcctggaaaagtgtacagtgcagcaatgtccccaattgcaacaacacatatgctgatcgctactggaagtgcagatgttcaggtccgtttatgtgatattgcttctggagcctttacccacacgttgtctggtcatcgtggttagttgcttacttctagtgtagtgatgaaaatatgcttgctttgtttgtatggttaccaccttatccttggtatctgacatgtcagatggtatcatgtctttgaagtggtctacttcaagtgagtggattttgatgagcggtggttgtgatggagcaatacgattttgggacataagacgagctggatgctttcttgttcttgatcaatcacggtctcaactaggaaggcggcctccttttcttgagggcacctcagataaggtatggtcaccattatccatcacttacatttgttttcaaaatatttggttgcaacgctaaagctggacttccacttttattttctgcaaaagcttcaaaaatgttgcagctttaagtaaaacattatggttgtaatgctacagatcaatactgtcagccttcaagtaaaagctgatttctgcggctattaatttataggtttgtctcacatattagtgtcagtatataggtgctatggatcagtttagtgctccaattcttacaatataaggtctgcatacattgtttcttgttgattgttgtgccctagaaatgacgcgcaaactcattgatctagttgtgcaaatgatcaatgtattcatttttaattttgactaggatcctttgaactctttacaaccttcatcttcttcaaagatttactctgcacagcagaggacaggcaagagtaagaaacagtcacacaaattgcacaaaagtcaaatccctggacatggacatatccaacagagattgcaccctggtttgtcttctagtcaaaatcgtgcaacggcgcattatggtgctgttacgggattaagaacaactacagatgggatgtaccttcttagctcaggttgattgaatttaattgctatttctatgagcattcgattgctattgcttgaaaggaattattgcctatggctatcttcttgttatgcctgtatgcagtatgcattaatgat

SEQ ID NO: 62240 - DNA, 5165 bp, Oryza sativa
ccacagtccagaacaagagatgaaaaaactgttaacttattccaaatgttatttgctgatttttattggaatcagatcctgcttaaaattcatgttttcatatgtagctcaataatgcaccaaaaagttcagaatcctttttgttttgtgaggagaaacccataactgaatcaatcaaaggtttccaagttaggaattctctcaccctgccacctttggggaaaggtttagagccattcttgcatgtgtgggcatcacagaattggcgcaagagaaattctgtgaaacaagttggataagcaagaaagctacacgagagtgctatgaggacagataattagattcaagtagtgctcagttgctcacttaccatgaagacggctggcagattgcccttgattaataggaaagcaactatctgcaaggctctattagcagaagcaaaactgagttagataatttccatcagtaggccagaaaatgctcaatgtatatcacatctattgtttaaccataagaaccaaggtagcaaactgatttatgaaagataaaggacacagaaaacttcaataccattgcaataatggattaaggtaaatacaaatagtgcttataagtaaagcatgtacagcacccatagtctgctcgttgattaggggatagataagcatgaaaatctctatccaaaggtccctcattttcatctaattaacataacaagtacaccaatatgcctgcatgcataatctggtgcttctcaacaagatcacagcgcagaacaatattagtttcaaaggaaaaaatatgtcacataagatgagaatagctaaagacaaaagttataacatatcaatgatgtgtagtttatctaatgcaatcctcgatatgtagagcaggaaatgggaatagtaatatttacacacaaacagtccaagataaaaacaaaatgcaaattagtaatagcagaacatgaatatgcttcttgatatgctatatgaatataatgaaatcaaacaaataaatggatttagaatgtccccggaaaaaaatggatttagaatggttaaaacaaaaggataagaacctcacaaagatgacgattccttgcagctgcagttgcactgcatttactctttggtttcttaaactccaacatcagatcacagtgaagtgctccacatagatcagccaagcatcttccttgactctaaaggagatagtgtaacaatcagcatttctaagcatggccaatcataatgaagaaacaaaaatagattaaacaagttagatctgcactaggagatgcattgccaagaaaatcccacagaagactgtctcgtgtaaatagttataaatggaacttcgaagagccttgaatttgttattttctcaattaatgaggaagggaaagaatataatcacacttgtggcagaaaccacacaggctacaccaatactatcaaagaaagaaagcagatatgaaactagtacaagtgatttatggaacggatgattgaaagtctcatgcaaatcggtaagaatcatacattatccacaagattattgtgccgattgtgaaaatgctgatcaaggaacttctctgctcggaaggctttcttgcagaaaccacagcgccattcatttatatcaaagtgaatcttatgctgctcctgttcccgaaacatgtcattaccaggatgaagtctacatttgcttgggagttcatatttctctttttccacaaagggcatcaaatactgcatagaaaggaaatgttaatctgtcatattattatagaggcaccaatgcactgggcattttcatgttacacatgctttacctcatcaatagctttccaagctgcacggcttctttcccttgagcaatgcacttgatttgtgtgttcatgtgacataagaagagttctagaatcaagttaaaaggacagagggtcatgagtcaagcaagagcgtttccaatttccattaaggctccaaggaatgaactactttaggaattaagaggacctaatctccgcaaggatcttgcttgtagtgtcatgccttgaaaaggcaaggtacaattttgggagggactaggtgagggtcttattttagaatttagactggcatgtataaaataaaacattaaataacatatttccctccatatgagtttgtgagcttaagtacctggatccagcagcttcatgaaattcctatagcacaaaaggaatattcagattagctagaataagggaattaggtgttcatcttaaaatcaaagagaattttctagtagatatagcagcaaattgtaatttgcactgtaacaaagtaaagatttacttatttcgtgtttatcatgagaagcatgcatattcatatcctgaaatgtcatttgcttatcagctaatacaaataacagtgtgctgctttctaatagaatgtagccattgcaagtatatgcaacaactcaaaggaagtgatgattgaacataggatggtatatcaaataattgatggcagtacgctgcacacctaccataagaacttaacttcacataaaaaacatgcctactcaacatgcacaccattagtatcaacattttactgaaataactagtagcagggacaccagagaaacgtttacatgcaacagctctcctttttgttttgcataaaaatactactataataaattaccacggcgaatttccatctcacaatcaatcgttgcaagaaaccacgacggacatcacaaagcaaattatacaaggaaaacaagtcaggtaagcaaatcatatcaacataggcaagcttgcaatgttccctttaggcatgaagcaagacaaagaacaaatctgcagatagactagctgatgcggacccaacgccaattaattctcttaatggaatgaatgacaccgtctcacgtaatgctcacaagttgagcccaagctcagaatgttgaatcatttcatttatacttatcaaatcaaagtaacctaaagcttaattctacatacaaaagaaaaaacacctcttctgcaccctgaaataacaggaactgaacgtacggatctctaattcagcaagcaagaagactaccgatccaatccagcacaagatagatatatacctggtgtgatgccgccgcaacagctaaaaggcaggaagcgaagaggacgaggtacgcggcggagcgagagcgaccaccctcccgactgggatcctccaagcttctacaaccttgtggagaataatcggaggggacctcaggtacttgttctcactgtgattcgaactgaaaaatcatgcaggagaggactttcttaccagaaaaaaggggaaatcactcactccgagctatcttggatggatctcccgctccaccccaccccaagtccagtgcagcagaggggagtaggggactgtctggagaggaagagagggagggggagctgcgggcttcgattcgaagcggcggaagcagccaggtcaggcgagcgtgctccggcgggaggatcgccggcggccggcggcgcgagcgagagaggcggagacggtggaggggaggaatcagctcctctgacttcagccctcacgacggcagagagcagtcgaggtcatccagccgtccacgttcgatcgaaccgtccgcccaaaaagcgcacggccgcgtcgtgagtctgggccaaggccggcccaacaagccccgtccccgtttggccgccgccatcgcccagccgtgctcgtactcctcgtctggccgccgccatcgccgtcattcttgtcccccgcgccgccctcgctctcgccgtcgtgctcgtcctcctcgccgcccgcgctctcaccgtcaggctgcagtactcagctgaggagatggggaccggaaggtgtgcaagatgcagcgcttggtcacgggcacggcgcaccggtgccacgagctcgatgtgcgtgtgccgagctcgagcaggccatgcgccgcgacaggcagcgcgcggcgaatggaggaggggagcgagtggaggaacatagcggcctcctcggcagtcagggagaggaggaactcctcctcgccgtctctcagcagcgagtgagtggaggaacacagcggcctcctcttcagctccttaatgctgcgtccaggagtgttgctttgttgtatgtcaaaccgaatggcattctggagatactgaatgtgcagttattagaatgatagattgttctttacacaggcagcagaccacttgttctgaaaaatggggttgcatgtgttctgtaatttgtatagaaagcaaaaaaactttgtaaattgtttgtagtgagaatggcttgtccaacaaaatgatgaaatggccatttgtaacttatcactgcaatgaaattatgttccaattctgggcatatggcctgttcaagagaaccaacagtttttgtcccccaaaatgcttgctatctgctgtccagtaccaagtgtatatgacatactaaactgtacacactaaccacaggcgtgtgcattcagttaataaaaaagactgaaggtgctcattgatccggcatagcgtcgtcctttcagaagagccttgccatcagaatcctcttccaagtgctcaacaccaatcatgtcatcccctgcgttcagcacctgttggcagtggtgaatgggggcatctgcacatgttcagtaacaaacaagggaggtacaaccaatggatgcataaatgctcaccttgcccaaaagatcaagctgttcatcaagcgtgccaaaagaacaatctcggcaggtgccgcagcccgcagagaccaaaagcctattcaccaaaaccaaactccattgctagaattcaacatcaagatcatcgacggttgctccctgaaaaattaaagaaaatttaaactctgtcgatgttaatactaatggatcatagcttcgaaatattaccgtcaatagttgagagaaggtgttgatggccatgtatggttcacacatttcttccatgggcaaagaggtactaggatatatattttgccctgctggattgtcatgtactgatgcttcttttccctttttcttgcctcccgtctttgcagccttttgttccttcaaataaaagaaataaaactgagcatgttcccattgaacagtgaaagagaaac

SEQ ID NO: 62241 - DNA, 662 bp, Oryza sativa
agtcgtgaatagaatatccatctttagcctgcttaatgggtgctgaatagggtaggatcagggtttccaccgatcttacctgaattaactaaacctgccttatatgctttaatgacatgttaaatttgccctttaaggtaagatcctaatgcatttaagtaaaataggccttcgtttgaaaaaatctgcttaccttaatatcttaaaaaaaagttgtatttgagtactagccgatacatgctagatctatttgatcagctatgctataaacaaaaaagtcttgttggtggtatatattcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccccgttttctttgtttctatttcttgttgattgcaggatcaaatcaactggtacgtagcatacccgaaggtgagttttggacctgcactggagttaagcagatctctcaggcctcgtgtttttcatcaacac

SEQ ID NO: 62242 - DNA, 633 bp, Oryza sativa
cgtgcacgtcgtcgagcgcgtcggccggcaccaggatctcgtgcagctcgttcgtgtccaggttgaacacgacgatgccgtgcgagatgaggtgccagtagaggatttggccgatgaggacattctgccggccatcgatcaccgatggcatctcggtcgttgccaccttgatcctctggaacgtcgccgagttgtagatgaaggcagtggagcgcttggtggtggcgttgcttgagacgaacaccacgcggaacaggtgcgggtggagctcgtcgtggccccccatggtggagaccacggcggtgttgctgaagtatgacggcctgtactccagatgacgatctttacaaaggcatgatgggcccaaccatcaaggtgataataacgcaaagtgataattttctacaaaaaatctaatatggttccttattagtagtaaagaacatactcccaatcttgttacttccaaaagaaactcatgtagaggcacttttgtagaggtccctctaaaatcaagagtttgaaaagtagagacacattttagagacattttaaaaatgcctagaacacttttactctagagaaacttttgagacatttttagcatattttttaaaattctttctcgtagtg

SEQ ID NO: 62243 - DNA, 2133 bp, Oryza sativa
gagccccctccccctcccccttccccctccccttcccccctcactttctcctcatggcggcgacgatgaggtgtccccgtcccacggtcttccccgtcttcggcggctccccgccgccggatccgccacctaatcccacccttgctttacccccaccgccaacaccggcccactgccctcctccatccccgcggcttcggcgccgccgccgcctcctcgccgcccgccggagtccaccgcccacggccggtcctccgccgctcgccggagtccacagcccaccgccggtcctctgccgcccacggccatccctctaagccccgaggaaaccccctcttccccctcccccatcccccctcctaccctcactccaaaccctaaccctctggagtcggggtgtcgctggcgccggagaagaaggggagcctgtcggagttggagagaagccgatgcacgaatcttggcatggatccaatggtctaaaatctgtaagatttcatccccaaatttcatttgaatgccatatagcaatcccgataacgaaaatctttgcgtaaatgtgttggagtaggtgacaccgtgacaacagctgagcggtggtgctgcttgggggtggcgactatagttagccaaacaagcggcacggcccaggcatggcatggcccgaccaacacaccgagccatgccgtgccggcccatgggctgcaccaccggcccaagcacggcccaccagcagtcgggctatgccaggtcggcccgaaggcacgggtggcccatcgtgccttttttaaaataattctatttttttctcccttctctttgggctgtgacatatatatatatatagctaaaataagtctattttccctcccttctctttgggctgacatatatatagcaaaaataagtctattttacatccctattctttggaccgtggcatataatatgtctatttttgctccctatgctttgtgtgttgggcttggcctgtcgacccatcgtgccgtgctggcccaacgtgccggtgggggggggccaggcatggcctagtggccaggcagggccggcatgggcccgacccccgtcgggccgggccatgcttgggtcgggccaaaatatcgtgccatggaccgggccgtcgggcttcgagccttatggctatctatagtggcgacggtcgcatggcgcggcgcggtaccccggtgtagacgacggtggcaaggaagcagcggggaggatgagatgaggagagtggaaacatgggacggaggacgggatgccgcaccggcgtggcctgagtcgttgaagtggcgatggactcgagcaggcagagggtggcggccagatctgggacatggatagggttcctagtgtatgtgacctaaggttttcacgaaacataggctatgtttagttccacgccaaaatggaagtttgactaaaattggaagtttgaagaaaaaagttgaagtttatgtgtgtaggaaagttttgatgtgatggaaaagttgaaagtttgaagaaaaagttgggaactaaactcggccaatgttacggaaaagttaaaagtttgtgtgtgtaggaaagttcgatgtgacggaaaagttttttcttcaaactttcaactttttcgtcacatcgttccaatttcttcaggcttccaatattagcgtggatctaagggtgtgtttagttcacgccaaatttggaagtttcgttgaaattggaacgatgtgatggaaaagttggaagtttacgtgtgtaggaaagttttgatgtgatggaaaagttggaggtttgaagaaaaattttggaactaaagtcggcctaaacacagccatggtctattagttttgatcctgttttaaaacttattagtttaccttagcttttatttagttccacgccaaaattgaaagtttgaagaaattagaacgatgtgatggaaaagttagaagtttatgtgtgtaggaaagttcgatgtaacggaaaagttagaagtttgaagaaaaaagttaaaatagtttggaagtaaactcggcccttgtttagattcaaactttggccgagtttagttctaaactttttcttcaaacttccaacttttccatcacatcaaaactttcctac

SEQ ID NO: 62244 - DNA, 7828 bp, Oryza sativa
tagtctgccctatcgttaccgcaccatctctgccattgaggatctcatccaccaaacaaccaccatccaaactcactgttgtgccgcctgccaaagtcgaatcccgctgcggatgctgtgagggggagctagctcgcatgtcccttgtgctcatcgacgtcactagcaccaaactcttcacatgctgacatctactagtccattatctccttgatccatgtcaccatcgctagttgtacgcgatggtgctcctagctcatcaccaaatcacattgtggccgtgccttcctcccaccgactttcgcctcatccgccattgatgccctagtccaagtcatcgtggcaatcactggcgctcctagcgcaccattaaagctaaggcacagccgaactggatagccaccaccgacatctcccacctctgttgtcaccaccatcaccgtcatcatcgtccttagtcttgtcgccgtcattgtgcttgtcgtcgctcctagcgtgccgtcaagccaaccaaccaccagcacgaccaccatcaccggccaacaccaccctggcccttgtcgccatctcagcatttgatagtgctcctagcatgccgccaagctgatcaatccaaatgaggccaccatcaccaccatccgctgcctctaccatctccacagcaccgcagttaccgtccctttcctctggcgcctcctcaacgctctctggcgcacctagtgcgtcgtcaagcagtcctgctaccatctcccccattgaccacagccactactaccactgcccctgtcgccccaccagatccacccacactagcctctagatccagtcaagccactattgctggagccaagatccgtgcaagccaccgccgtgtcgcctcctccaaggaacggagcgaaggaggaagccccaaccgccctcctggcggacacacgcactctgacaccccgctccagtggcagcgaggttggaaaatgggtggcgccagctaggttgaagaaggagaggagccaaccctttctctcctctagcatcttcatgcatactacatgcacgtgaagctctgatcaatttggtttgcattaatgcatatatagggggtgtttagatccacgggtgtaaagttttggcgtgtcacataaagtattatatagggtgtcgcatggggtgttcgagcactaataaaaaaactaattacagaatccatcagtaaactgcgagacgaatttattaagcctaattaatccgtcattagcaaatgtttactgtagcacaacattgtcaaattatggagtaattaggcttaaaagatttgtctcgcaaattagtcccaatctgtgcaattagttattttttagcctatatttaatatttaatataggtgttcaaacgttcgatgtgacaggtgaaaaattttaaggtagaatgtaaacagggccataataactcttgaggtggatcaggcatgtatatacgtatatgtcagggctagcattctgtgattctgtctactattatctgtagttctgtacaagtggggcaataccatacgtcactctgcttcctgatccaatacagaacaagctggctagatagacagtgagagcaaacagaagctattcagaacaaagccagtgagcaacatatagtcaacctagccagtgtggcttttatggcactgttcagcaatcccttctatgtatgagtttcagtgttcccaacttgatgagctgagcttagagcaagtttaatagtatagccaactactggctcaaatcatctataatcaattcaattaatatccaattcatacaatagttacctataacatatatgacacaattaatacctagtcccacttgtcatacacacatacatcttgaagcccgtgctacagctgactataaatctgtagcccactgctcttctctctactcttttatcttctcgaaatgtgtttatagcctgctattgtacatgctcttattatgcccaacactgcccaatcaaattgaacaaaacttaaggaaaatgtatttgtagcaactccacaaaattacaccacttttatatcattatcacaaaatcacattacattttaacttaagaggtttaagagagtttacactacttgcataactttcacaaaatcacgctgagccacttgccaacctgacaagcctatatatacatgttactctctctgttttatattaatattataagacagtttaactattttcgtagtcaaactttttatcttttctaaagtttatagaaaacaatagcaatatatagaacatcaaattagtttaattaaatagaactgaatatattttgaatgtattttgatattatgtttgttttgtgttagaagttagtgttgctatatgttttaaattatataaactagattaaatataaagaagtttgacttagaagaaaaaaaatcaaaatattttataatataaaatggagggagcagactcatgggaccaacaagctagtaggcatgaccattggatatgatatgaaaacagtaaaaattgtggtttttcataaagcattaagaaaagaagagtagtgttctgaaattattattcaaaactgtagttttgggatagtttttgtaaaatttactcaactgtttatagaaaactgtttatagaagtgtttgctcggcgcacatatatacaaaccataactagctattgtttaaaatattcctagctagtctatctctctctcttttttttttctttttgcacattaactatagccttgcgcacaccctatgaagacacaccagtagaccaaaagcttcataccgaaattgtgaatcctggctgaatggacaacactctcatcatctacttcttttcttgtcagccgtaacaaaaaaaaattgaaacttaatttcaaagttaattttggcttttctattttagtagagatactactaggagcgcagcacgctcgtattccgagcgccaaacatgtatcagtctaggtccacctcacctcacgtcccgtcatcccgctcccaccgttatcggaataagtgatttacttcgatgaaaacaacttccccctgcttctgatcccatcccatgtctgatcatcccgctcccaccattatcggagtaaatgatttattatgataaaaacaacttccctgcttccggtatatattctatttttcccgtaccaaatcaaccactctcgccccacttaatttttcctctttttttatctgaatcgatccaccatcccagcgcacagattggtgatacaccatggaggaggacaatggcaccatggcggttgacagcggtggctggcggcggttgaggcaaaggcgcggcttcaattctcgttgccggacgccggggaacgtcttaaccaacaaggaggtgttcacctgggccaagagaaacaactgacggctgctccatgtcggcgacattgacaaaacaagcaagtaagaaaatgacacttcaatttgcatatgcatactctccttcaccttcacgcatgaagccccaattttctttttttttttgcaaatcaaattaacgtgcaatctccaatattacctgatcttaattgataggctgcatagatccttcatttgcacatcgtgctccatatggctgtccacagaggatatggtggagttcgctggtgatggaggttgtttgctatttttgttttgctcgtcgtctctatgacatgaacaagaattgttttgcattcttttcgtacttgcttgatgatggatggctgctactgcgcaacgtcgagcttatctctgtaccacgctgctacatccttccatgattccattgtcgactaccgttcgccacccagttgccctctccactaccagtcacaagacacagaccaacctctccatccttatagcaagatccagcaaagtcaccaggataccagctccacgatgaagttttggctggatcattttttttctagtttgattagtaattttatcactcgtgtgtgattgagcatgtaattttttcattcgtacgaccattttgtgatatagattaccaatactcttagtatcagtttttgctcttatactatgcattgaatacaacagtaaacatattctacgagatcatgggctatatcaagagaaatgtggtaattgttttactcgtagaccacacagtctaaataatatttatatcactagtaaaagaattactagtgttataagctagtaataattcttttatggccatataggaatagtgtcgtacgatgtgggggcatttatgcaagtaaatttgttacttttaaagggaacatttatgtgattaaatttgttatttttgaaaaagcatatgtgggaagttaggagtaaatggaaaactttatatagtaaattcattatttatgaaacgtgggagacactagaaaaacagaaaaatcggaaagaaaaactaaacggtaaatattttactaaaacgagaaaacagaaaaaatggatagaaggaacgaaaaccggaaaaaactcgatggttaatattttaccatgccctttcatggagcacgaatgagatggaaaaaagaaaaaagaaacacggaaagtgtggggttgtaaaaaacgaaaagatgggtaaccgagcaaggtgggatgcggaggaaaggcgaggtggtaaaaaaaggaaaaaccgaaaggagggattattgtgcggcgctcgatctaaaattccgcgtatattagtaccaccgtttgattgctatgtttttctagggtttattatttgtagcgcaaccaattaaatcatagtcctctgggaactgcatgccaaagtcaccactcaccagtggactagggttggacgatagatcggtggcaatgcgtgggagtattgtccgctagctttgctcaaaacacaagtaaacgaaaatgtcaaatttcaaattaaacgtcgcgaccattcttttgttgtttttatatagtttgtacgtacactaaactttccatagtgtatttctatactcggaaactttcaagttaccctatttaatttcgccatctcaattaatcacatctcagagctaaggaatttaattaagcagagctgcacacacgtacagacctgatgaattgagagagatggattggatcgatcactgaattgaatgaaacaaggcaggacccatggatggatagaactcatcaaggccacacctgcactgagctgcggcagagcaagaaatttaagatcggcgagcagtcggtgcattcaacggatttccttccttccttcctacttggctctctctgatcgatctgatgcatacgatataatgcagcaaatgcatacatatatttcatcgatcgatctgctgctgcctgcctgcattgaactctcacaatatttcaggcatttatagatccatcctagctacccatccatcgcccgaataaatatacgcagcctggccaaacttaatgttatctgaaccatcatcttattaattatatgatgaatgcctacgccgacgacccccgtgcagtacggtatttggattcagatcgtacgtagtactacactctagatatttcttcagtttctttctttttatttttcatatattattagatccgaagattatttattagagctatatgttataagaaaattcagctgatgagatttcattaatgaattggtttcttgtcctcccctcccagccgttccaaaatataaacatttctggctatatgtacctggaaaatagtgaattggtgaggcatatgcatggtgttattagatctccggtatacatcttctcaggataaaaaaccctagctatgccctggttgcatcgacctaatcatcgtttatacgtttttaaggcattgagatatgaagaactgatatatgatgtttagccaaaaaatgtcaatgcaactttaattcattgatcggatctatagagacgacggtataacattaaagctagagtttcaatacatctttgctacacatgtacaaagcttgtatgaatggtcgatctctagtggtcttgattggggctattcatgattctttgtttttatataagaggatagttttaccattaattgagacgtcacacgctcttttggatttatattgttcacgggcacttagcttatgatgtgtaatatggccgtatgcatttctggttgggagaggccaagagtttatttctttatctgatctaaagaaatagctagaggagtaccgttacttgcctcgagttttcataattttcctcaacaattgtgattaactttgtctttatccagactataccactgagtttgttaattgtttctaggcaatatatatacactacgccggactaggtcatctctgacgggcccaaaccctcacctttgacgggtttggtcttggtcagtgattagtggtcactgatgacaaaatcacatgtgacgggtgaaacacccgtcacagataacccatctctgaccggtatataagtcatctctgacgggttaaaacttgtcacccgtcagagatgagtcatcagtgagtcacgacactgatgactcatctctgacgggttgtaacttacgacccgtcactgatgacaaagcaagaaatacattttttgaattttaaccccaccaaaaaccctcaaaaaaatattttgaattttaatagccgtcctatacatggttacacgttcatcagtgacgtgtcgtaactacctgaccgtcactgatgactcatctctgatgggttgtaacttacgacccgtcactaatgacaaagcaagaaatacaatttttgaattttaaacacaataaaaaaacttcaaaaaaatattttaaatttttatagccatcctatacatgtacacgtcactacctataaattcacaatttttcacgcaatataacttgcatgctacacgtgagattcaaactcaagacctcaacctccatatagagctctcttaccaactcatctactcagcacatattgactactcacctaatgttgttattttttctatgcttgtctgaatcatttaacatatatttaacaccctaaatgacttcaaatgaaaatattatcaactaaatagttatagatctcatcgtgttttataacttttacgtagaaaatatcttcatccgatgttgtttgaagaattcaaaatttcatttttcaaaatatctcactttataacatgtattttgaacatgtaaactttgtgaaatgaaaatattttcaattataatgttgtagatctggttgagttctatgactttgatacggggcatgtatccatccatgtcatttgaaaaaaactcaaaattaatcttcctatgcacataattaatcttcctgggcacactaactagcaaatgtcacgaaaaattctagaagaaaataaacatgtaatcctaatagtattatacatatatgcaaagtctcatattaaaattcatatattttagtcataataaaaaattacgaaatctgaccaatccgtaacaaaaatgaaaaatctaaccaatataatgaatttgattaagagactttgcagatgtgtaatactattagaagtatatgtccattttttaaataattttcatgatatttgttagttggtgtgaacagagtgtgcacgacaaatttgtgtgtgtaggatatgttgcgttgtttctaatatgtccacgatgttggagacagaatgatcactactggaaaactgatctttggagggtcatgtaaaatccacattagtcctggttcgagtaggaaccggg

SEQ ID NO: 62245 - DNA, 781 bp, Oryza sativa
  unsure (1)..(781): unsure at all n locations
ttatatttcatctttcagtcttgtacatacatgttactaaaagcacttttgccaaaacttgcaagggaacttcagaattaatgcataagtacataccaattcatgctacacagcaaatggctataattaaatctatgcaaattgatctcactatgtgtgtggggtcctcctgattggcatttcatcaagcaggatgccggagagggtacctgcataccagggcgtgctggaagtgggtggttgtgttgtcccatagtggacttggaactggaggggggcgcaggtgatggtccccagattcctgggttggcgacgtgtttttctctctcagtttgcagttgttcttcagtaacagagtgggagaatggagtggtcgagctgtgaattccacgaaaccagaagttcaagatttggcctgcacagaaggattcatctcatcacaatgcanattgagagaaaaagaaacatcacaacagattacctgttcacgcaaagatctgatgtttgccatgtttaggcggaaggcataactggcttcgtcaacagaatggacacggtgggcttggagtgcggctgtggaggtctcgacgcttccacctgtgtggaggtggtccgcaacagtttcaggcgatcgatcttattattttatctgccgatgcaactggagagaaagtgatacagcttcagctcgccgatctccttatcccttctatatgagagacagctaacgagcgaggagatatcaaacatatatagaagtgaaaatcacaattagctttca

SEQ ID NO: 62246 - DNA, 612 bp, Oryza sativa
aaaaccgtgaagtcacaatgtcctgtagcaaaatttcccttttctaaagcacttggaatggtgtggtgtgatgaaggtagggtgctacagtaatttaattagattaatgggagagatagttttgattggaatcatgctatacgtacgacccatcattcaaccggcgtaccactgaaacggagagcaacacattgcgagacggcgtgatgattcgtactgcatgctgctgacgccgcgtacatcgacattgtagtcatctgagagtcggatgttgggtcgtgtgtgtagcattttccttttgattgtaagcactggtatcaaataaatgtcactccaagaaagattggaaaataaattttggtaggttctatttatgtagatggaaaaaaaatctaaattactcctaacctattgcgaagggctgaaattgccaacttaaacaacaaaacaggatatttgatatcccaaactctctaaaccaacgagtaacccctaactcaatctgaagcggttgtgtggcgcatacgtgctaacctagtcaacactaaaaaggtaaaataattaacgacccccctataatataggctttcttccctggtcttccaccctacc

SEQ ID NO: 62247 - DNA, 527 bp, Oryza sativa
ctatcatatttgactattctttttctgtggggagatttaccaggggccatatgttgtgcatacaacatttctttgtatgtagaccaactaataaatatcactgaaaattctagaaacaactatacatattcttccaataatattacatatatttctaaagccctcacctcaaattcattatattttagccctaaaaaaatctaatagtttaaagagtataaaattgtcggaattttttctttcttgctccctatgtacgatgaatttgaatatgagacactcacatatatgggtgtaatcgtcagggttttggtcatcgaatacatctatgaagatggttacaacacaaggacacaagttataaccctccaccttgacgctatgcgcacatatgattcctatcaccaagttcctaattgagacatggactccgactcaggtcatgagatgaaggctgttttttttcctggagtgcaagtcttgtgtggagaagaaggataagactgataacgatcagtataaacatg

SEQ ID NO: 62248 - DNA, 5149 bp, Oryza sativa
tagcattacaatatgtaaaatcactatattaaattcttggttctgtatctcggcatattttgcattagaaaaagtgggaacatagaggttgcggaacatgcttgagaacagttatattaaagaaatatatataacatgtttatagagtacttaaagatcgacaaattctccccaaatatagaacaaacaataaccttaggctaaatcctgattaggacctatcatcattcaagcatacatatcacttttaagttcacttattacataataataaaattaaggaatccattaaaaacattttctttgagtgaattattgtcacgccctgaactagccccgaacggaaccagcccgtgatgctccaaattaacctgttaaccgataccagtcccaggaaatagagctggtatcacagaaagacagaatatcacagcaatagaggtctctttattatagagtaggagtacagtcatgttgggctacggacagaccccgagctcacaactgcattacaagagaggaaagcggaagccaagatttggacctaacatcacaggcgcgacttgggaaccaaatcgaaaccctaaaactcatcatagctgactttctcttggaagaactcctcatcagcggggtccatctcatcttcttcagccattggggggggaattatttatatagagcaagggtgagtacaggagtactcagcaagtcatgggaattatgtatttaatgaaggcttcaaaggaaaggctgttgtttttacaattgatttttggttaaactgctttttaaaacaactaagtgagtgcttctcaaacgacacggatgagacagtgcatctcgtccggtcggagtatgtgcaatgtatcagtctttgattgattcaagattggcacccggccacaactttcaaacggccacccgggcctagctgatcccgtcagctacagatgttccaaacatcgaactcaaattcccaacagcaatttcacaaagcagtagtcgaacaaaactacgctaaggaatcaccttacatccacccatgaccgtgggcacggctgttcgaacagtttaataacctctgcagagggggcacactttacccacacgacattactaacccggatcacccagcccgtggagaacagccacacctggtgaccttaaggctttcatgacaaggcatttcgagagccgacacaggtttaccatatgccgacgagaggggtcccagaccaacaacaggttaggtcccagaccataatgtgccaggaagcccaggggtcctccccgacaccaccctgtgaatccacttgtctcccggtatcaaggctcccctgattagctaattactcagccaggggtgtcccattccacccatgtggtcgtacttgctatatgtttagatgaaattccaaaggaatcggtccttaagtgcaagagcgggaaaccgtgctcccggcacgtcccccggtctgcgatttttggaaattcatttagttcgcaagcaccgacccaggcgtcgggtttttccaagtcttttgtaaaacccaagttttaccaatcgttggatattttaaatttgaggggaggactccgacgtgcgtgcccgaaggcccgtacatcgaagtacaacagtcgacaaaggaggtttaagtgttcaataattcaaggagggtaattgccgcaattaggattggggccggtaggctatctcgcaagccgcggccaaatttcttgtgttaatcctatccatgcattatttgcggaaaagaaatacttagatttaaattataggtgcaagatgatcaaaggtgacttgccttgctcgagatcttgagcttgatcctcgaaatccgcacactccgggtcttcgggctccgaagctacacgtgaacgagacgactcaacaaacggtgaaattaaagccctattattgtcctctaagcgtgccattgggtagatctcgagatttgaggatttttggaagttgaacggagtcaaacagatgtacggttgagaaaatattgaatttctaagattattggatttttggtctaaaggaaaaaggatttaattaaacccgttgaaaaagaaaagaagagggaggaggaacagacttccctcgggcggctagggtgcggcccgagagaaggggcgcggctcggccgagctaatgggccggcccgcccgagaaggaggcccaaaggcacgcgcggggagagagggaggggaaccggtgggccgggtccacctcgcgtggtcccgagtgggacccacttgtcggcggctcggctcaccatgagcgaggtgcatgcggcgcggtgctagggttatggtcggtgcggtgcacgcgtctggcttgcggtggacgcggcgcgcaagtggcccacgcgcagcctctcggctctctgtgggccgcgcgcacgcgagcggggacggagggagcggctgaccagggtcggcttgacccggtccggccgagctagcgccgacgtggcgccttcgtggctgccacgcgggccggcgggaggaagacgaaggcgccggccgcgaatggacggcgggcggcggcggtttctccgggatgccgtgtgacgacgagggcgacggggtgtacaccggaatgacaaggggaaatgagatggagcgagccaacggctcggattcgccggagggggctgcggattgcggcggcggcaactggcggcgagaaagggggaaatcggcaacggcatgatgggagatcgattcgggcgagctagagcatctacgcgactccgggaatccgtttctagcgtcggattggacggaacatcgccgaggaaggccggcgacgggcggctattactgagcgcggcggtgacggcggcgagcctactgcgagcagcggcagcggtcggggtgtcgcaggctagctacggggagactacacaagctactgctcgagtctaaggggaggaggaagagcgaggagtgagaacggggaggtgttctaccgagacgagacggggcgttgtgacgagaggccgacggcatgggagtgatctctccagcctcgggtcggggaagaggaagaagacgagcgcccgaagtccccttccgatcctagcgcgcaccggctcctccagcgcacgcgacggcgaagggcgacggtgaacagggcacggggcgaggcgacaatggcggaaggcgaaagcgagggagatgggtttgggggaggggctcgggtttatagggcggctatgtcagttcggaaaccgaccttgggcagtcaagccagcgagctggcgccctggctagcggccaaaacggtgacagggaggatgacgctggcggtggaagagaaaagggaaaaaggaagaaagaaagggggcttgccccttgcttctttgggaaaaggagggagagagggtgacgaggcaggaggaggaggagctcttcctccatcccttagaagctagcgcgcggagtggcggggccgggtcgatgacaacggcgatgacggcggggcggtttggaagggcgcggctacagggcagcagacgcgggctcaggtgtggcaggcgctgacggcggcggcgacttgccggtcggccaccacggcgcgcgcgcgtgggacgcaacgggtggcgtggcgatttgagtggcgtcggcgggaagcggcaacgagagcagagagggagggagaagagaaagagagagagcgagctctcactctcgctcagcgcccgagcggcgcatgtgcctcacacgtgcgggcaaggatggaggggagaggagagttgggctgaggaggaaatgggtcggggagaagagatcggcccacgaactcgagggaggcaaaatagacttttcgagaggatttgatttgggacggatttgagattagggtttggatttcgacgatggattggggaattgagatctggaatggcacggacactggacaacaaacaaggagacaattttcgcatttaggatttttaagagatggttttcccactaggcgccacgacggaacgggtgctacaattatgttattttaaggaaaattttgaccgcgcccattttatctctcttggctgagaaacacacatttttctattctcgccgctatacgacacacacagcacagtgctcgcacaaacacacacaagacacacacaaacaaaaaaacgcattccgtagctcattagcttaggtgagacactcatgtagggatatatacagtagagatgttggtcctttgagatagatgcttgtaatacttcaatttcgtgattattaagacacctagcttggtttgaaccaaaattgagttcggatgctcataaacccaatcacgtatggccctcatcacgacatgtttgtactcatcgttatccattagatgcgaggttgtgggttctattcttcttttcctaggcacaaaacttggttttttccagcatcaaaacagcgaccatctcatgatctatattcgagtctgaatcctaatcaggaacttggtgataggaatgggttgggcgcatagcactaaggaatgataaacatatgtggttcttatccataaagaacatgctcgctagcttgtgtttatggtatacctgcagtgttgaagctgatgtaggcaaaaacgtggctgtagtaagcacaagcagccactctctgggtgtctttcgtctcaatgtcaattacgtgcacccctctaccagctgcatgcagtaaaactgcatttgcttcctcaacgaagccaataacatttacatttgcgcttattactgggatcggtgcatcgttatcctggtgaaaatctttatcacaccataagtcactccaccacggggattgactgccactagcctcgttgttgtgctgcattattggagaaattgctctagtcttatcaccatagtcatcatcatcacgatcttcttctccatcatcagagttgtagacgtaatagtccactacccagggagaagctaaaaaaccacaagtcccaagaatgttggcgtgggggtggaaagtagtggtccattggaataatgcttaggatattccatgtcctgcccacaacaatggtatcatcggcaatatccatgcgagcccagcacaatagtgaaccctagtttcccatcct

SEQ ID NO: 62249 - DNA, 32175 bp, Oryza sativa
gaagaattggaagtcgaagctcttcaccgagtttgtcaacccgcccggcaatcatacgtcgttcgatgaataccctcaaataaccgaagcggtgtgggaggaattctgctctctaaagaccacccaagagtttagggaattaagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgtaactgggcgcgggcaaggggtaaggtcaacccggacggctctgtcacatttgagaacaaaagtgatgccatcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacgaaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgtagcacagtgtgtcctactagcgagagtccacccaactttcgctcctgaagtcgctgagggcatggctttcaagccctcggttacagacaaggtccacggtgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaataaatggagctaagcaatgccaagcggaaatgagggagtcatccatagttggacatcacgaccaccagccgttcctatcgtcgcctgcctatataactataggctttgatgacctcttcaaccttttcaggatccgaaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccctcccgctatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttacgttgtactattaatctattttctctttttttttcccttattgacaggttgtggaggtcgagtacattatggctttaatccatttggtaagtatatatgcggttctatgagcaatgaccgaaattgtggctttcaagggtggtgaatttgctgtgcaaaattgtggcatttgaactgcatatatgtgttgttggggatctgtgatgtttgagatggatctgtgatgttatattgggggggtgatgtatctgtgactagaatatatctgtaatgtatctgtgtttcagagggcatggctcgcaaatcctgaggctagccaatatttagcatttattttttttctggaattaactcatcagtgacgggtcggaacaaaaatccgtcgaaggtaacctaacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctctaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgagattgccatcgctctgattgcatccacgagggggaaaaaagatgcagctgaaggcgcgcgttgataagggcgtataactagctggtagtctatatgggcataggactaccctagcttttagcccaagaccttaaccctatacccacgaagtctaataaagttctgtgatatatagtgattttcatctttgtaagatttatattgttaaactgattcacttaagattgcatcaagtgaagccttaaaacagtaactgtattactccctccatcctaatatatatcaacctagaactagataaacacattctattaaaaaatctagatgtgttccacacttgcatccagttctatattgctatattttgagagttgggataagggagtatatcataatatgctactctctccgttctaaaatataacaaacttctaacatttgaaatttatcctaaaatataacaatttttccacctatattccttctcaatcaattataatatttcaccgttcaaattttttaagtattttttcctcttaaccaattacaatcttctctcgtttaattttacttgtgttcttaatacttgtgtgtaagtctaaaactcatattttgggacagaggtagtatttacaagaactaagttgtattagtaaggaccacggcggaaggtaaatgatttcctattgtagaaatgaatatctcatcgtctatattttagcttgtatgcatttctcatttagacatttttttttcataatattatattattataattgatacctactcagtagggggtcacatataatctttttcgtcttttgtaatgagaaataggactacccaatgaaaaattcctggctacgccactggtgttgaatgcggcttatgagctttgagatggaggcggtagtgtgtgagctctcggatggaggcttgggtgacagtgtgagggctctcaaaagcattgtaaaaatagataatgaacataaaagctctcttttacatcaccatcaaaatctcgctctgcacatatatttatataggtcttataaagagataaatcgtatctgtactccgatttatagattaaaaaaaacctatcttatataaaaatttgtttcacaacaatgggtttggttcggtctgtggtttgtttaagagtcaggcgtatctgatgggtggtctagggaccatccaaaactacatagctataatttagaaaagaaaaaaatattcttgaaaagagaataaatatttttttgcaccagtaataattagcaagtcgtttattaatatatcacatggtatatatttttttatcaattatatattttcgttgtatacattttatatttatgacacttaaaaattttaaaattatgtaaggtggaccaccatataaaaatgcttcacagtgagctgggttggacttggagcagtttttggatgacgatctagggcgtgtttggccagtgagccggctattttttttcaacggtcaggctgttgccttcgttttatatgaaaaagaagatgttctattttaagaaaaaaatagaaccaaaacttacaatactacaatgcatagttaattagagaaactgggcgaaaaccacaactataaaactcaaaactcttagggtctgtttggggagcttaagattctaagaagtagctgttaagaagctagctggtgagaatctggagaagctggaaaatccagcttctggcctctagttcattttccagattctacaactacaaattctcaaaatcttggtaaaaaactggactgtttaggagagtttctggcaactgaagattctagaagaagctgcagctgttagaagctccccaaagggccttaacaacctatcaagaccctgaaaataaaggacagtcggagcccaaaacaactgtcgataaaaggccagtgaaccggccttgaatgacgatctccccaactctcgatctcgccgccatcgtggagcttcccctcgccacgcaacgctctccccaactctcgccacgcaactccaatctgcccgccaccagtccaccgcgccgcctgctgtggccgcgatggcgtccactccgctctcgcttgcgggcgcctcgtcccgtctctggctttgacgggcgccaggccatccatggcccccgcacgggaggtgttcgacgaaatgcgcgagcgccaccgccgccatgagctgtttggcatatgctgggaaaaaaggctattcgttttactgattgagttcgcctacactctcgtagcatacgggagaaatcgattcgtttgtctgtttgagttcgcctaaactctcatagcatgggaaatcgtggcatcgccaggttgagctcgcaggcctgctgtatgccagcgggatgcttctctctgtcaacaattttgacgttatgggacctgtaaaactgcaggcacaaattggacgtgttccggaggaatggcgtgcacctgatgatcccctcttgggttatggaatctggttggagacgcggatgagtggaacaataatttctaccaagctctaagcaagtgagttcacatttcccatcaagtttgtgagttcgtatttgtgcatattataagattgtggaaccagatagcgctttcagctttttcatgaacattttttaccttaagttgtagtgcacaaaacaaagctgcaataatttgcgcaaaatacaaagtatttgcctgatgtggaagacatgggaccagagatcatgatggttgtaggcttctactcactaggagactccaaatttaaatgggctgacccagttaacacttaacagttaaaaacatgatagtcttcgctgctgtttttctaaggctactgctattttttaacctatttttcagtaaaattgtgttgctgatgtttgtttaacatatggtctaacaaatttgctttgttggatcctcctagaactccaccatttatggttctaacttttgacacatcaaatcaacttgagtttggtgatcctaatatttatctggagtttaacatgtaagctcgtttgaatttgctgtttctagtatcgaatagacaagaccaaaacttaccccaaatttacttctagaaatgccatctatgcataggtatattactagcaaatttttcacacgccatcctttctgtacataagagtttgggtgaataaaggatgcatctccttactttggaacaaagttgaattaagagttttatgtaatggctaatctactgttaaattatgttttattctgcataaaatcatttcacgatatgatgtgtatcataatggtttaagaacaaattacttacaaaataacaagaaatcctttctatatggtaaaaaataacttctttacttccctgaagcattacaagtgtccatcttagtcttttcatcttgaccattgagcatgtaatattggctcatttcgctttctagtgctcatctgagaatggttttggcattctgctaaagttaggttgtcatcatgggcaaggtaaccgtgtgaactgtatagggcattcgatagcaggtaggggtgacatctgtagacagcagccaacaggtaaggcagtgggttactggggtgcagttttcgctatgggatgtgtcagtgttggttttcagatgacatgcacggtgcataactattgttgaaacccacctaatagggtgaattaaaccaattttagaagttcaggaggcttgcaatatatagttctattagtttcatggaatcaacattacttcaaagtgaatattagaaaatcaaagcccacattgctttcagaacatgtactagtggtgctaatgtttttaacgacatactcagaacatcaccgaaaatccaaaatagccagaaagtattcttttgatgctttctgaaatatacttctcaaagaacgaaaaagataaaatataaaagtagtaataaaaggtaaagtacatgaacctgattttcctgtaatcattagccacccatttcatcttggaccagatagtattgattcttgaggtggagccgaatatgtagatgggttgccttgagcagatattactgaatttgcattgaaaaaactgtaatctaggcagttctccacgctcattgcaccttccaataccttgacaaccattgacatagaaggcctccggctgctgtcattctgcaagcaccacattgcaagcttcatcatttgaatcacttcctcctggtgtgacaccatgtcattactgtgcttatcaatcatatcaagcaactgatcgttttgagccttttctcgtaataggttgatgagctgaacactctcctcgggctgtgagagatcaatatttttccttccacttattatttccatgagaacaactccaaagctgtatatatcaactttttcagtgatctgcgatgttaaccattcaggtgccagatatccaggtgtgcctctcatcactgtcactaccttgctttgatccctgtctattagcttggaaagtccaaagtcagccaatttagcattgaaattctcgtctaaaagaatattctgtggtttgatatccagatgagcaatttttcgcctgcattcctcatgaagataacataaacccttggcaatatccataatgatcttacaccttgtgcaccaatcaagaggagcattgttgtggcggtaatatatccacctatcaagtgaccctcttggcatatattcatataccagaagcctatttgatttctctgcgcaaaatccaattagcctgacaagattgatgtgctcaatgctgccaatagtctcgacctctgccaagaactccttctttccctgtctagcaccttccagacgtttcaccgctacactctcttcacctatttttccttcgaagaccgatccaaatccaccttcgccaagctttttactgaaatcttcggtgcattctcttaacttttcaaaagagaaccgcgttggcattccaggcaatatatcaaattctaattcttcatctagttcttgatacttcctcctccttcgtacatatatagcaacaataacaactaaaacaagagtagtaattgctgcaagtgtagcacctaaaattgtcttcaattttttttgtgtagggtcagaagagggagtaatctgtacctttagataagctgaagagttgtaattaaccttttcaggttgtattgactgcaaggagaatacctctgtcactgaccggcattctccattggaatcattctgaccatacctgaacgctactgctttgcatgagcaattcttcaagcaggcttgcttgcagtcatctctattttttgcattcatgatgatttggctcatatcaaagtaagaaacatcagtaagagtcaagagctgatgatttttgatttcttgacaagatactggtgtcactggtgcacaaccaagattagtcttccgctcgtcaactagctggaagtaacgtgaactagaattactctgaaagggacagatgcattgcccacttgtgcatatcccgtactccccgcacactgttgggaaagcacaatcatcaacatgtaggaattccttcattacatcagacaccatgatccagcttggttctccacgagaccactcaaacagcctcaagtgcccatcagactctaaccttatgtactgggtggacttagcttcttggaattggatactttcatctggatttcctggatgtgtggactgcaaaaagatgctgaggctgccatttgtaaaggtaatccttgttggatctctctggctcatgtttctgctcagctcatgcttaaagtatagttgtggtggtgtggattcaacataaccatgtacaccatcacggagaacagttatatatatcttaccctcagtccaatttgtgggggaggcatttgctctgagcatcttgccctgcagcagtgactgccctgggaccaatgcgtcggtgggatgatcaaatgactgccacactgtcatgttcctctgaccaaacagcacaaggttgccttgctcagtgatctccatgcgtcgcacggattggtctgaagtgccgctcgaccagatgagtctgccattggctttttcacggaggaccaggtcgccatctccagtcagctcaagggtagcattctctcctacagggcttgcctggttggcacaccagacaacccgtgccattttatttaccgggaaagaatctgtgtcagggaaaatgaagactgcgaagatgaattcttggcagggtggggtgcagaagaaccctgcggcaaatgagagatcggaggtttgtggtgatcggaggactatggcacgtaccaacccatcttcatatgggacgctgtcaaggactttgtttttgacccacagtgtcgagaggttggcactgggatagacggagcgctgcccggacaccggtggtgcggcaactgcgagcaccacgaccaccagcaccgtgaagtcggcgaagagatttccaggagacatgtttcttggattggaaagggaggagtgaagccagcaagaagctgtggtcagttcagaggttgacaagatctcctgacctgatgacactaagtcgatgagctgatgtggtcaccggaaagatatatggcctcaccgtcgccggcatggggtcgccggactggcggactctgaagtgtttgatcggctacttgtgttctcgctctctcagtacttcataactatatattaccacccggtgctttagttttttggtttcttgggaagatggaattttggcttgaccagttctaaatggccaataatggttttggtttctgcaaaaagatatgtagcctagtggttactaagtgacctcaaatttcagtttggatgtttgcaatttaaatgtttgcatatatccggttggatgtaaaggccgagtaaaaaatatccgtctctaaaagaaataataaaaaaaagaccaataaggccggtaaaaatacctttctctaaaaaataaaaataatattaagaaaatgaccaatcgagtttccctatgttgtcacgtgatttttaataataaaaagaaaaagcacatattgataaaaataagcattaaaaagcccaaaactatatgctacccggtcaaaattagttagcttcagtacggcatgacaaaaaataactagtggttaagccgggtaaaaaatacccttccctaaaaaaattaaaaataatattaaaaaatggccaataatcatctgtgctcaccatgtgatcgagagtatggtgagtagagttaactatatgctcgccatgtgatctagtttcgttacgttgtcacatggtttttaataataaaaagaaaagcacatgttgataaaattagcattaacaagcccaaaactatgtgctacccggtcaagattagttagcatcagtacgtataactagtacggttagccagtgtattatactattggcacaaatgtgtggaggatgggagcgttggctaaaatagagaggacagctggactaacccatgaccttggtccttgggcttagaattgcaaaagtatgtatgggtgagtagaggtaatctatactgcaatatgtagcaacgtacttgcacgaacatgtatgctgattcctgaccgtctggtcgcgaaatctggcggatggaccagattcgtctcacacgatcgtccggaaaaatcacccgcgcgaaccattgatcctatcccaccacgtaccgatcgaccccactcatccaatcgtacttcctgccttgcccgatgacgtacctcgtgcgctgtcaattgcgccccttcctcaaacctccttcggccttcctcctcgtctccttccgaacaccgtcatcacatatgagccccgagtgataaggacgtcgtcactttatacacacttaattaactccacaagttctaatgataatttgaagtctagttcgacctccaagttctaatgataatttgaagtctagctagttcgacctccaaaattagtaccgacttcaaacatgttgaacatttatgctaactccgatttgatcttgaacatgttggaaagcttatctcgttactttttaaacacacccagtctcatatcaaaattcatcctaagtcaacagaaatcatcaaaacaatacattgttgtttgctgaaaccgaacttgaaccttgagtcttataatagattatacccatctaggaaatgcctctctccacctccacaaccagcaactatctctagctttattatcataaaaagctttatacatcctgtaaaacaattgagttttgtttatttgaattttgccaagtgtcattcactttgtctctagtcatcctcgtttaattagtcggtgactatagattcagagtcactaatagttggtgtgtttatttgccgggtcgattagatctaccaccttaattgtaactatttcttgatgcttaattacctattcgcaatatttagattgtatcttatcttattcatgcagtgttctctcgtttgcattgtaggatcatcaaccacgcgtcagggttagtatgacatcgtttatggtgtagcaattgcacgacgttctggacttgttctggttggtagacacgtcgcacttgatcaaagcgagagttatcacctcaccagaagattgtaccacaagatatagcatcattagttggtatcagagcgtcggttgcgtggtgaagattttagttttgtatatttattttttctatctatcatctacaaaattactgtaaatgggtcttctttgataggtttgtttttttttccatcgtaggacatcaatttaaaatatgggtagttttagcacacttgagcaattgagtcaaattttagtacgcttaagcagtggaggcacatttgccattccagtggacgtatggtacgagtacacactaatctgacaaggtcaaagagcttagtagttgttttatatgcaatttgtttgttttgattggttgatttttctttaaaccaaattgcaatataggagataaagaaaacgtagagattgatccagtagagttttaatcgatctgtctaggtaaaagagctttgtatattttttttaggtctgcatgtgtgtttgcttggctttttcttaaccaaattgcaatagaagatagtaataggaaatacgatggatcaacggcacgatttatcatgctatgctataggccctattgatggggggcgcagacactactggagaagtactcatctcttccggttcgcaaccccctttactcccaggtagcgaatcggaagggagaatccgggactaaagatgacagtctttagtcccggtttaaatacccgggagtaaagcttcatctttagttccggttggtaacgacttagccacgtggctggcacaaccatctttagtcccggttaccaaccgggactaaagattttgttttattttttttaatttggttgtgctgcctactgtagaaatgtatagtatagaaatgtatatattacacatatgtacactatatgtatctatacatatctatacatatatatatagtgtacacatatatatgcaatgtcaatatatacatatgtagaaattcatatgtatatacaaatattatacacttaagaggccatatacatatattaacaaaatatgagtttgcaagtaagtaaatatacacatatattaccaaaataagtacacaaaagtaaatgcatgtgtgcatatataaatatatacatgtattacaattccttcggactttgtaatctttgtttctgttactacgacttcctggcattggaagaagaaggaccggcttgatgaataggctttctgaacgtgcagagatgtagcctagaggggggggtgaataggctttcctgaaattttctcaacaatcgcagcggttaaattgacagggcccggaacctcctggtgatgaacaccggaacttctgggcaggatgagtagcccggaacttccggagttcttgagccaggaacttccgggcagcagagataaattaaaactgagatgaaaaacaggtcctagcaagggaagtttaggcacacagaggaacaagatgaagatcacaagatatcagcagattcaaacaaagaacatgcacaagagagacaaagacgattttttcccgaagttcggatcacacgaatcctactctccgttgaggtgctccaaagagccgggtctcgattaaccccttgcctcacttatgcaaagatctcagaagaggtccacgaccttcaactcaacacttctaggtcattttctagaattgagtgaccaccaagatcaaactcaaaattccttctagaaaaggccacaagtgcacgttgctctacctaggataacctctgaaaactcagcacaagaatctttactcacttacctcgtttccttgcggaggtgaggaaaaccttcacaaactttcccgggacatccacaagatctttggaagctcacgggcaacacataactgtctaggagaagatctcaaagagtaataagcctaagtgacagcccacaaggtatccaaagtgctcaatcaagcctaatcttcaagccatctctaaaatactcctacactctcatctaatctctcaatctcacaagataggctctagatttcagtggaggaagcaaaggaagcttgggaatggctagaaaatcctagaacataaaagaactgaagtggaatggccaaagggtgacctggggacgaaatccatatatataatggctaggtgacgtcatctagccgttactcacaagtttgaactggaaacctgccaggaggttccgggcaaaagtgccaacttccgggcagcacttaggaacttttttgcaattaaacagcgcccggaagtttcggccagaacctccgggtagccctctctgtcccggggagaaaatcatttttcaaaaatgattccaaaaatcttttgactcatggatatgactaagagcactttgtataccctagatccacacttgaaacccctcttaatagtacggtttttcctaaactcaatttcgaaagtgaaaaacctagtctaatcacctttggtgatttttgcacataggaacattcctattggggggggggtctccttgcattcttagccatcacaacttgcttttggactaaactcctgtgaataaacttgataaacacgttagtcccctttaaccaccttgtcattaatcaccaaaacccactagggggtttaagtgcatcttcactttccatcgtaatagaattctcctgtgggatcgagaatctgcccgttgatgaatctcatcatctgttcttgaacagcccttatgaaatcatcgtgggtgaggctatatatcatgtaaatcatctgtcatttggaaaaaaaataggattatacatatgaaaccagtaaacaataattgacggatgaataattttacgtacttccaggtcctggccaatcctgatttggtgtgctaagcagtgcatgtaatagcagacgtagtagccgcacaagttagtcccctattcctgctttgcacactgaaagagaaacaacgagagatttaatatgcatatctaatttataacaaagaagtaattcaatataatattggagcatgtactaaccggaaaattgaacctctgtgtgagtttttcattccaaatcccgcggaccaatgtacagaaccgaatccatgccctatttacagttgttaggaaggattaatttattatccgagatccgtatagtacttgtagaatgattcataatgacagtgcaatatatgacaatacctatctatcacttcgaaaatatgtgcgaaagttttctccggtttatccattgattcgtagacatagattttggatttctcaaggttgaaaagaataaggacccagtggaatctgcaatttgcattagatgatacatgtgtgtgtgtctatatatatatatatatatatatatagagagagagagaggaaggaacaaaattgaagttatgattgtaggaactcacgatgtgttgtagggaagtagtatgaacatcttataatgctgctgcaccgggaaatggaggatattgtcctcggtttgtttctcatagttttgtagcatcagcgtgttcactttgcgggggtccatgaatcctgtattgaatttgttgtgccgacggcacaactgaatctctattctacaacgggtacaaggaatttgtataagctacgttcaaaggaggaacaaaattgaactataaacaatacttacaaagtccacgtgctgagaatagagacgtcgagggcgtcgcggtggtataagtcgaagacttctttgtaacggatccaaagaacatcatctccttgataataatctgagtttcgcaccctcgctccgaacatctctctgcccatccctgatttgtccaagtaccattgatgaaaccggtacatctgtgtaggtagctttctcttatcttatcaggcgtgactagcggttcaccatgtttaaacatgtacttttaccggagctgtttcgataggtgcgtcctctagcaactctgctccatctttagtccagtttctttcaagaacttgcgtatctcaagttgttccggatctacgaacggttcaacctcttgttgtggctacagccccagctgagggacttccattccgcacttcactgctgcaggcttggctttaagagccttcctcaatgttcgatcataatcagaaactacgaccggtttgctcagttcagccatcttaataaagtgatcctgaaccactggggatatagggatcttcttttccggactccatggcttcaactgctccctaacttccactctaacggcttcatcgagctcctccggagtcaagtcatacgcccttttcttgagagcggggagccttggctcgtcagatttggctttcttctttggtcttgatggcatgggctcatatgggcaggaccttgacggtgtagacttggcagttggtgtaggctgaggagtcgttgcccgcggacccgacggtgcagacttggcagcaggtacacacggaggaggtggtggaggcagaggagcgggaggagccggtgtagccgaaggagacggaggaggcggaggagacggtgcttgcggcggggaaggaggaacggactaataaaccactttagtcccggttctttttggaaccgggactattgtggaaatcgcccgaccctctaaagatcacttctccagtagtgtgatacctgactggtcgcgtgcatgcgaggccacatgatcagctacatatgtatatactatctacatgtataatgagtatgtatatattgtatatacatacatatatataaatatatatataaatatagttttttatatgtatacattttaatgtataaaaatatacatttttaatgtataaatatatatatacacatatatgaaatttgtatacatatatatacaaacttggtatatgtatgtacataaaatataccaactttttatacgtatatatacaaagtttatatacgcacgtatagaaataccaaaaatacacgtatatacatgtacataaactttgtatacacgtataaaaagtttatatatgtacgtctttaaataaccggaaaaagaaggaaagaaataacagaaaaaaaccaaaaaagatggggacgcctacgcgtcgggcgcccgatggtgtgggggaaaatcgagcgtgcaaaaccactttaaactattttttctcttaaattatttatccaaatcatgatccgattgcaccattaaattcattgcaattaaatctttaaaacaagaccatacatggatatattccaatgaaaaatgtttttagcttattattgaattattttttaatgttgcacgatgttccgccaagtatatcggatttgtttcactaagtagatcgaaaatgtttcaattgtttaaatcgggtgttgtttcaccttatataaaatcaatgtttcagtttgttgcaaaagaatgtttcagttcactgcaacattagatctatacatagtgaaacattgtgagtatactaggtaaaacatttttggtggaacaaacaatgaaacgaaatcccttaatagagagtttctaaaatatgtgggtaatttgttgcaatggagttgtgtgtgtggacacgtggtgggcccagggggcacctgcacgcacgcacacgcgccccttggcatgcacgcgcgcgggggttgggggagcgtccgatttttgctccccccgccggtcgaccgagcagaatcatttttgaaaaaagacggaaagaaaaaaatgaaggtaccaaaaaatgaccttgtgccattcgccgccctccccctctccgcacgcgctatgtgtccatccgtgcggggtaaggggcacgcagatgtccgagaaatagcattttcactgttggatctcaagaattcaaatggattttgcaaaatttccacacaaaatagaaagacactactatacgtgtctttcgacacatttatcagcctaaatctgtcaaattctgagaccatataagtaacaatagattactaagattaatacgataccaagcacaaaaattgttataaaagttagttgattgaacaaaacgatgactaaccttgatcaattcagtcattgatcacctaagacatatcagatgacaacacaggaacagacaatatttattaacgaagttcagccgaagcctacatgtctgggactttgattatggacgctccaacccaatcaatatagcacgcttttattctacaaaatatttagtaatactattaggagtgcagcgcgctccttagtattccgagcgccaaacatgtattagtccaggcgcacttcaccccacgtcccgtcatcccgctcccatcgttatcagagtaaacgatttacttcgataataaaaacaacttccctactcccgatcccatcccatgtcccgtcatcctgcgtccactattatcggagtaaatggtttacttcgataaagacaacttccctgattcctgtatatattttatttttcccatacccaaccaaccactctcgtccccacttcaatttttttccctttttttcggatctgaattgatccaccatcccagcccacagatcggtgacgcaccatggagtaggacggcgacaccgtggcggttgagggctattgatggtagttagcgatcaggtttgaccgtcaatattaccaaaatagaggagaactagttatgcttgcattgcatatccatgttagaataataatattccattagtatttggttcactaacattttgcagagaataatcattaagtggaggagaatcgacatcaaatcagatgataaatcaatcggacgatgtcgagaatcagacttatgtatgaatgggccaagaactcagaattgacacgatgaattgggccaaaattcacaagtctgcgtatgagagcaacggaggaggccacctgccaattttgggctaggccggcccgacccatggttcggccgaaccccccgcagcgccattcaatccaggtttctcctggacggcatagatgactccccaataacggttggtgggtattaccgatctttccaaccgtcataaccgtcattctcaagctataaaaggagctctcatcctcattttactcacacacctcaagcaagagttctctcatattttctcaagttagtttagtgttctcaagctagtggaataggaatagagtagaaatcggaatccggaagccttcggaagtgttcgggtatggctctagtagctcttctcttctcttttgtaagctttgtacttttattagaatactcttctatatacatttatggtattgaaatactttccgagtatatggatgccaactttacattatgttcatgtcatactgattataccgctagcttatctgggagatgcattggtacgggtatagtgtttgcttatgcaattactctatatcatgacgatgatattagagtagtatctgatagtttaggcgtagtgtctacattacgggatatcattatttggggttatatgctgcggatgacaggtgggatgctgatggtgacagctcattacgggtattcctccgcgcgtgtatatagttctaagttaattttctggggagggtactcctccgtatttagccccgattgtatggtcatgacgggctgtcgtaaggaactcgacagttaagggtggcttctcgaagtatcaggaggacatcggatatagggaattagctagtatgtcagataactaggatgtatgtatactatgtatactagaagtataggaatagattctctttctattttgtttccacttagcttacatcctagccacgcctgacatacgtacatctatacaaccggtatagatgtatagatagatagattagcagaagtggaaaacgtgagaactcataattaaaaagtactattagtataggtatagatagatagattagcaccataccatttctgtcacgttttccatccatctccctcattttccgtcttcttccttctctcttcctcaagaaatggcaccacccgcacctgttgtgacggcagcggcagacatccccaccggtgtggccgcccttgcctccgccggacgacgacaacctcatccaggagatcctcctccacctcccctcacagctgtcgaccattcggccctcgcgcctccctcgtctgcaagcagttgcgccgcctcgtctcccggattccttcgccgcttctgagcccaccaccgggattctttcctcctcggcgttttcaagaacgagctctgctaccccatcttcagatccgtcctcgatcgcgagatcttatctcgctcaaccatttcgccctgcggctcaacggcgaccacgtcgcaagcctcctcggttgccaccacagcatcttctcatcttcaactacaacacccgtgagttcctcgtgtggaatctcgttcggcaatcgccatagccgttccgtcgaagctcaccagggaggggtggagggagaaattcgtcatgaacggcgtgatgctttgtgttgctgctgtcatcggcgacggcagccatgtgcacggcagcggcttctagtcctgccgcttcaaggtggtctcttgatcccgcacccgccgccgccatcttcgcacctactgttacagcggcaggtgcggttggcgccaccgttcttggggaagagagaaggaagaagacagattgatagaaaacgtaacaggagtggcactgtcccaattttataaaagtccagtgacattcatctaaatagctgcatataccatggcacggacctaattgtttttttaaaaaaaaacggagcaatggcctaagttcacagatggcccacacaggcccatgttcatacatggcccacgctggcccatgtggcgctgcgtggaacagttggcccaatttccatccccatccgtgtcaatatcgatacacccttcgcggcggcggcggcggcggaacgacggcgaccggcggtcgagccgatcgaaagcatcaccacgatgatggccgcatcgagaacggcgttcgcctccggcgacctacttctactcactgtctcctcctcggcgtcaatcctcaccctggcaaaaacccaaggtatcatcaaatccatctcgttcagttctgggcgccgtcgtcggccgcgagatccacagtccatacctacacccggcaagcttcctctgatatctagtgattttttcggcatatagaaaaacatcatccaaaaaatccaacatatgtattgttcaggtttagtgataatattgatatgcagttcagatagctagtagtagtttgttttccaggataggcaattcaaacatgaaacatatttgcagtttaaagaaaatgttattagtaaattattcttccagtgcattgtgaaacatacttctcacaagaagaaatatgatagattaccaaagtagttacaaaatatgatgtgcatagatcggtggattttcttgtgctcagtagccgcctatttcatcttggaccagatagaatcgatgcagaaagtggagctgaatatgtggatgagttgtcttgagtagatatcactgaatttgcattgacaaagctgtaatccaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcattcaattcattgtctttagccttctctcgcaataaattgatgagctgaacgctttcctctggctgtgaaatatcgatatttttccttccacatattatttccaagagaacaactccaaagctgtagacgtcaactttttcagtgatctgtgatgttagccattcaggtgccagatatccaggtgtgcctctcatcacggtcactactttactttgatccctgtctattagtttggaaagtccaaaatcagccagtttggcattgaatttctcgtctaagagaatattttgtggtttgatatccaaatgagcaatttttcgcctgcattcctcatgaagataacataaacccttggtaatatccagaatgattctgcaccttgtgcaccaatcaagaggagcattgttatggcggtaatagatccacatatcgagtgaccctcttggcatatattcgtataccagaagcctatttgacttctcggcacaaaatccaatcactttgacaagattgatgtgctcaatgctgccaatagtctcaacctctgccaagaattccttctttccctgtctggcaccttccagacgtttcactgcaactctcttttcacctatttttccttcaaagactgatccaaatccaccttcgccgagctttttactgaaatcttcagtgcgttctcttaacttttcaaatgaaaaccgcattggcattccaggcaatatatcgaaatctaattcttcatctagtttttgatacttcctcctccttcgtacataaatgccaacaataataactaaaacaaggctactaattgctgcaagtgtagcccctaaacttaccttgatacgtttttgtgtaggggcagaagcggagggaggaagttgcactttgaggtaaacagaagagttgtaatggagcttttcaggttgtattgattgcaaggagaagacctctgtcacagacttacattctccatcggaatcattatggtaatacctgaagagtacagccctgcaggagcaattctttaagcaggcttgcttgcagtcatctctactttttgcattggttataatgctgccatcaaagtaataaacatcagtaagagttaagaattgatggtttttcatttcttgacaagatattggagtcactggtgcacaaccaagattagccttccgctcgtcaactggctggaagtagcttgaactagaattagtctgaagaggacagatgcattgcccacctgtgcatatcgcgtactccccgcatactgtggggaaagcacagttatccacgtcgattacatcatccatgtggattacatcagataccatggtccactcaaatccagaccactcatacaacctcaaatggccatcatactctaaccttatgtactgggtggacttagcttctggcagtgcaattcttttatctggctttcctgcctgtgtcgactgcagaaagatgctgaggcttccattcgtaaaggtaaccctcgttgggtcttttctgctcttgtttgtgtccaccaaatatttatagtatagctgtggtggtttggatccaacataggcatataaaccatctgggagaacagtcatatacaacttactctcagtccaatttgtggtagatgtatttgctctgagcttcatgccctgcagcaatgactgcccagggaccaatacatcggttggatgatcaaatgactgccacactgtcgcattcctctgatcaaacagcaccagattgccatgctcagtgatctgcatgcctgccacggattggcctgaagtgttgctcgaccagacgagtctcccgtcgatttcacggaggacaagatcgccatctccagttaactcaagggtagcattctctcccaaaggacttgcccggttggccgaccagataacccgtgccatattgttttcctctaagggtaagccataaccgctattgaagttggcgatgaagacagcgaagaggaatgcttggcagggtggagcgcagaagaaccctgcggcaaaggaggggccatataaagtttgtgttgaccggaggatgattgcgcgcacggctgacccgtcggtgtaggtgatactgtgcgggagcaccgcggcgttgttgacctaccgcgtcgagaggttggccgtgggatagtcagggagctgcccggagacggacggtgctgcagttgcaagtaccactgcaaccactgccatcgtcgtcacgtctaagcaaaagagatttgctggacgcatggtgcttgaattgcagaggggactgcaagaagaatctcttcttaatttggttacatacaagaagccaggcagcaaggagctgtggacattggagaggctggcaaagatgtcctgacctgaatcctgatgatactgaatctatgaactgatgtgctctccggaaagatggcctcgtcgtcgcaggcagagggtggccggattccgaagtggtcaactactaagtcttctctctctctgtctgaatacaagccaaaagactaccagtcttcctggtgctttaatttggtttaggttctcttgggaagatggattggcttgaccacttcaaaaaggctaatacttggcattgccgacattgccatgtgatcgattttgcgtgtcaatgtcaatatcgaacaagtttcctttgtgctgtctcgtcgatttttcatcctaaaaagaaaaaaaagagaagtcgtgccgattatattcaagcattcttagtcgaaaaaagattatattcaagcattgtcagagtagatattggcatggtaggcatggtagtaagaagcttcataattaagcattgccacggcattccctgattcccttgtgccattttcgttctgggagagcatgacaaatagtagctagctaatgaggtaagatcagttagaaaacacctgaataatattggttaatgtaaaatttacatgttcggagagggacggataatttgcttatacttcaatatgtactcccttcatgcgtaagctctcctatatacatgagtgcttattattattattattattattattattattattattattattattattattattattattattattattattattattattattattattattattattattattattattattattattattattattattattattattattattattattattattattattcagattagtaaaatgtccatacgagtaaagtgaatttaattacctaaagagactagtctccgacgttcgaaatttttgctagcgtctattgagttcctctagctgtcataatttcctttgtggaggatcctgtttgcgagtaaatgcttgtatatctgaagacaatattttctcctctatcatccagccagtgaataacaagtgcattctgcaagtaagggcccttttaaatattaggaaggtaaaaaacagagaaatagaaaaaacatgggtcctcttaaatagcaggaatagaaaaaacagggaatagaaaaaacagaggagtagaaaaaacatgggattctaatagaaatgcaagtgtagggaaaacatagaaaaaatacagaaatgatcgtttgattgaaccacagcaaaaacgtaagaatcggatgaaagagatagactcgaaggaattttttcaagatattggacttcttactaatttttctctaaaatctctataggattatccattccatatgaattttaaaagatgggatatgattcaatcctttgtttcaaatgttttcataggatttttttttcatagaattgaaattctccaaaatttctatatttttcgtataaatcgaaaggaccctaaaggttagaatggtgaggtcactgaaccaatttgtgaaagtgattggcagagtaagagttaagacaagtgcaggttggtgatcacgagggcttcttcctgttaacggggacaaactacaagcattgccagaaaaagaatgaaccattgtactcgaattttttagcggattcagattcggacactgacagtattgggtgttcatttaattttcatttatgtatgcttcgagttggacagccaagcgggaaatatccatcacattttcctccgtgatgatgtatagaagtattgctactctcatctccttactgcaagtatatgtaaggatgtgtgaataaatttcagtaaataaactgctttaacaagctatttcaactgccagttcgttagacaatgatttaaatacgagagtacaacatcatatacaaaacatgatatccaactacattactttatgggtgaaaataaagccacattacaacttctcaaagataacatcgaatgtataacttgcatatatacaaaactgcaccatgtcacatgtgtatatcagtatatgccatgcaataatctatatacattccatacaaaactgcactatgtcacatgtgtatatgcaatgcaataatttgactatttccttcgcacccaacaaacactggtggagaaagcgtctgtagtcccggttcgtaacccccctttagttccggttgatcgatctttagtctcggttggtgttcgagctgacatttttttttttttgcatggccctgttgctgcatggtttatatatatatatatatatatatatatatatgaccaaaatatatatttacattaaagaaaatgtgtacacatgcatatagaaaaatagacatgtattaattacaatccattatgtcctagctagctacgattttgacgtagtagtagtcgctatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtaatgaaattttgaatttatttgtacgtacatcgagctctcttgtggtgatgatttggtctgcaaggcagtggcaatactcgcacacatagtagcctcacaagttagttccctgcttttgctttgcgcactataaataaatgacaaacggcgagagatgtaattaatatacacttgtatatatttgaatcagagattcaatataaatgtagagcatgtgtactcacaggaaaattgaacttcggcctttctctccatttgccgcgaaccaaatgatggaaccgataccaagccctacatggagtttaaagatatgattcgtagtagcaattaattaacataagaatttatgacagtacctatctataagttcaaaaaccttatcaaacgtagactcttttttatccattgattcatatacgttgacggtgcaggcctccaggtcaaagagtaaaagcacccagtagaatctgcaatgtgtgtgggatgcattacatatgaaacagttagcatgttcgtacgggaatgaaatttggtataggaagacagtaaaattaaactaactctgtgttgtacggcaacagtatgaacgtcttataatgctgctccttcaagagatggacgagatcgtcctctgtttcttgcggatactggtcgagcattgcgacgtttacttttcgagagtcgatgaatccagtatcgaaaaccccccgccgtcgggccctttgaatctccattctacaacgataaaaggaagtatatattatatatagtctacttatatacaaggacctatttaattaaaggaaacgtaataagaaatctaactgaaagatacttacaaaatccagcaactcataatagaagcgtcgagggcgtccagctggtatagttcgtagatacccttgaaattgatccagagaatgtcatctccttgcaagaagttcgtgtccttgatcctcgctctgatcatctctctaccggtggcgctcatctccatgtacagttgatggaacttgtatatttgtgtggttagggactgcagctgctcaggcttgacaagcggtttaccgagttcgtacatgtatttcacttccgccttttcgattggtgcgccttgtagcaattgatccgtagttagcccggtgtcattaataaagtcttgtattccaaaatcttcaccggtcaccaacggctcgatctcctgatttggttgctctttaagctgagggactggtttggattttccagaagatgctttcttgagtgttcgctcatagtccgatagctctatggcctccttggcaggtgcagacatacccctaaagaagttcctgacactcaggtctataggaatcttcttttctggacttcgaggcttcaattgtctcctgacttctgatgccacaaaagcgtcaagctcatcttgcgtgcaatcgtaccccaggtccttgttcttggcggcatcaacttccgccttctttgttgcccttgtgggggcaggcggtggagcttggggggcccttgacttggaaggtgccggacaaggagattgcggaggagtcggtgtaggagcctaaggaggagtcggtgtaggagcctgaggaggagtcggtgcaggagcctgaggtggagacggtgctggagcatgaggaggagacggtgcaggagcctgaggaggagatggcggagccggaggagatggtgcacgagacgccgcttgtcgcccagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcacatggtgagaggttatttattagtaatcaacatatataagcagcaactagcggaatggccaaatctaaaatctataaactacgagcttacatttattgataagttcttgaagggaatatgcagctcacatggtgtccgctgagtgatgtcatcaatggggcaggtggtttcgtcctgggtttgcatggtgtccatactctatgatcctacctgccccgttgaggcgcagctgctacgatttcctgaagggctcaccattgtaggaggaatggtcggctggggatcatgggaccgatatgcggccatgcattcatcaaccttccttgccacctcctcttgcatgctgagctcgtagctcgataccctgaactcaagatctgcaatcttcgcctcggtatctctcttgctcctcatccgactcctatacgtgtggatgtcctccttgaacccaatcttccaaggaatcacccctttccctcgtgttcgtcctgaatgctctggagtctgcatggcgagtgacagctcgtccttctctctgtcgggttggaacgtgccctgagaagaggcttccactgcgtccgttagtcgacgcgcagcctcgcgtatctgatcgccgaagaccagggagccatcagctgggttgagcgttccaccgtgagcatagtaccagaacttcgatcgttccggccaattagcggtgaccggttcgatacccctctccagcaagctagcctccatctcctcccacttcggcatcgcgacgctatagccgcctgaccccaagtggtgatggtacttcttcttggcggcattttctttgtttctttccatcatcgcctgcccttgttgacctgtcttatatgcaacgaactcgtcccagtgatcccttagctttgggaatgtgtcgaagttcggtgtctgccccttcaggatgtatttctggtacagatctcccttgaagctctgaaattgttctgccattttcttcagagtccaccttttcactttgtcctctgtacctgtgggaagggtgaatgtctcgagcattgtggtccacagcatctctttccacgaatctgggacaaagctctcatgatctccgcatgcccttgttctgtgccagtacaccgtactgacaagcacgttatcctgcacaacccaaccgctgtgacgtacgtagttcttagcggcttccgccggggcactaggtcggccgtcttcgtccacttccgttatgatgtgccgaccctcaagcttcttcgcggcacctcgttgcccgcgtgccctcttctgtccagcggagggttgactgccactagcctcctcctcctggttctcctccacatccctctccacgtgcccctcctggttcccctccgcatccctctccacgttcccttcctcgttcaaatactggtatggatcctcgttcccctcttcttcgttccagtattggctgcttccctccgcgattgtatcgtacaatatctgttcctcatcgcgatcagccatctgttcatacaggaaacagttgctaagtcatgagacatttttgctttaacaatcttatatgctaacaatcatatatgctaagtcatatatgctacgtctaactatcgtatatgcgaagtcatatatgctaagtctaactatcgtatatgctaagtctaattacaaatctaataatcgtatattaaaactataataatcttatattaaaactataataatcttatattaaaactcaaatagtcatatatgctaagtctaggtgacgtatattaggaccctagctagtcaataattatatactaagtctaattacaaatataataatcttatattaaaactcaaataatattatactaaaactcaaatagtgattatatatgctaagtctaattgtcgtatattagaaccctacacaatcttatatgctaagtctaattacaaatctaataatcttatattaaaactataataatcttatattaaaactcaaataatattgtattaaaactctaactataatgctaagtctaagtgtcgtatattaaatctaatagtcctaattgcattaaaaatttaacaatcatatatatatatatttacgtcacttgcctgcgcgaattcctttgagggctagctactactccggcttgagggacgacgacgacaacgtcttttctgcaacatacaaaaagatgtattaggataaacgcgaagtagcatatattgcatttcacgttcacacttcgttcacgatcgttcatgttcacgttctcgttaaggtcacgtttcattcacctacgttcgttcgttcacgtgcgtccatgttaatgtacgttaagtaaggttcgttcacgcatgttcgttcgtttatgtacgttcaaatacaacgttaagttcatgttcgttcacgttcatgttcgttaacgttcgttcacgttcgttcgttcacgttcattcacattcacgttcgttaacgttcgttcgttcgttcacgttcaattctcgttcacgtatgtttcgttcgttcacgttcgttcgctcattcacgttctcgttcacgttcgttcgctcgttcacgttcacgttcacgttcacattcgttcgttcacatggcggcagctagcggagaggcggtgtggcggcagaggagcggcggcggggcggcgcgcggcgcgcgtggcatcggcgtggcgcgcggcccggtggcggccacgcgcgcggcacggcggcggcgttgcgcgcggtgcgacggcggcgttgcgtggcggcggcgtggcggcgcggcggtgccgcggcggcgtcgtggcgtcccggcgtgtcgtgccgccgcggcgtcgtggcgcggcggagtcatgttcggccgcgacgacgtcggcgtcagcgtcggcaacgaggcagccggcggcaaccgagagagagagatcaagatcggagagagagagctagagagggaggcggcggcggctctcactccatagatgcggtgtcggcggagtaggcgtagacgtcgacgacgacgcgcgcgagacgacgatgagatacgacggcggcgtcggcgcggggatgccctaggcagtggcggcgaaggagaagccgagagagatcgctcggggcaaaaacttctaagtgttggtggagaagacgagggcgcgcatcgggaaaatatatatacccctagatctttagtcccggttgatgagaacaacc

SEQ ID NO: 62250 - DNA, 3081 bp, Oryza sativa
cggctcggggcacgaggcgcgtgcggcagaggacgaggcaagggctagggacgctctcgaacacctagcgcgcaatgaatagtgccagattccaattaaccctattttagcctatttcctatataaattttattctataaatcctaatttttgcataaatgaagtttactcagtatttgtgttattctaaccaatagattcaccctagattaatattacccatattatatttctatataatttatttgaatccttaattagggctaactcttattccaacgcacttaaatttaattgatactaatatggtcgcgataatatttttatttatttctatcctcacctaatatttattttaaattgtattccaattatttatttagccaaattaattttagggtttattcctaattagttattcttttattcgcgattaatgaactccaaaatcaaaatccaatgaaataggcgaataaaaccggcatgatgcaatttatttaaaaagtttttgaagatccgtatttttagagttttgattttgttggtcgcattttcagggtgttacaagttttacccgtaatgattatcgttaacaattaattgcagctggcaaagtagtactcagtgatccaacactccatgatcagttgaacagaagcacgtcaggttaaaaactcttacagtcatttaatttacttattgtaatattcgtattcaattagattcatacaaaattaattggtatcatctcttctaatgtttctttgaatttttgttcgctgatcttgttatttcttgcacaggaggaggaattgatgctgcagatgatgatggacagcacacagatggtaagtggtgacattcttaggtttagctagctgaagggttttcatttttttacatggttataagtcttctgttatagctagctagcatccaaaaaatgtattcagaatataattttgctgcaagctagtaaaccttcttctccacaatcctactacagtttgttttatttctagagctttcattccaagctttactttgattattttcgaatatgttagaaattataggttaattacttgaataattttttctcatgtcattcaccactaggccattctatggatttaactgaacaagatgataccaaagcagtattaatacttatcttcatcaacttttacattattttttatatgtaatcgtactgtcattccaagacagagctcctaccatttactgaataactgatcttcaattcagtgtatatagctagcatagtagcatacccaatatatacattattgcattcagaattttttttgtgcaagtaactttttcatgcatgcatggtgtgtcatatatatgcaaacttcgatattttgttatgctgctagatatctttaaccagaatgtaatgacaagagttcctttttgatttgacaggtaacaagagtcattagtatgatggaatggaagattgagcttcaatattctgcttgtgaacaatttaatcaatcgatttccgaaataatttgtgaacatcaagattttgcttgaaattaaacaatgtttattgaactattgtgtttgccatcatctgcacctgatatgtgcttaagctttgtgatggacactgcttttctgaaatattaggtatgccatagtcatatgcctgaggtagtgtaaagcatctgtacactagttaagaaacgggatagagacggtcattagagaaccattttaaataataatactggatctaccaaattttgcacatactgctctcagcaagctcatcccattccttgacaattcaaatgagtttgcgtggattgtaacaaagtcatggtttcacccacaaactgcaagtgtgcaacaaggtcacactcgctcggatatcaaaatatatcccccgaataagcaaatatacatatcacacttaagcttccaattatgaggacccaccatcaaattgatcagggcagtccacccaaagaggattcccatgaggaagaaaaaaaaacccggatgacacatagagcttgggttacatgatacacaaaattatgggtgaagaaggagcggaagagcacatatccttgaccgggagagatgcctagggaattccttccccaattctttccccttgtggcgtgatgcgtcgtggtggatatagcccgcgaccttcatcacaatagttgacattgtggtcatccatcactcacgaccttgctagttgctagtgaggcataaggagagggaggtcaatcatacactttgagagagagcacagtgattatgggcgagttggctaaaatgaagccccagatcccaccacttcctctcatgcagattaattcgcaaccgacttcttaatggttagcttccatccaaccaattcagtgaccatcagcttgattttatccttggggcctatgcctggatggttgaatcgttgaattcttagcttggattttctccacgattgacttctctcatatcaaattgttacatttcactaagcgaaggagtttaaaattcaaatatacggtgttttgtgccattttgtaggaacatattggttttataaatattcgtgtaaatatgtatgaatcgccatgtgacaagcatacataatgaagcatcatattgtgattggctgtaagagtgtaattaagtggctaacttgtgaacccacttgtaagtcaaataaataggtaacccatacccatgccggtatgttgtatgaagagaccaacatattatgacatgcacgcattgcgctgaccaagctcctgattcgcttcacttgattaatttgttgattgatttgattccagtgactcgtttgtattttagatattttcatgaaaaggcggaggttggatggatgcgttatcatgtagcagcgtggcgagagcgtccaggactcgtggtattgctcggctgttcagagaaccacatagtgttgctctgccagggcgatttggaaatattattcgcaaatatttttaaagctgctatattacattactgtaataaattgtgaaaaaataatatattcagcggggc

SEQ ID NO: 62251 - DNA, 12574 bp, Oryza sativa
  unsure (1)..(12574): unsure at all n locations
tcctgcagcccgacagcaggaattttagcgtggcaaggagatgctgcaatgtcatgttgccctgttttactaataaaactagtaagtttaaccaaaaacttaaggttacgctggccagctaattaacgagcacaattgcttaagctagtagagaaggccttgttagttctaaacattaaggcctcagttatcaagtcggcacagctagagccagattagagggagcagcaaacaagcagagttcagagttacacacctcttttcatcgtctcctccctgcttttttactcttaatagattacaaaacttaacaatcacaactaatccaagtgaaatagatgggagtggacatttccccgacggcagcgggatccgtcggggaccctatcagtagagatgaaatcggttcggatagttttcaagcgtccgaatgtttttatggaaaaacaaaagcaatgtcggatgaataatttcacataggatcgaaaatagaaataaatttagaatttttcagaaacagatatgcatatagttaataaatatgaagttttatccctattagacccttaatttagatttttatttaattataaaataataattaacaatgcaattaacgtggattcctctttttaaaataacaagttttcacattaaaaaaacacatattttttaatatttatacatatatatatatacacatatccggatagtatatcttgcccaactcatttgtcaaatatctttagaaacatggtatgtgttgcagttgcagctatctgttatacttactagttccagaccatacatttcatggaatgtattattttttttaattttaaataaactaacgaatctaaattggttacaaatgacatatcgtatttaacataaatttaatatattattttgaataaaagaactatttctatctcatcgttgattttggaagcatagtccaagggcattcatattgcaatattcttgaccatattttttttatttgctatgtatatgtatatgataatatcttttttcgtattatgggtattcgtatttgtttttagttttttttaaaaaatatgaaaatgagtataataaagctgatgtccatctgtatttgagccattttcatctgtagctatcaatgtactaaatagatatatgctctgaaatcaaccaaggaacgggagcaggttggccagcctgcagattaccatatatggacatggagggatgggagccatggattataaccaagaggtatatggtatgagagctgctacagcccgggattccgtcaaaacgggatatcacgacttcatattccgacttcctcccacactacgtacatgcacgagtcgcgagctatatctcgatcgcgttggcgcttctctcgtagtatcacactgcggccgaagaggtgcgcatcgtgccactatacgagcagcacatcgaggacgtcgagtccgctacgccactgcgctcatgcgccgtgaacaaccaattaatccatgtctctctcgctggtgctggcgccggccggcagcgtcaatggaactagcagttccgtgggcgccgccgccggccagcgtagtctcgacaacgggaaatctatacgcatccatcatctctaaagctttgcatgtgctagtgttcctctctctctctctctctctctctctctctctctctctctctctctctctctctcatatatatatatatatatatatatatatatatatatatatatatatatatatatatatatatatatatatatatatatatccatggacactttatgatatggttgtgtctatatatgtgctaatacctgataccgacatataccaggtctggtatctatatatattgggactgataactaggtactatgtatcgggtatcacacctgataggctgatacctatagatatcgggtctaatcattgttagtaccaggtaccatatatgatacctatcaatcaagttagatacctatcgatatcgggcctaatcattgttaatatcaggtaccatacatgatacctaccaatcaagtctgatacgtattagtatcagacctgatcattgttggtactaggtactagacatgatacctatcgattaagcctgaaacttgtcagtatcagatctaatatgtatcagacatgatacctaccaatcttgatacttattggtatcgggtctgatacgtatcggtaagggggctgctatataacggtatctcgttttcgaacgagatgatcccgagtaggtatcaggtgtaatacctatcaggtatcagatgattctacacacgtttcaggtgatacctgcaagtatcatgtgatacttatcaggtatcatgcaattttctaccacgtatcgcgtgatactcgcaaggtatcatgtgaaacctgttaggtatcagatgatttcaaccacgtatcgcgtgatactcacgaggtatcatgcgatacctgtcatgtatcagacgatttctaccacgtatcacgtgatactcgcgaggtatcagacaatttctaccatgtatcacgtgatactcgcgaggtatcagacgatttctaccatgtatcacgtgatacttgcgaggtattagatgatacctaccaggtatcaggtgattcctactagatatagttgggcatcccgttgggggaggagcaccccgacacgcgcggtcgcccctagcagccgtcccttgtagatgaggacggcgatggcggcagcagaggacgggcgcggcgacggcggcggtagcgggggacgggcgtgtcggcggtgggggatgggcgcggcggcggcgacagcggctgcgacgggggacggacgccgcggcggtggcggcgggggacagcgacggcggcagtgggggacgggcgccgcggcggcggcggtggccgcggcggaggaggcgacgggggacgggcgcggcagcggcgggggacggcgacagcggcaagtgaatgtatggataagaatcgcgtgtggagaggagctatcctgttgggggacggtatcccgtcccctagcattcccgtatcggtaataagcctgattattgttggtacatgatacatgacctgatacgtattggtaccgagtaccagattgatctgatacctacttataccgggtctcatcaatccttattagtatcaggtactaccaaatctgatatttataggctagggacacggatcaagtctaacatatcaccattcactgtagtagtttatatgccatccacctgcaaccacgatcgaacttgtcaaaatcctaattaatacagtgcagctgcaagccatttccattttattgggacttgggatgcgtccagatctgagtagaaacaactagctgaggtttgatacgcagcaattctactgacacattctggataaaaatccgtagctcctggatcatcaatgaaaacatttactttcccgaaactaaacaaaatgaagcgaactctggatcaatcaaaaccacctcttgcataaaaaaaaagttccctaatccaaagacgtagcaacacaccgcatgaatcaacctccccgtggagcagccactagctgacagctgctgcgcatggcctctgcaagaagctggatcacgagcaatgagagaagaaagaggaggtaagagaaaggaggaccgagggagagctgccaggccaccacgcgaggaggagagagccaatcccatacgacggaatcccgttgtatagttttttttgatatggtatatgcagggccggatccaacgtgggtgttgggaggacttgagtcccccctacatccacaagacttataagacccatggataccccggagcaccccttcgatttttttaccataaataataaactaaaggtccctaaatagctagaggttgaagaaactatataattgagccctcaagattttgtcctggatccgccccgtatatgagcaagtataaccctatcagcctatcataaatcccattattgacgttggtttctctccttcagctgtccgactgcacgttgccacagtactgcccgtctcgacgggaactcaccaaccagcacgtaccgtcacaccgcaggcctgaccggttttttttgcttccacccagcctcgcctaggcccattgtcaaacccgtggataaaggaaaaaaataaaaatatactgttcattgtttttttaataaaaactggataacgaatgttttgcacaaatatttcacagacgtgtcgagagtatcatcttctctttctaatcatgcatatttaacagagaagcaatcagacgcgccgaaagtgtcatcgtctctttctaatcatgcacatttaacattgaagcaatcagatccgtagtcatgcatatctaaagtagggaaaatactaaagtttttcctcaccatattgcgccacgtcatcaagtaaatactgaccatctgatgaaagaaagatttattccgagccgttggatctggatgagtctgaataaaggaggctcagtaaaatactattgtcgctcccatctctcagtcaatcaaaggagaggcttcagaaagcttcccccatctccccgtcactcccgtccttgctgctaggcgctaactcccaccggccattcctcccaatctcttctcccaccggccaccattcctagcaaaccattgccgacgcaaggagaagtggactcttctagaagcttctgaacggaaggatctagagtttttgtcaaattccacacgtaagttacgtagatacgtagtacagttcttcaataggagaactaggcaactagcagaagagaattgagaaaactgacgaaaaaaaacgcaacgcttccttgatcttcaccacaccaactcaccatctccctattgggaccaagtcagtgcaggcagcacaagatagaagccctcgatgcgctaccatgctgctggccgccgaaaactcatctttagaaaagatcgacgaaagggggctaggttgaggagatcactcctcactcctcagtgaagccagcctcatccttcagacattctcctccttttcagtgcaaatccacggcagcaaaggtcgagctacaggctacctatagcagagacgaaggggacaagatgcggtcctactcgtggagtcgtggttggtctgtgtatcccagaacccagagtcagatgcaaaagggaaacaatgaataaatgagtagggacgataatgatgaggactggacggttaaattttttttgactgtaggaaaacgtctagggctagattggtttgagatctaaattaatcttaccaatttttataatttcaataatatttagtgtttatttggtttgaaattaaattttagcatgccttaaaaaaaggccatttcaatagttaacttaggttattttgatttcgattcaaacacaattttagcttgccaaaatttggcatgacaaaaattgataaaacctcaaacagcccgtagtgcatccatcatcagcatgtcctgtacatatgtgaccctgttaaatgcagagaaaaaggctataggcaggatgtgtgttttaatatgcatatgtaaatagtgtagcaagtattcttttaaataaataatttagttaagtacttatatgcatatgtactaattactccctttattctaaaatgtacttagatacagtgttacctttttacacaatcttttaacattatactttttttagggaaattttaacattatactttaactactactaatttctttcgtttattatcgataactacgaaatcaacgttacataaaaagatttaaatagaaacctgacggcactcccttatcatatagtgatataaaaatcaaataaaaatcgacatacatagcactaatcatatactcctaaacttttagtccattcattagtcaaatttttaagttttgattttcctcaaaataagaatgccatatatattttagaatagatagagaaacacgttagtatttatttatcatataataatgcactctcttttgtcataaatatatatcttttgttttttttaccgaacctttaaaattttgcccatcaacgagaactcaataacggggcactgttggcctcacccatatatacatatttttacatatctttcgaacgggtcttaaaagagccatgcaacgcgtggcttacatggctagtttaaccatgaagcgatcagacacgccgaaagtgtcttcgtctctttctaatcatacacatttaacagggaagcaatcagacgtaccgaaagtgtccttgtctctttctaatcatgcatatttaacagtgaagcaatcagacacgccgaaagtgttctagtctctttctaatcatgcacatttaatagtaaagcaatcagacacaccgaaaatatcctcgtttctttctaataatgaatgttttctctgtgcaacccagatggtgcacaccttttttctatcctcaaacccctgtaaataattgaaagaataattaaaaacacctaaaatcacattttacggtggattgaataactcctaataaatttttggtttgtgaaacgtgattttacaagcattaagtgtggtaaatcaaagaaaaactgcccccgaaaattcagccaaagttgcagcgaacgttacttgaaaactgaaaaaaaaatatatatgaagaggaaaaaaccccacgtcgactagattgcatcgaaaattacaacacagcgagcgcggagatgatccgccgccgccaccgccccacctcgccggcgccgccgctggacaacgacgacctcctctccgagatcctcctccgcctcccgccgctgccatcctccctcccccgcgcctccctcgtctgcacccgctggcgccgcctcgtctccgaccgcggcttcctccgccgcttccgcgcccgccaccgcaagcctcccctcctcggcgtcatccaggtctgcgcctaccccatcttcgcccccgcgctggacccgccggaccggatccccgccgcgcgcttctcctggcggctcgacaaccgccacgacctcaacgacttgctgggagtccgccacggccgcgcccttgtccacgtcaacacctgccgctattctcagcgcaggctcatcgtgtgggaccccgtcgccggcgaccgccgcgccgtggctattcccggcgggttccgtgacaggggggtggtcgtccgcgccggggaggtgcgctgcgtcgccggcgacggcgacccgggccacgtgcacggcggctgccattcgagtccctttgaggttgtcatactaggcactaataagaatcggacacacgcgttcgcttgtgtttactcatcggagaccggcatctggggcaatgtcatctcagccgcagttaattttggggattgcatatgcaattttactaccttggttgggaattccctttactgtttgctcctaggtgagcagaggaccagcttctttcagttcgatttggataaacagataacagctcagatcgatgttccacccgatatgcatcctgatgggaatggccaccacagatttggggatacaatctgcagatttgcgcctgcagagaacggcgggcttcttttccttgttgtcacacattatactctcaatgtatggaagagtgagaccaatgctgatggtgtcgctggatgggtgctggagaaaactattgaactggacaggctcctttctttggaaccagggcctcagaaaacggcaccgatgcttctgggcttctctgaggaacataatgtggcttttgtgtgcacgtatattggtgtctccatgatccatctggagtcaaaggaatttaagagtgtttcccaaagaatgagtctaatctatcatccattcactagtttttatactaaaggtaattgcttcccatgccttttccgttgtacatgtagcaaaatcatgttatttccagtagcttgctttttctgaatgccttttattcgctccgtgacaattaatgttcctttaactgcttgataaactgtcctaaatattgaatgttgtttctaatattagtctctatctgttttagcgggtttgactaatttatgctttgaacatccatagcttagaagttaggaccattattactcatatcagaaatactagaactaaattttgagctcctattcatttattcaacttgtctgatggtagtattaatgtgtgcatactacatggtatagtactttttagcttgagttacatatcacttttgaaattagcaacaaccatatggaaaacatacctgaaccaataaattgaaatatcaaattaccaacacagttggcccacttagaaggttccaagctaggtgcagtctttttgctcaatacttttatataaattattgactgtgttgttaaatgtatggctttgaattgttacctttcaactaattgatggttttaatcatatgctgagaagtccttttgcaagtgcgtgctccatttgtaaaagagaagacataagttgaatatgtttggcctaagttctataaaattcattactggctacatctgtagttatagtttatttgctttgccgtatttttagttttgtctgtttgagaagcatggaatgaacttgtgaaagattatatatgatgcactttttcctgaccaactaaattgtgcagggtatagctcttcattttacgtaaatgaacaagtagtcagggaggtcaacccattttttattgcaatgttgttacattagagtctgcaattgagaatggaaactcattgatggacttggaaagatccaaaatatcttaagaaattaataacagtttgcttaatttgtagtcctaatttttcttaggatgctgggtggtgaatctgtatttgtgtattttcctgatgtttcttcatggagttgtatttttgtcccagagttatttacttgctggctgtttgtatccacatctgactagtattaattaagaagttggttttgtttcctggatacatactatagaatgactatatcacttcctgtaagcgaatttttgccaacatgcgtgtccttcatttgagttagatgttttaagaattgagatttggcctgattttggtgtagcagggttccgtttgcatattctgctgactaattgtcttttgtgtgcttattgatggcagaactgtcgccccactgatggatgatcatgtaatttgaccatggagatcacaagagcgccattcctggtgattttcgtgagttttaagatggctaactatatttcccaagtattaccaagtcggatatgatattcgttgtcagtcctagcaggttttgtacggtcacatgttcctaatacttggatcgatataatttagcgacaataatgtaaatcatgttcaagtgctgcatagataccttcatctgcaattcggtattgtcgcctgtgtctggaattgtgatgtcacataatagcagtcattattcttgctcctgtgaatgtgctctctatcccgttcaggaaaactgaataatcacctcactttggcgtagatactgtgttatttgtgtttggcttgactgatggtaggtcaattggacataggcgcaacaaggtgcaaagttttcctgaaataaaagaatgaattgactttgttgtcaagtttatcaccaagtagtgcttctgtaatatgcatgccactggttgagtagccactagaaaaaaaaaacaaaaccaatgttgtttctgaaaaattgaccctgtgccacaaagttgattggtattgaaaaatcgccccatagttgaggcgattgccctctcttttgccacaacaccatgtacgttccctttcaaatttctcccttcttcctccatcttcctatgcacgttgccaagctccaccgatgaacgcattcaagncttcgccggcgccaccctgctcccaaactctgctgcatcctctcgccatcaccgtcgataccgtcgaggctggtggcagcgtgggcacgatgggcgatgttgatgggaacgggtggcttggtagagacttccacgtaggtgagaaaggtcatgaacacgacggcatggcctagttagacgtatagagaaagaagatgagaatggagggaaaagaggggtaactttggaagtccatgtgttgggtatgttgtgccaaaagagagcgcaagctagcgcctcaattaaaaggggggtaactttggaagttcatgtgttgtgtatgttgtgccaaaagagagcgcaagctagcacctcaattatggggcaaaaaatggagcgcataggagatttttcatgcctagccaccgtgttgcctaaagaggtaactcgggcgacaccccaaacctagcaccgctcctccccctacccatcaccctgcctttgtcgccgtctaaccagcatgttgggagcacgacaagcaacgaggaaggtggcagcggggcaatcccacccagagaccttacgagtagagaagatgctgatggcggcaacttgggtggtgcgagtgtagctggtgtttggaagcattcagatccacaactagttaggctagatctagtcggttcgtcttactgatgcttgtgctcatgagcacggcgaaggtaggcagatctggcacatccattacaagatccgcggatctagtggcgtcatggcatccgcagctgcaggtagaggtcttcttggaggttcgggggaccggcaacgatgacttcaggatggaggcctacgaaatcttcggtctggtgtagccagcatgtggaggcatgaccctgcggtgatttggttacagtaacgatagtggcttgggcggtgctgacttgcgctatcgatggtgttggaccaaatccatgtgcgagaaggcaactgtgcttggcctcgtggcaatctgtcatgtggtgatgacaacaacatgggcggtgctagccggcgaggtcgatagcaaaggacaaactacactatggggagagcgttgtgctcggcccttgcggtggtttgtcttgtggtgacaaaaatgacatgttgatttggggtgatgcatgaggtgggtggagggtggcctgtagagggacaatgggtcatgattgcaggggttggtaggctgtagcctgcatgtgtaaacctatcctagtggtttgttgcgtcagtaacaccgacacttttgagtgtcttgttacctgatgagggcattgttgaggcacctccccctgccgctggtgggacactctaggtaaaaaccatatccagttcattagatgggcagttgcggcactatggcatcacatcctccctggaggcatcatctaggaggtctcgttcctgcctttcccacctccaaatagtttagccaacgcttttgaatggcggtgggttatacgagggatgcacggatcatcgtctctctcgctctctcgcccttcttcacaggtggtgtccatgaggccattttgtttcttgctgtttggaggtggtgaacggtataggggtgggtacgttataggtttggtggcgttgttatgcatagtggcaggcgggcggttctaattaaatttaggtgtgcgtaatgccgtcggtgcgtggtggtcctattttttttttcttttgcccgattataacatcgtagggctatagtcttgtgattttttttctgctatatcaatacaaaacaccatactctcaggtgatgttcattcaaaaaaaaaagaactaaggtgcaaatttgcaacatcaatcagccttgtggcaattgtgagtacactcttcgactttgtagcataagagcaatttttattttctgatattaatcgaaaaaaaatgtgagcatgcacctgtactaagtaactttaaatctaggtgggccagtttcacaatagcctaatcatgagatgcccatttgatcgaattaataacagaaatggccattttagacaccccagaaaaaaaaaagataaagaaagataaataaacttgccaactataggttgttgcatatccaatgaaaatatattgtgacaatatgtactttcgtagaagtatagttttatatatatttatgctaccatactataaaaataatatcataaaaactattccctccgtctcaacatatagcaagtaggatgggctcgtcttagctatatattgggacagagggagtgctgtcaaatggacaactgcgtcacgtcgaaggacgtggttgctcaacagtgttggaaaagcaataagtgtattgattgataaaatttcttgggatcccccattacatggccctaggggtctatttatagccttagcacaggcttacacctcctagggtttaggtttacaggggattttacatggttgcccttataaaagggatatttacatgggtacacagtgtcatttgcatatatgggcctttaatgggccgataggctgggcctggtctatggtgaaggggccttaaaggtcgggggcagcctggtgggcctccttaatgccgaactcgtcatggcgaagtctttgtagttcgccg

SEQ ID NO: 62252 - DNA, 108634 bp, Oryza sativa
  unsure (1)..(108634): unsure at all n locations
agacggcggagtcggcgcgggcatcccgtaggcagtgacgacgaaggaaaacccgagagaggtcgctcggagcaactacttataagtgttggtggagaagccgagagagcgcgtcggggacatatatatacccctagatctttagtcccggttatgagcaccaccgggagaaaagatatctgatatctttactcccggttgttctcatctatctttactcctggttgttctcatcaaccgggactaaagatattttcccactatttctaaattctttttaaacccggttagggttaagaaccgggactactgataagcgcactgaatattaatttccattacatatgtgtttttaaaatagaaaataatgcactaaaattatttaaagtcgaaaaattaatgacaattacttcgaaaaattattgttggctgtagtaaattaagtggataaaacgtagtaagcaaatatatgatttaaaattaataaaaattctaataatcttatataattagcatatgaatgatattaaattaattgttaaaaactctaattaacatatgtaaatatatacgacatgcatgatttaaaattaataaaaattctaataatcttatataattagcatatgaataatattaaattaattgttacaaactctaattaacatatgtaaatacatacgacatgcatgatttaaaattaataaaaattctaataatcatatataattagcatatgaataatattaaattaattgttacaaactctaattaacatatgtaaatacatacgacatgcatgatttaaaattaataaaaattctaataatcatatataattagcatatgaatgatattaaattgattgttaaaaactctaattaacatatgtaaatacatacgacatgcatgatttaaaattaataaaaattctaataatcatatataattagcatatgaatgatattaaattaattgttaaaaactctaattaacatatgtaaatgccacatgcatgatttaaaacttttaaaagttgttaaaacctctaataatcgtgcgtaattcacatatgccaaacaacaattgatcggcggtgacggttgaccgcacgtactttctcctcactattgttccctccttgtgatcgctacgtgagtaaggggtgtcttcatttgataggaggatgctagggtcaatcgtcaccgtgaaaggaggttgcccatccaactgatcgtaatcctcgtcagtcttgttctcaaccccgacgatttttcttttgcctgggagaaccacgtgacgcttaggctcgtcaggccctctgcccttctttcctttgctagacatgtccttcacgtaaaagacttgcgttatatcattggcaaggacaaaaggttcatccgagtatccaaccttgttaaggtcaaccgttgtcatcccactgtcatcaatcattacgcctccaccagtcaacctaacccattggcaccggaacagagggaccttgagaggaccgtagtcaagttcccatatgtcctcgatggcaccgtaatatgtgccagttgttccatcgtgtcccatggcatcgatacgaacaacgctgttttggttcgtgctcttcatgtcttgggctctcgtgtagaatgtgtacccattgatctcatatccctggaatgtcgcgatcgacccagacggtcccctcgctaggaaggcaagttgttggttgatcgtctcgttacccatgagatgttgtcgtagccacacggggaaagtatcaatgtgatgccgtgtaatccatgcatcgaacttaccgatgtttctggcacgaactagagccaagtgctcatcgatgtaaggagataccaatgaagattgttgcagaaccgtgaaatgggctttacggaataaattattgtctaccatcattattgctttccttccgagagttccctttccccgtagtctcccttcatggcatgattcaggtaccccgattgggcgaaggtattcaataaattctacgcaaaattcgatgacctcctctattccataccccttggcgatgcttgcctctggacgagcacggttacgaacatacttcttcagaacgcccatgtacctctcgaaaggaaacatgttacgtaggtacacaggcccgagaatactgatctctttgacaaggtgacaaagcagatgcgtcattatattgaaaaatgaaggtggaaatatcaactcaaaactgacaagacattgcaccacatcattctgaagggcttctaatctatccgaatcgatgaccttgcgttcatgaatgcacatagctttgttattgttgcccagacattgtttggaaggataccccttattacaactggtagcagttatgtcatcaacacgtgacagtcatgagactttaggtttgtgaatttcttctccttcgtgcttattattcgcttgatattcgtggattatccagacagtacatttatgctctccaagcattcaaacatactttccttctctgccttgctaagagtgtagctggctggactcaagtaatggcttcctttctcctttggttccaggtgaaggttgccgcgttgttccatatgcttcagatcattacgtgcttccagtgtatctttcgactttccgtacacacctaggaagccaagaaggtttacgcaaaggttcttagtgaggtgcatcacatcgattgcgtggcggatgtccaagaattctcaatagggcaactcccaaaatataaagttctttttccacattgccgcttgaccatcttcactctctataggctggcttccagacccctttccgaacactactttaagatctttaaccatagcaaacactgttttcccgctgcgatgtttaggcttcgtacggtggtccgccttacgttcaaagtgcttgcctttcttccgtaccgggtggtttgctacaaggaatcgacgatgacccatgtatacaaccttcctacagtgcttaagatacgtactttctgtttcatccatacagtgagcgcaagccttgtaccccttgttggactgtccggataggttgctaagtgcaggccaatcgttgatggttacgaacagcagcgctcgtagattaaactcctcctatttgtcctcgtcccacacggggacaccttccttcttccacaacagtttaagatcttcgaccagtggtcttaggtacacatcgatgtcattaccaggttgcttggggccttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcatcattctagcattccccttgttcctgaacaaacgccttagccgtggtcttataaggaaataccacatcaccttagcaggaattctcttctttgttagctgcccgtcaacttctcctggatcgtctcgtctaatcttgtatcgtagtgctttgcaaatagggcatgcttctaggttctcgtactcctcaccgcgatataggatacaatcattcggacatgcgtgaatcttctgaacttccagtcctagagggcagactatcttcttagcctcgtacgttgtctcgggcaatttgtttccctccgaaacaatgttcttgatgagtttcaataaatcgccaaatgccttgtcactaacaccattttttgccttccattacaagaactccagagttgtatccaactttttgtgcccctgctcgcaacctgggtacaacgacgttctgtggtcctctaacatcttgtccaatttatggcccccttttcactttcgcagtcctccttggcgtcctgcaacatctgaccaagatcatccgcaacgtcgttaccatcagcatccctttcctcctcgcccgtttgatttccttcaaatccaacgtactgagcaaagtccggaatattgtcatcttccacttcatcttcttccatttcaacaccttgctctccgtgggatgtccaacaattatagcttggcatgaaccccgactcaaacaagtggaaatgaattgtcctggatgcagaatactccttctgattcttacacttgttgcatggacaacaaataaaacccttatgcctgttagctttggtcactctcaaaaaataatgcacgccgtcaataaactctttggaccgccggtcagcgtacatccattgccgatccatctacatgacatgaaaaaaaatcgtacacaaataattattcttacaataatgacaatcatataataattataaaataattacgaactctttcaacagttatacaataatgacatatctttattcatttaaaaatcataaaatattacaccaaataattcttatttactatttctaatgttttaaactaatattaatgtgttttacttcttttaattttcattttagtttgttttctattatttaagattaactttcactatattttccttctcaactattttataaaaccttctttagcaaatcaactaaatttctatatattctttctttcccacacaaattttctctcttatcaacttacaactaaattttggagacaaaaaagtgtgtaaaacatagctccaaatgtaatatgacaaaaaaaaatattggaggatgaacttgcaaaccttttaggcacctccgatttgtatgtaatcatcaaaattaattcactagaaattttggcatgaccttctatcttttttgaagaaattttgaagcttgctcgggcagctggaggaggaagaagacatatatatatataggggtgggactttagtcccggttggtgttaccaaccgggactaaagatcccgggggggcctgacaggccctgacagcatttgaaccgggtaacgggcatatttgatctttagtcccggtagccccggtttttattgcatctaggactattgtggaattcggccgaccgacgaaagatatttctccaccagtgaaagtgtgagttgtacgtatcatcatggcaatatacgatacattcgatacgcggatatgtgcaaaagtttcattcgaaatagatatatccatttgttccatatgcgcgtcattagaaaaaactcatttggaaacaagtggaaatttgtggagttacgcacatgagaaaaaaaaaacatacacacacagagcaatgggaaaaatgggaattaaatcatggggcccacactggccagtgtcacgcgagaaaatggatattttgccatcctcaaaacatggtttcgttggaatgccatctaaaaaacgcaatttgttaaaatgccaatatggaccgcgcgaccacagccactttgctattttctccattttctctcttttctccattttcaatttcattttcgctggagtagagcttgatgagacgattttgcccctgcttgccggctaaaaggggatcgagatctcgcgagctaccggccatggctcgacgcgccgcagccgccgacggagagtcccgtcgccgccttgccgctcctcatcctcctcgtctttctcctctcaacttcactcggtatggtcgccacaccggtgcgagaaactcgatgttggtttcttcgcattccaggcttgttctgacgcgctcgcgtaccgttgtgtttgcaggggcgtgcagttcggcgagcaagaggggcggcgacgggcgacagcggcggtgcggtagcggatgaggcgtactactccagctgggaatcggcagtggcggtggtggtggcggggcgacgaaggctagtccggccagggtcgtcgccgccgacatgccggagccggtgcggtggctgccacccaagcttgttcttcccggctgcgtcgccattgctgcacggacaaggtttagctgctacctagctggagcaagagccatcgacaatactgcagccaagaaggacattgctgagaagatcaatcacgcaggcttcggcttcgatgggttggtgtatgtaacgttgagttcttggagattgaacaagggcagagagatgttaatgctgccattttgtttttcctcctcctctctttctatttattttttttctgttgtttgttcttcccttgcattttttttttgggtgatttccctgctaatttgttccatctttgccatgaactttgtatttactcgtaacgcacatcatcgtcttgctctgttcaattcttgctatttaaacatcttttagtagatgaacaatgaaaaacttctcctacttctatcttcagctctgatgcgtgttagtgttcttgtggctagtgcacccgtgcatgcacatttcagtactatagtatttcacacaacaatggaccggcgatgcaggtgacggtggtggcggcacttaccgacgggcagagaagccagcaactagctgaaatggctcaaccagctcgatgcacaacggttttcaacatccaaccgaaggggcaatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcgtgtagcgctgttaacgaccaaatttggtaatctaagtatcggagatgaagaaggaatcgaaacggagttcgagatagagatcgtcccggaaacagagtaaagtcagctgaaatccgaatcggctacgatcaggatcggcagagtccgagttggatagggttagccaattgagttgaatctgacaatgtagcacgatatacgttgtcgggttaggttaacgagcttcatgaggattgtcgtgcatggatagagtcctaagaaggcaattgtatctattaattaggatattttatgtaatttccttagagatatgtttgggcaaaagtctgccacaaagacttatggtattttagagtttgttagagataagaatcgtgtccgatatagacatattttgtaatctcgggtataaatagaccccgagccccatgtaatcaaactaacacacgcatcgccacccttttaacttttgttttgtttcgacgagttcttactttcgggttgagctgcatcggttttgatcttcaacaagaggtaaaacttgttatggtggcttgcgttattaggattagtgcttccatctttatgatactctaatcttatttatgtaatttgtcgagttatcatatatcttacataatctccggcaatatcgctatctaaccgtcaatcggctaacgtctggtacgagaagtcagccgattaggttaaatactgatgttgacttagattatataggatatctactactctatgaaatatccaacggcttgattgtctagaaattgtccttctttttatacttatagctgcatcagttaggtttgatcttataagtcgtgattagaatctcaatctgctttttggttgccaattagggtagtatcggggtttcagccgattttacctgatttagctttatatttcattatgttaggatatcattacaataaaatatgttagcttctgtgtaatgtattttacttgctttaatatcgagtagtatcggagtattagccgatacgtgctagatctatctgatcggttatgctatgaacagatatatagtcttgttgttaatatatattttgatctaagtgatttatactgtctcggcatggcgaccgatctatcccaatcacttgatttaagtatatatcgacataaggactatatattattaatatctacagccgatcgagtagatttagttcttccgtacttattaacatttgccgatcgattcacatatgacatcggctcagagataagtgatatgtcatcggcaattagtcgatcggctatcgtttatgaatttaaccgcggtttctttatctttgtttcttgttgattgcaggatcaaatcaactggcacactcatacacctaaaggcaagcttttagacctgcattggagttaagcagatctcccaggccttgtgtttttacatcaacacgcgctgggatgagactcctctgactttgtgtagtacaactgcaaactgcacaaaggttgtgtttaaatctacgggtgaaaagttttggtgcatcacatcggatatacgggcacacatttgaagtattagacgtagactaataacaaaacaaattatagactccgtctgtaaactgcgagacgaatttattaagcctaattaatccgtcattagcaaatatttactgtagcacgatattgttaaatcatgaagcaattgggcttaaaagatttgtctcgtaatttacacgtaatctatgtaagtagttttttttatatttaatactccacgtatgtatagatctaaacattcgatgggcaaagtcaccggatatccgtggcggtgcgtggaacagttgggcccttcccaatttccattcaccctttcgccgcggcggcagcggccggcagccgagccgcgatcgaaagcaccaccacgatgatggccgcagcgagaacggcgttcgtctccggcgacctacttccactcaacgtctcctcctcggcgtcaatccccaccctggcaaaaacccaaggtatcaccaaatccatctcgttcggttctgggcgccgtcgccggccgcgagatccacagtccatacctaccaccaggcaagcctcctctgctatctagagatattttccgccatattgaaaaacatcacccgaaaaatccaacatatgtactattgctcagatttagtgataatattgatatgcagttcagatagctagtacatatttgcagtttaaagataatattattagtacattattgttccagtgcattgtgaaacatacttctcacaagaagaactatgatagattaccaaagtagttacaaaatatgatgtgcatagattgcgatggattttcttgtgctcagtatcccacctatttcatcttggaccagatagaatcgatgcagagggtggagctgaatatgtggatgggttgtcttgagcagatatcactgaatttgcgttggcaaagctgtaatctaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcgatcaatacattgtctttagccttctctcgcaataaattgatgagctgaacgctttcctctggctgcgaaatatcaatatttttccttccgcatattatttccaggagaacaactccaaagctgtagacgtcaactttttcagtgatctgtgatgttagccattcaggtgccaaatatccaggcgtgcctctcatcacagtcactactttactttgatccctgtctattagcttggaaagtccaaaatcagccagtttggcattgaatttctcgtctaagagaatgttttgtggtttgatatccaaatgagcaatttttcgcctgcattcctcatgaagataacataaacccttggcaatatccataatgatcctacaccttgtgcaccaatcaagaggatcattgttgtagcggtaatatatccacctatcaagtgaccctcttggcatatattcatatacaagaagccgatttgacttctctgcacaaaatcctatcagcctgacaagattgatgtgctcaatgctgccaatagtctcaacctctgccaagaattctttctttccttgtttagcactttctagtcgtttaactgcaactctctcctcacctatttctccttcaaagactgatccaaatccaccttcaccgagctttttactgaaatctttggtgcattctctcaacttttcatatgaaaacctcactggcattccaggcaatggctcaaaatcaatttcttcatctatctcttgatacttcctcctttgcacataaagggtgataactgtgacagccagtacaaggataagaattgctgaaattgttgcacctaaaattgcctttgttttgtttgctgtggaagcagaagcagaaggactaagctgcaccttgaggtaagcagaggagttgtaatgaagggcttcaggttgtatcgtttgcaacgagaagacctccgataccgagaagcatgtgccatcagaatcattctggccatacctgaacataacggccctgcaggagcaattcttcaagcaggattgcttacagtcatctctgtttgttgcattcaggatggtgtggctgacatcgaagtatgaaacatcagtaagggccaagagctgatggcttcgcatttcttgacaagagattggtgtcagtggtgagcaaccaagatttgcctttcgctcgtcgaccggcttgaagtagcttaaactagaattactctgaaggggacaggtacattgcccacctgtgcatatcccgtattttccgcacgccattgggaaagcacaatcatcagggaataccttgattacatcagacacgactgtccactttgctcctgtattagaccattcatacagcctcaagtgcccatcaaactctaacctcatatactgggtggagctggcttgtggcagtgagatattgcttggctgagtggactgcacaaatatgctaaggctgccattggtgaaggtaaccttggttggatcttttccactcttgtttgtgttcactgaatgagaatagtagagctgtggtggtgtggattcaacataagcaaacaatccatctggttgaacagccatatacacctgattctcagtcgaatttgttgtagtgctgtttgctctgagcttcatgccttccatcagtgactgcccaggaaggagtgtgtcagtcggatgatcaaaagactgccacaccgtcacattcctctgatcaaacagcacaagattgccggtgtcagtgatctccatgccagccacagaccggctcgagctgccgcttgaccagacgaggctaccatcagcatcactgaggaccaggttgccattgtaagtgagctcgagggtggcattctcccggacggggcgagcccggttggccgaccagaccacctgcgggatcccggtggtcgtcatcgtgatcccggcgccgctgttggtgtagacgatgtagacggcgaagaggaacgcgtcgcaggggggagagcagaagaagcccgcggcgtaggaggggccgtagaaggtcttcggtgaacggaggacgatggcacgcacggccgacccgtcggagtagccgacgctgtgttggagcgccgcggcattgttcacccaccgcgtcgagaggttggcagtgggatagtcgtaccgctccgcagagaccggcggtgctatggttgcgagtgcgatgatgacgatgacgatgatgaagaagaagaagttggccggaagcatggtgcttggatgtgaactgagaatgcgatgaagaaccaattaagcaagaaacttggggcatttctgccagagatgagagaagatgttgtcagttctcacctgatgtcagcatggcaatggtggagctgatgcggtgaccggcaaaatggtctcaccatcgccaaggtcaccggactctggagtctgcagtggtcagctacttgtcttcttgatctctcagtaagttcacacttcacaccaagctgggctagattattatggttttggtttatctgtgaagacagattgacttgaccatttctctttggggggggaggggggggggtcaataattagccgtgccgacaaatggtagtcgtttccatgtaccaaattgctgatatcatcaacattaacaattcaattcaggcgttgtccctttcagtaaaaacaattgaggcattgtccttgcatataaagaaggcaattcaagagcaggtattggtacggtagtaaggctggtaaggaaacacgggaactgacgaactgtattgtttaatttccaattcacgcgttccagatcttaaattggttgtaaggatcagttcatatgtagatttttccagttggtatgatcacagtatcacaccaatatgattgtgggatcttggtcaaagtttccattcgatcctgactgcttgtacagactctagtggtttatatattaaaaataactacatgtacatgtccatttattacaaaatttcactctttcatctgtccatgtaaggggttttttttcataggtaaagaataaaatttctactgcatgtttttataattaaaaggggtttcagaagtataactttacaataaatggaaggtgttgatgataccataacttggagatggacgagcaatgggaaatatagtgcgagatcagcctatatagcacaattcaacggaaggataagctcagctgcagcaaaactaatctggaagcaatgggctccctccaaatgcaaacactttgcctggctgttactacaaaataggatttggacaacggatcggctgcagatcagacaatggccaaacaactatttctgttaactatgatacaggaacctagaaacaactcaacatctcttcaaggattgtccttttgtgcggcaggtttgggagagggtcctagggaggctgaactgcaatgaaattgacctgacacatgatgaaaatgaatcgctgttgaactggtggattaggagaacatctcaaggtgggaaggaaaaagctaaggcaaaaaaatcaatccacatgttggtagcatgggaaatatggtgtgatcggaacataagagtatttcaaaatcaagaaaaaaccctgcagcagctactagacaagattcatgatgaagtcaagctatggagaatatgtggagcaacaaacattgcgagattatcggcctaagaccttttgattgattagtgtttttcttgtttctttttatttcttcttttatttttcttttcttttatttttctttttccttttctccttcaccgtttggtgatcatgtaaatagtttctcccctacttaatataacaccaacaatgctggctcggttttcaaaaaaaaataactttacaatacagaagtattcatacattttagattttctttttttttggaatacgcaaggagcacatttttttccattatttacaatgtgaaatgaaaaacaagcacgggactggtactggaggctagggatctaatggggatatctcgcgctagatttggctaccacgacctcgcagaggtaaaactgaagggacccctacatttgccgacttccaaagcacggcttcttccgccatcgctttcgccaattcgatccaagacttgctctgttgattgaagatccggttgtttcgctccttccaaatcgaccaggccaccagcgttgcaatagtgtcaaattcccggcgatgctgctctctcaacttcatccggctttcacagagccagaggtgggtagacagtccggattgcctatcgctcttaatgtccaacaccaaagctgcctcgactcaggtcagcctaccagaatgtggtcgatgctctcctcctgttgatcgcaaagaacacaacggtctgggtgaggcaacccccggctccgtagatgatcagcggtccaacatctgttcattgctaccaaccacaggaagaagcggcatcgaggtggagcaaacgatttccagatcggggtcaagaggaaggagatccgaccaaagaacagagccttataagaagatattgagctgtactgacacgagctttcccatttccagctgaaagaatcaggagtggtagggttacaggtcaccgattggactagcgaccaaagcttcagattctccaggatggcttgaatcccaagtgccccagcgatgtccccgatccatcaacgatccgttagtgcctcggccaccgtccggcgctggtgcacgtgaggcgaaacacgatcgtagatgttaggggcaatggatcggatgcagccctcttgcagccaactatcctcccagaagaggatcgtttgtccatctcccagctgacagactgtggatgcagccacgaagctcttctccttttgcgaccccgggatgtctaggccttgccatggtttacttagtgaagtccgttgtagccaagtccatctggagcgaagtgcaatacccatcaactccagatttggcaagtctaaaccgccatagttcttaggagcacagaccctcgaccaagcgacccggcagcaacctccattggcttgcgccttgcctgccagagaatcccgcgtcggatcttgtcgattcctttgatcacccacttgggtgcatcgatagtaatcagcaggtagattgggattgcactgagtacaaactgaaccattgttacatgacctatcaacgacatttggttggatttccaagctggaagccgccgggctatgctgtcaacgaatggctgcaagtcttctttcttcaacctgaagatggaaaggggtagacctaagtacttgcaggggaaggatgcaacatggcagggcaattccggctgtatcccagcaagcaactcctctgagcactgaatcggcagggttgaacattttccaaaatttgtccggagcccagaggcctcaccgaagacgtagattttctttcaaaagaatcatctgaaagaattatgcaggatcttacatttgtaaatgaatcctgcaatttgtgatatcctgcctggaagaattatgtgccctattcaggagtcaggacacaaaatatgtaggtattttagcctaacaaatatgtaggtaatgtctcgatgaaagcacttaacattttctttgtctgtatgtgtttggatggttgctttttcttaaccaaattgcaacagtaacataaaatatgaaggttaacccactaaaggacataatttgttgcaccaacaatgattatttctcatactttgatgaccggcgtggtttacaaaaccatttgaaggttgaaatgttagttcctggcgaattaacgagattaaaaaatgcgactgtataatttgtaaaccaaaatctgaatcctagcggacagttcaagcaaactaaaaatggatttcaaacggcttatggagaaaaccgatcagtttgagccaaaaaccaacctgtgtaaaaccatagaataaatgtaagaacatttagaaaattgaatggaatttaggaaaatctggaaaaatgagaaagactagcaagatcattgctataatttggacaaacttatgttgtctacaacgttagagcatctcgagtgtatgaataaatcaaaccgtcgcgccacaaaacgaaccgaacacattggggagagtcgaactgtatatgtcagaagactcgaaccaagccgaataaaaaaaatgcaccattgcatggtgagcacatacatactgatgcgtggaaagaaaaataatactgcctctatttctaaatattggttaccgttgactttttagcacatgtttaaccgttcgtcttattcaataacttttgtgaaatatgtaaaaaaaaaacttttgtgaaatatgtaaaactatatgtatacatataggtatatttaacaatgaatcaaatgatagaaaaaaattaataattacttaaatttttttaataagacgaacggtcaaacatattaaaaaaatcaaacgcgtcaaatatttcaaaacggaggaagtaatttagttggctttctctttgctcagaatgagtggtgggagccgcaaaccggtgtttacactgtgaagttcgaacactcagacacgctactgattttgcacagcaaaattgatggcacactggagatgcccgtatagttgacaaaaatgttacacgcactgacaataacaacattataaagggctttcacagtgcggggacgtagcgagtttcttcgcactgctagctagaaaaatcgccacctgtcaaccgggagtgcaccccactagagtccctcgttcccacgttgagatacgctattcttcccctcctaagtccacgcgcggcggagaaagagcttctcgtgtgcactgtggagggtgtggctctgtcgcgcgcgttcccctcgcgccgcctgggagaagaatcccaaaattgccctcccgcccccacctatttcttcctcccgcgcaagatttcgttgctcccacgctcacatggttgctcggctccgtgggtgggagtccctcacgcctcgccctctccaattcacggccaactcgccatagccgctcgcgccaccgacagagttgttcccatgcaatcctcaccttcccctccagagaaacccttgctcgagctctccctcgccgtcgttgtctgcaagaggtaagcaaaccctagccctgcatggttaacggtggcgcgccgccgagggatgggaggataagaagcgtggcaggataggagagcggatcgacgtggcggatggggaggagaagcggcgccgtggatgtggaggagaaacgatgcgcacgagtggggaggaaaagtggagcggcgcggcggaaggcagagcgagcggcgctgaggataggaacgcggattggagtcgatgcgtcacgagaaggaaggggcagatggggcagattatctgtggcccattcggctggggcaccggctaggtatgtatttgtgggctgtgttacctcactaataacataatccagttaagccatttaaaagaggtcgcaagcactgtggggatgcatggcctatggatgattccgggccaatttcgtggataaatgggctagaggcacgttaggagtaccttgtcctatgagtgtcttaaggccacgagtaatgtagaggaaccaagtagtatatatagattgtcgaaacaagatttcggtaatacttaaagggggtggctatcaagctagaaaagtggatgggtttgaaaacaagaaattttatacaggttcaggccttcttattcaagaagtaataccctactcctgtccggggatgattccgccgagtatatattgatcgtatgatctggggaaaaagaagtgtcccgagaggaacccggacccctccttatataggggaaggggtccgtattataaaatacagtccatatcccaaacggaatatatgattacagataaaatacaatcgtaaccgactaagatcccgggtatttccttgacatacaagtttaaaaactaacccgaatcctcgtaaagatattctatctatatttggtgtcgtgtacccaactaaactataactgccatgtagatatgggatatctataatctccacagtagcccccgagacctttgcagtcgacgaaatagctttttcagaacaaaaagcaaaaatccgagtgcttcaattcctcttgctctggcctgccgagtactaaaatcaaagactgtgaagggcgaaaataaaacatggtgcatcgagtagatgcacctaattaggtataacccccgactatgtggttagttgaaaaactaaacgtgtagttaagaaccgagtggttttacaaccaaacatcatatagcaaagcacgcatggtattcagtaaaatacccagccgactgcttctcaacttgaatatatcaagaataaaaatatgaaaagggcccgagtgataaacactcaaaatgtccacaaaaagacatatttgacaagaatccgagtaagaaactcttaaaatgatctaccaaatatgataaaaatcatggtaattaagaagtttaatagcctaggctataaccctcaccataatcaaaataagcatataatatgccaagagaatgactcttaataaactagtcatctcgaatcaacccaaatagcttttgcagcctaataaagcttacaaaaatagtataacacctttctgtcgggcacctttttatttgcatcgtggtaattccaaagaattatcaaactgcgttaaaaaggattttaacagcatcgggtcacatcattgtgagcacaaattgccaaagcaaaaagcgcctaagtccatagggatcacaacgggccacgctggtaataatattgggctgaagtactgtacaggcataggcccattagcactcccgatactctaacaaaacaccgaagtccaagcgacgcttcgtcttccccgccgaaactctcgtcatttccccactccttgttacagtacaaagctgcgccgacgaagctagggttcatcaatccgccccaatccattctcaaaaatccacgaaacttctccacgcgtccaccgcaccgattccccattcccctccagcaacttttcagaccgaatctgactgttcgactcgcacccatggcggaagagagagaaagtttcgagagtcagtaggcgccctccgacgtgacggaggagaatctgaaggaaatggtggcgcacggcgttcttccggcaaaggagatcatcgggtggtggccagcgtttggcgaagcgttcccaacccccgatacacacgaggtcgtggtattttctcacttcttttatggtggattttctcttccaacttcaagattcttccgaggaattctaagcttctatggaattagcctgcatcacctgaatccaaactccatagtgcacattgccaatttcattcacgcctgcgaagcttttctgggcattaggcctcatttcgccttattccgccgaatcttcttcctcaagccccaaccgaacaagagcaaaccatgcgtggttgggggcgccagcttccaactcagaggaacactaagccaaaagtatttctccatgccctttaagacctcaaacaaaggctggcacgcaaactggttttacgttcaaaatcctaaacccgcactccccgagtactcctgtcttcctcggatttaccaggacacatggaattcattgcctatgggagatgaagctgctcaggcagtggaattgatggaacgaatgctaaagctgaaggaacagggtttgcagggagaacaaatcactcggcacttcatcaaaagtcggttagctccaatcaaagagaggtcccacacggcttttgagtttgacggcaagcatgatccaaatcgtgaagatctagactctcttgactttaaggtcatgaaggaaagaatatacaagatcttctcaaatgccattgttatcggctattcacatctgttgccagttgtgccatacaatgcattcaaccctcctccaccggtatgtactcaaacacttcagccttcctcaaaatatgatctcgtctttttgttaaatcaattgacagtggacgatattatgtctaggattttgctctgatgaagtcggatcccccaatcgctcagcgccgatcacctcgccgtcagactggtcaggggagcgggggaccaaagatccggtccgaagcccagcccaacacttctaatccagccggccagtcagattcctgtaagaggaagttagtgctaagtgacgacgaaggcgacgatgctgaaaagactagagatagagaaacaaccagaaaactcccgaagcaagccattccaaagaagaaaacatccagtcatcctatgccgaagatcaggaagtcttccaggtataaatcatataacattcttccttgtactgatgctcacttatcatgaaaacaacgctgacagtacaactcaaactcgtaggaaaccatctgatatagatccttctgggaaggactctgatccgactaacatggagacgagttcttccaaggaaaccgggccgactgctaaggatcatccgagtgacaatcagccggcaatcgacaatgtagaatccggtgatcaacccccgactggaaaccaatcggccgaagctgaagccggagttaatcaggagcccccgactggaaaccagtcggacacagggccaagccaagagattccagaagttgaagctcaggctgatagccctcgcggacatgatgccagcaacgacccgaggcctggatctcctgctaagacacaagagccgactcgtcctcgcccgggaatcatcacgggtaaacaccttgcctgaaaccgtgttaatccaaccgactttaattgatcatctgatctttatccatggatacattaggaccaatgattggtgatgaagaggaagttctccggatacgtgcggctgaagactcgcgcccttccattttggtcaagtggtgggatgatgacttgcaacctcaaggaattgtaataaaccggcaaaaagaagacgaagaggtatgcctactgaaaaaggcgctcggccaagcgattctcattgtaaacgtaagttccttgacgcctgacctcagccatcttgtttgccatctagctcgagcgctgataaaactgttttgcagaggattcaccttaggagcgaggcgaagaccacaaccctagagaaattagttcctcatcttggaacccttgaagctgtcagagatcaattgcacgaagcaaaagagcttgccaagaaaaccgagcacgatctaagggatcggatcgctgagctccaggagtctaacttcgaactaagtggttcatcaaaaggtacacaaaatccgtccgactaacttgtgctgtcatctttgtagcttcaattaaccggagttaatgtagtgcaagctgccaagatatctcaattggagaagcagattcaggctctagaaagcgacaaagcagagctggcaagacagggggactcggctttgaaggatgttgaaggtagcatcaattgatactccgaaagccattgccttctgtatgctgactcattaatatgaatctgttggtgcagaccgcaagatcaagtcgcaggctcaattcgacgtcctggttggcaaaatcaaaagacttgaaggggccagggatgaagttgctaatgttgctaccccactcgtccaagcgatgttcatcaataacaatggcccgagtacacttgatgcttccgaaatcttcgacaagctgagagttgctccggatacatatttcaagaatatcaaagaagctggaagtatgggagcgagtctggcgttagcaatgaccaagtccctttacccaaaaatcgacattgatgccattgacggctttgcagacgggacaagcgaagaagctgttctcgatcttatcaatgatgcacagaaggttgctgacaagatagcagttgatgtagtggagagatttcaggacaccgatcttcgactgactggtcttgatgactctgatgatgagaaaactgatactgattgatgtaatgtaatgacaatgattctgatgatgatgatgatgatgatggaggcacaatttgtacaatactgatgaatttatgctgtgcccaatgtttcatacttagcttctgatttcttaaaagtttttgtcaagccttattgagcctaaaacccgcaaaagctatttaaaaactttcagtcctcatggactaagccaaaaaattaagcaaggcaatgataaatcgaataagcaaattggactaataaaaatcacactccattattatgacaatagcccccgactgataacttcaagggaaagcttgatgttgtcagtcaagatagggagatacagaagcaaacttaagcataaaaacgacgaagatgttcgatattccaagagttgtcaataggtgtaccgtcttcacgcttgagtcgataggaacctggccgagtgacttcagagattataaatggcccttcccataaaggagataacttgtgctgatcccgtgtagtttgaattttcctcaaaaccaggtcgccgactaagaaagcacgcgatcggacattacgattgtgataacaacgtaacccttgcaagtatcgggctgactgaattaaggctgcttcacgggccttttccagtcggtgtaggtcatccactcggtcttccccgtagcgctcttcgcgaaaattacgaaaacgcaatgattcaaattctacttcactaggcaacattgcttctgctccataaactaggaagaatggcgactggcccgtagcccaactgggggtggtgcgcaaggaccaaagtacagatggcagttgttccacccatttgccggcataaggattcagtcggtcaaaaactcgtgcctttattccttggagtaccatgccgttggctcgctcgacttgcccattgctcataggatgcgctacggaggcataacaaatcttaatgccgaagtcttcacaaaaatctttaaatactccactggtgaattgagtaccattatcagtgatgatctgattaggtaccccaaaccgatgcacaatgttgatgaaaaaatctctagctttatctgccgtgattgtgatgaccggtttagcttcaatccacttggagaatttatcaatagccacaaagagatgtgtgtaaccgccaactgcctttttgaacgggccgaccatgtcaagcccccaaaccgcaaacggccaggacagcgggatagtttgcaactcttgggctggcaaatgagtttatctagcgaaaaattgacaaccttcacatgtccgtacgatcttgtcggcatcggacacagcggtgggccagaaaaaaccttgctagtaagccttgctgacaatggtgcgtgcagcagcatggttgccacagataccagaatgtatgtccttcagcaattgtctcccttcttctaaggatacacagcgttgcaaaattcctgatggacttttcctgtacagctcggtctcatgaataatataaagcctgctgcgcctggaaatccgctcggcttcgtctttatcttgagggagttcagaaatcgtataagaggctctctccagtcggtttcgaccatagctatgttttgagtgtccgcggcttcaactgtttctctcttgggtacggttggctcataaagatattcgacgaacacatcagaaggggccgcttcgcatttggatccaaaattcgctaatctgtcggctgcttcattattgtcccgaagaacgtgagtgagttcgagtccatcgaacttatcctgcaactttcatacctcttgtcgataagcgatcatattgtcgttgaggcaggaccactctttcattacttggttaacaactaactgtgaatctccacgaactatcagatgcctgattcccaaagagattgcgatccgtagtccgtgaaggggcgcctcgtattctgccacgttgtgagatgcaggaaaatgtatccatagcacatagctcagtctttctccagtcggggaaattaaaacaactccggccctagtgcctgaaagtctctttgacccgtcaaagtgcatagtccaatactccatcttttccttgggcgtgtcctcttggcactcggtccactcagcgacaaagtcggctaaagcttgggatttgatcgaagttcgcggtttgaacgatatatccaaggacatcagttctaaggcccattttgcgattcgcccgtttgcttcgcgattatagaggatatcactgagtggaaacgatgtaaccaccgtgaccgagtggccttgaaagtagtgggataatttcctgacggtgattagaacaccgtacaacagcttctgaacttgaggatatctcgtcttggaatcggccaacacctcactaacgaagtagatcggtcactggactttctgaacatggccttcttcttcacgctcgacaaccaggaccgcgctcacaacctgagaagtggccgatacgtatagtaatagcggctcttgtgggtgtggtgaggccaaaactggtggagtagtgagaagtttcttgaaatcttcaaaggctttctgtgcttcgggtccccactagaaattgtctgttttctttaacagtttgaagaagggcatcccccgctcgccgagtcgtgagacaaaccgactgagcaccgccatgcatccagtcagcttttgaacgtgtttctaggaacacggcggcttcatgttgaggatggcgttgactttctccgggttggcctgtatgcctctgtgagacaccataaatccaagcagcttccctgacagtactccgaaggtgcatttttttgggtttagtttcatcctgaaagcacggatgctcgcaaaggtttcttccagattcgtaatcaaatcatccttctgcttggtcttgatgactacatcatccacataggcttcaacattgtgaccaatttaagtcgagaaacatctctggatcatgcgttgataagttgctccagcgttctttagtccgaaaggcatggtgatgtagcagtaggccccgaagggcgtaatgaacgaagtcttcaagcagtcggattccttcaatcggatctgatgatatcccgagtagcaatccaaaaaactgagcagctcgcagccggcggtcgagtcgactacctggtcaatgcgagtttgagccatcgcgatctcgcgggtttgagccatctcgcaactttccttgtcacatgtgacagcttgcttgatgtcgctccgtaggaatatgactcctcgaggaccgggcatcttcatcatcatgtaggtatagtgcgggacggccatgaacttggctaacgccgggcgtccgagtatggcgtgatacgctgtcctgaaatcagcgacttcgaagcagacgttctctgtgcggaagttctcccgagtaccaaaagtgaccggaagagtgatctggccgagtggtgttgccgatagccctaggatgactccgtggaagggtgcattactcgggtttaactcggtgcgagggatctacatgtcatccagggttttggcgaataggatattgagtgcgctgccaccatcgatgagagatctgcgaagcttgacgttgcgaaccactgggtctagtaccagggggtaccgccccgggtggaccactcggtcaggatgatccgagcggtcaaacttgattgttatctccgaccaccgaagatattggggcgtatcgggctggacagcattgatctccctttcagtcagcttttgctttcttttagactcgtaagccagagggccgccaaagatgtggttgagctccttactgtgatcttgaaaacctgtcgggggatcatcatcatcatccttctttttcgacgtactttgttctccgtcaggggtcttccgtgcattcttggcatattgctctgcaaactgcttgtagacgaagcaatccttagctgcgtggttggagttgggatgatgcggacattgggagttcatgatcttgtcaaaagtgttgacgcgcgaacgttgtcgggaggagtgtgtagtagtcgcgacgagttcctcgggcttacgcttgcggtccttgtgattgttacttccaccccctcccgtagtcggcacatctttctttgacttccaagtaggacccgactgcttggatgcgataatggcgtctttggctttggcatactcgttggctttttcaaacatctgtttgactgtcttgggaggcttgcgcccgaacttgccaactaggtcttcgtggcgaattcctttggtgaaagcaacgatgatgacgtcgtcggtaatgtcggagatcttgttgcgctgttcagagaagcgtcggatgtaatctcgaagggattctccagacttctgaatgacgttgtagagatcaaactgtgtgccggggcgttcaaaggtgccctggaagttggtgatgaagtggtcacgaagttccgcccatgatccaatcgtgccacggggtaatccatggagccaggaccaggcagaatccgctagggccacaggtaagtagtttgccatggccttgctgtctcctcctgctgcgcggattgcgagaccgtagacggtaagccaagactccggattagtggtgccgtcatacttctcgattccagtcggcttgaagccggctggccaatccactcgacgtaggtcgttagtaaaggcagctactctatccacgtcgtcgtcgtagcgatctggtgaatggcggtgacctcgtgctgcacggcgctgattgattatatcgcgaatatcgacaggacgctggcgaggtggggagcgaggccgttcaactcggcactccctgtgtcgctcaggaggcgagtgaacagatcgctcgtcgtggccccagctcctgcgattggatcctgtgccggtgatgctgaggcttggctggtaataatcatgagatcggagatggggagctcgactgccagtcggcgtgcagacgcttccagagttaaccgggaccgaagcggcgatcatggtcttggtctggttcaagatgttgacgacgtgatcagcttgattgagtgcgtcttccttgaagagggtgtcgaaaagggtgatcgcagcgacagcgttctgttgaagggtgcgaaagaccgctgttccctcgacgtcttgctgcccgatgagatctcgcgctcgtcgccctgcgtccaaggcttgttgtcgttggtcctcggcctcctttgcagcccgttcgcgttcttgttgctctcgccgcagtcgttcttgctcttgtgcttggcgctcctcttctagtcggcgtcgctcggcttcctgctgtacgcgttgtgcctctgtttctcgggcttggcgttgttcttccgtctcgttgtcggccatgaagacgccaaagtagagagggatgtaattgtcttcaaagctttcgtcgaagtcgtcgaggtcacggttgtcgtagcggtagccgaattcgtcgtactccacgatctctgttggtcgtgagtcgacgccgggggagccgaagtagccttccagttgatctgtcgaaaccgtgccgagtggccggagtatgacgccgacttccctggagctaggcaaggtcggtgttgaagccgacttccgcctaggcctacggggagaagacgcccttgtagtgaagacggcagccaagtcgtcggggagtttcatcaggattggcgagtaggccccatcatcttgatctggtggtgttgaaatagatgggatctcgtccgagtggtttgaagccgactcgatcgagataagcttggagtaaatcttggtcgagttcggaacaccgaacggggctgagacctagtccttccctgactggattgaatccgagtcaaggagagagatcttgccgaagtcgttggtgatgaagtcgaggctgccgaaccgaaacgcctgcccgggagagaagacgaggtcgtcgatgccggagacggaacccatcgcactaatcggcgaagaacttgacgctacccctacctggcgcgccaactgtcaaaacaagatttcggcaatacttaaagggggtggctatcaagctagaaaagtggatgggtttgaagacaaggaattttatacaggttcaggccttcttattcaagaagtaataccctactcctgtccgaggatgattccgccgagtatatattgatcgtatgatctggggaaaaagaagtgtcccgagaggaacccggacccctctttatatagaggaaggggtccgtattacaaaatacagtccatatccctaacggaatttatgattacagataaaatacaatcgtaaccgactaagatcccgagtatttccttgacatacaagtttagaaactaacccgagtcctcataaagatattctatctatatttggtatcgtttacccaactaaactataactgccatgtagatataggatatccataatctccacatagatgggtcccacaataaatgacattagttgtggcagatcctatatgtttatagggatagttacagataagtgggtcccatgggtaaataaaatatttctagtcccacctaccgtcaccgggctcggatccagacaagtggacgaccaaccagagtggcaacaggagcagcgagcgcacggcagacttcaatttcaatatgaacatatatatatatatatatatatatatatatatatatatatatatatatatatatatatatatatatatatatatatatatatattctctaaatccagaagacagatgagattctaggattatccttttgggcaaagacttttatgcatacttcttctgggttatctataccatactgtattcacataaagatgatacacgctagctaaagatccaccgggtgtaacgtcataagcacattggaaacgtaaataattgtaaccatatacatataaaatgacagcaatggaatcccaatcctctgcttttatttgtaaagtctctgttcctcgatgatcgaagcccaaacatctatgaagcacctcatgtttgactagccaattagataaccaaccctgctgcattatcttgatatctctctctatgtgtgtgtgtctatatatatatatatatatatatattagaattctccaatgcatcatcacatttgctaaccctagtgatgaaaccacatgcaagaatttagtagtatgattttaagagtgaagatttgtctagttctccgcacgtacattttttgataatgctaaacgatgcgtcttttgaaaaaacaattataaaaaagtttttttaaaatccatattaatttatttttcaaatttaatataattaatacttaattaatcatgagctaatagttcatttcattttgcgtatcttctcaatattatgtttttctcaaacacgggaatatgtacgcaagctttacaaaattttcccgtgcagtacacaccaactagcaaatatcacgaaaaaatcaataaaaaaaactgcatatgtgctcttaatagtattgcacatatattcaaagtctcatattcaaattcatcatattttagccgtaacaaaaattaaaaaaaaagttacggcttaatttgaagataaaatttcacacatatgcataatactataggaaataggtgtttgatattttatataattttccgtaagattcactagtcggtgtgcatacgttctcccgaaacacccccatatatacgataactagtggaaatgtagaaaattacacagccaagaaaaagaaaagaacagtagaatttcagaattatttcacacacatggacagattaagatactctgcagtaactgcaccgtgcctttatcactgatatatgttaaccttcggatttatgtgtactcgactggatctgatcccacgtgggccacgagaaaatggacatttagccactttcaaaatatggtttcgctagaatgccattctgaaaacgcgtttcactaaaatgccaatatgaaacgcgcactcactgccatgcattttcgaaatcattttctctcctccaccagatgatgagacgaaattacccttcctggtgagcgtggtgagcaggggacaaaacgccatggcctcgccggcatattgagtggcggcggcggcggcagctattgtcttctcccaactcggtcgccccatctcactctccaacctactgctgaccacatcgagagaacaagcatgggctgcctctttggtctcaatcccatcgccggcggagatgaagacgatgatcatattcatcaccaagccacggtcgtccttgtcccttttgcgttccatactcaactcatcttgccgaacaaactttcttttgacgccatcgcgtttgatccattgtagcaacgggaacaccgccgcgccatcgtcgtcctggagcgcgctccggagcaccgccgcttcggcatcgtcgacgtccggccatcctcatccatcccggagcaagccaccgcgccatcaactcctccttgaggtcctcttcaaaacccctcaagaaccgagaagaatggagcatcgaggagggagattgacatcgtcttctccaacttcggccgccggcgtcaatcttcgattccctccgctccggtgacctcctcgtcgattctttgcgcatgcaccatccctgggacctaaccaacctcatggatgcacatgcatggcttcacatcgaattgaatgagttggcgtcgtctcgccggagctcagagccgccgctgagacgttttattcatcgctgccatcaaccaagcctcatggcctttgctcggcctcgccctgtcccacaccgtcgtcgccaactcgttccgccgcatccccgacaggtcgacgccctcgtcagcaacgatgacgaccacctcgccgcgctcgaccatctccgccggcagcacaaaacgaaggagagaaagaaagagaagagatggacctgccattggccccaagggcatttccgtctaatcaccacaaagaagaggcaaaatgatttcggaattaagagaaaatgagaaaatggcaatccagcgagttgcgccgccttgatattggtgtattctagcgaaaccgtgttttgaagatggctaaatgtccattttctcgtgggccaccgggctgtgcgaactcgctacgtggaatacttgggcccttcccttcctttccccaatccgcctcatccgataataccccccacccctctctcgtttcggcggcggcggcgcgcggccggagcccgagctgagaccaccaccacggcaccaccacgaacacgacgatgatggccgcggcagcgagaatggcgttcgcctcatgcggccgcctcctcgccccctcctcgtcgtcatccctccccgccctgccaagaacccggggcagcgtcgccgccagcggcaagcatcccgtctcgttcttggcggcggcgagatccgcctccgtcctctgctactgctccgacgccaccgtcgcgccggccccgcaggcggcggccgcggagggggaaggggaggagggggagaagaaggcggaggttccccccgtggaggaggtggcggcgctgctggacatccgggtggggcgggtggtgaaggcgtggcggcacccggaggcggacacgctgtacgtggaggaggtcgacgtcggcgaggagcagccgcgcaccatctgcagcggcctcgtcaactacctccccatcgaccagctccaggtctaaccatacacacaatccatccaagatttcttatcatttcaattcaacattagagataattcaatgtaagagtaagcactcaccgcggcgtatttatgcttttgcatagcatatggatcacaaaaatgtctcatttcaatccatccaagatttctcatttcaatttagcattacagaaaattatttgagagaaaacactcactgtggcgtaattaagaagctttatttagactcggttaattacatcgagatgatcaatcgaactgagtcaaccccggcctctgcataaaatgcacacaaccaaaaaagaaagaaacaactagaaacatctcccaagcacaaaagtttgacaaaaacatatatccaaaagcttacgcactacatggatcgcaaaatttcttcattacaatccatccaagatttctcgtttcagttcagcattacagaaattctttgagagtaaacactcagctgcggcgtaattatgttttcacatttacatggataaaaagaaacctctcatttcaatccatccaaaatttctcatttcaattcagcattacagaaaattcatgtaagagcaaaattatgttttagcttggcatggatcgcatgattgtgcatttcagaacagcaatatgtgccttccaagtgtcgtatatcggtatatggaccaagatgtatgctggagggtatgcatcagagagcggagcaagataatcggttataatcatttttaatttatcaggaaatgcatggattggattaacctggcccaaaatcccgatgctttactctgcaaagttagcactctattttggtcaagattcaattcgcaccaaatctggctgcgcatgtacagccctagtgttaacagagttcgggaacgaaaactatgctagtcaaataatgtgtaggtccttttggttatttcttttcgtactactgatgacaactgctattgtttgtgacacatgcaggacagcaatgtgattgttcttgcgaacctcaaaccgaggaacatgcgggggataaagtcaaacggcatgcttatggctgcatctgatgcttctcatgaaaatgtcgaattgcttacccctcctgaaggatctgttccaggtgaaagggtatggtttggtactgaagatggaaaggatcgccaatcagaagctgcttcaccaaatcaggtaacactttgggtagtttaaacttagattaacacattgttgttttaacaattgcatttcttatgaaattcaagaaaattgatatagtttaatgtagaatttaagaaaaatattttagttaacagacctcacctgtatatgtattgataaactatgctacagttttatactatacacatcccaaactaaagtatttttcagcatcgcagttaattggattgttgtgttcttttaggttcaaaaaaagaagatttgggaatcagttcagcctcatcttaggacatcagaaaactgcacagcatttcttggcgagcacccgatgcgtacctcagcgggtgtggttttctgcaaaactttgcagggtgcaagagtgtcataagtctctttcaagaagctttttttttttcttctttggtatccatattgtgtaccttactgaaaataatcatatggtatgagtaaaaatcttagagcaagatggtttctgaggctttatggaggtcgttcacaattttgtagctttctgatgtcaaagctggaacattttacttcaattggagattgatttataatttgatcatgagaattcgaaatgtgattaactttgtaaggaagttatgtggtactttgataaggtgatttctgctcttaaggatccatgtgcactgctgccaaattactctaaacaaacagtaaacacaacccattagccactatatagtggatattaaccactatatagtggatattccggtcgcctttcggtctgttttcctcagcaagttctatgatgtatgcaaatgttgtgatttctaaacatttttttgagcatatctcgatgtcatagagatcaaggtttcccttaccgtttttggcgcggttaccgcacccccacggtaaggtggttaccacggtccactaaaaccgagcggtagccgcgagacataccgtggttttaaaaactgaaaaggttaccgtgcatggtaaccgtggtaactgtgcggttttgtaaaccctgatagagattaccataagccgaaacgattttagcgccttaagtgtccatataaactggttgacagttgcttcacatgtattcatcataaattttgaggaacaatgagatcggaaactcatgaactgactagtttctcttacaaatgcagtaaatcttggattacccatcgatctaatgccatatggtaaattgaagatgcacatatatactacatcaacatagctgctactttgatttccgtgatttgaatatgttttccttgtagtattgtagctccttaatgctttctctaatgtcatccatcgccctgtggttcttctccttccttggagcatgtttcctttctgcggacagtaaacaaaacaaagcaaggttatgttttgtggagattctgtaactttttggtctgtaaataaaggaaattaaaactgctatggagaaaataagttgatttcaatcaacttcgactttttaaaacagctacctacgatgtatatggattgatatacatcgacgatatttttttcctcaattacaacgtgattctctttttcaattccacaataatgtgtgggaattcagttgttaaagaataagtcagccagcagcttggtcaagtgcagaatttgttaattcacggaggaaaatcacatcgcacacacccaaaagtgtagcaatcagatattaaactgttgaagcagaggactacaagcacagcacaagactgaaagcaagaattaacattacatttataaataccggagtaattttacctttggggaaccatcgggagcacaaagccgatatactgcttacatcaactatcacatgagagaaaatggctgccagatgtggcatgtacttctataaaacaaaacaacacagaaaattgtcattcaaaaagtgtttcaaaacaaaattcataatgctaactatcctatgctagctcataaggatattggaatacttttcacaacattctttgaggttacataatttatttatataatgctgaaggtgaaatcatttggctactatagtgatgtcagttggacagaggtgacctttgcttgctagatacaaattcaatattacctaaactgaacattttcaacacgataataaaaaaagttatgtaaatatacaaaatctcagatgcaattactgatagaagggacattgaatattgtatcagaatacaatttttcatataccaaaagaagataacaaagttgcatatggaaggcggcttaaggaaagtccgtaagttttatttgagcaatatatgctctatgcacaaataacactgcagtgcaattggtatgcagataaggtaaagtctgcaaagtgttgcattaacttgagttctgcaatattaaaaaaaaaacgctttccaacttaacagcacagataatattttctgatctcattctttaccaataaatctaggataaactaaatcgaaatcgcacactggcctgcctcactccagatttaaccagttcaataaggccaaataaggacataataaaatccaacgtaaaggcatttcaaaattacagcctggccatttgcctaaccatttcacttttaactgaggttaagtgtatgctttctcttactaaccttcaaaaatagtaaatccatatagacagaattcccagctatcagtggagtggctgagcctatatacttcctaataaaatctagcacctgaaaataattgacaaaaggaaaccttcattaggaaattttacattggaaagagaaacattcagaatatgaaaacatgcattgaacatttgtcagaaatgtacaattgaccaaaaaatagaaatagaaagaacgcttgtatgcaacagtaacaacacagacagagacacacacatgcacaaaggtagttctacacacacaacttggtaaagtttccatagaaactgcaatcgaggagaaaaaaaaggtaaacataaatggcaaatggtgcagtaatataatgtattattgtttgcaagcaacaaaatcacaacagatatcataaatatcgttcatcttacatatgttggcaaaatacattaactatcaaaagactgaaagagacctagtttacacatagagcagcacaacaatagaacatgatttcactaaagctatactacttaaaatgttagtagtggtggtgtccatttccacaccaccgctatcactaacatctgggccccacaatctatactgttataccacttttcaacaagtctactattggctccccccaaatttcaaaatcacctacttgttcaataagaaaaatcatggtattacttatactaaataagtgcttattaattgatttaataagctagaaattcaatttgttttccattgcaacgcacaggctaggctagtatatcaagatgattgtacactgtagtcacatgtacactgcacgtatacagtatcctcatttgcaaaactcatgattgtagttgctgtctagcaacacaacaaagttccacctagtcatctactcatcttgaaccgcgatatgtggtggataacgccattgaacactggtaaaggagttcgatacaatacattggccagtaggcgcctctttctatcggacaaaattctgcttaactataagggcaccttcagagattcagatgtactaaaagagaagagcatacttgtttctcagcatcattctcagaaatgtcgctctgcagcaccttttccttcagccctgaattggtttcatgagtaacagatttttgctcacaagtatatcattttgaggaagataagctgtttaccgctagcgctgtgatgaactttgcaccattcattcatgtcatttacacattccttgctctgtcttataaccaagtcaggaccctgcaaagaagtgactagctatgtttagcaatatctctggatttgagataccatcactacccaataaggtaatcagattgcctatgccagttgtgatcaaattgcagtattgatcaactgatatagattagaaacttgatatacaaagttaaatttgccaaacaacatggttatccaggatcataatgggattaatagaattggaaaaataagacatagactaaaccccaacttatcggaatcttatggcatatctccttgcatctttcctataccctaatattcgtaacataacaacatcttgattcagaatatatttgtttctattcttagatttacattgagacatatcgagctaattagtactaaaaacaaaataactcaacattccgatagtcctgatggatttgtagccttatttagcagtttttaacatctttatagaccatgagcttggatagaccagtttcagtatatgctactacgagcaatcattgcatagtgattaagagtcacatattgcacagccatataaaaataaactgttaaggagcatcgtaaataccaatgaaacatattattataagaaactgttcacttcctaaattcaaaagtcaatggtgcactacaagttaggtatttctgagcaaagaaaactattaatatagagcaatcagaattgcagaaacacttagtttcaatagacacctctattcgtttggtaagtttaccgtctgttataatacaagcaatctccagtatgcgatctttggtgatatccaaacctaaacaattaaaaaccagcaggctcccaattagtacactgtatagttttggtttaacgcatctacaaatttaacatagaagagaacaataacaaaaatgagagtgaaatcaagaaaccacagttcagaatggaagactgaaataacatgggaaaagttcctttttaacaaattaggaatatcaagtgaatcagtaatgacctgtatattgtttagcaacagtacaaagcatacaacccaccattatgtgtgcatgacaccagaattcagatcaactttagaaatgtagtagtatgtatctttacaaagagtgaaaaaatttatcagttgtaaatcatggccataatttattgatagagatatagcatgataaatatttcattgcaaactcaaacgcttaataaccaatttgatcaatattgtgtagaaaactggagataacacagttaaggctttatatataaataatggaaatatagctctcatggttgaggaataagttttattaagcatatttaaaaaaatctaatgaactcaaaagaaacatacagcttatgaaaagaagactaaccagtcatttccaagtctatccacactaatggcttatcataatcacttgatgatgaagcaaggttttctccatcgtggtttacaatcattgtgtgattcagcctgattttatctgcaaagtaaaagtaattttaaatctcatcctgaggagacagcaattaaggattggtgctatgcctacaagacaaaacaactaaaataaaatatttattcgtcactgcagaaatcaagttagcatgttaatgcataggtcattgatctattgttagaggatagatttttatggactttcgtgattctatcactgacctaggagattagatcaagtcccctaacaatacattattgctttctgatacagtgtaatttggacttctataacaaaaaatgcattggaagaattgactttagttttcaataagccacccactatacattgaataagactgcatgactatttagaaagcttcacaaaccggtgaatggaataaaagcctctgattttatgctttgacaaacaatatttcaggatttaggactattgatctatgagatcagacattcatgtttcaatttttttttcaatccaatctaaaactggcaacataatatcatatttggttatgatgaatcgatatcatgagaaccagtagattatttcactatgaaacatcatggttgacagcagcgcatcacttcattgacccagcaccgaaatacaccgccaccaccacgggatcaacatttagcagcacatcacttcattgacccagcaccgaaatacaccgccaccacgacaggatcaacattggtacaaacagagagcatcaattcaattcaacaatgcaaaggatggaacagcaatagagcgctcttcttaccaatctccgtgctgctagtaacagcagcagcttcggccttgctggatgttggtggttccgcaccttcctctctatcgtcctcagcatccagattaagaacagagaacatattcgcgagtttgctcatcttttcccccaagaaaagagtgacggagctgtaacctggagcatgcggggggtacagttgaaaccccccagatttgggggggaaaggaactgctattagtattagggtttaagagagagacagaagaagccttagcttccatccagatctagtagaagagaaagataaggttagggcgaattggaaagaaagggtggtcactcaccggaggcggaagcgggatggatggaaatcgggcagcgcaggagagcggagtcgagggcgagaagacgcggcggcggaagcagcaggacgacggcggcgccgctgctcttcgcagtcggcacggcagcaggtgtgacggagtcgagatcgatcgactcgtcgtcacggctcacgaaggcccgcgaacgtgagggcccattaagctcacattgtcctagctcaagcaaaagtttttatattttttttaaaaaaaaatacgaaaatgctcactgccgggctacccctgcgcgcccctccccacgtgcgtacctattcggcccacccacttctctctcctctttttccacaaaagatatttcacctagtgtattttcaatgtttcactatttatagatttataatgttacagtgaattaaaatactcttttgcaaaaaaaaccacatattttagaaactctctattaacggaatttgatttgtttttttcaaaaaaaatgtttcatctagtgtacttacaatgtttcactatgtatagatctaatgttgcagtaaacgaaacattccattgaaaaaaaaacccacatattttggaaaccccctattaagggaatttggtttattttttttgttccaccgaaaaatgtttcacctagtatactcataatgtttcactatgtatagatctaatgttgcagtgaaccgaaacattcttttgctatttgctgaaatattgtttttatataaggtgaaacaacacccgatttaaacgagtgaaacattttcgatctagtgaaacaattccgatatacctggtagaacatcgtgtaacatttaaaaataattcaataataagctttttttttgtcagaatatatccatgtgtggtcttgttttgaagatttaattgcaacgaattaatgatgcaaccggatcatgatttggataagtaatttaaaagaaaaattggtttaaaatagttttgcacgtaaatcgggctgacgtcagcgcccgatttccctcgctccccgtcggacgaccgacgcgtagtcgcgtatgttcttttaaagtagggcggaacacataaatcctcttaggattttgttttgtggcagacgatgagagggttacaccatgacaatttcacaggcagccccttctcattctcctctaagacgatttatcataagaagataactacctaccatctgcaaaatacgggtggggtgttgcctgcaaaataaccatttcccgatccagaggaaggcgatttatatggcccggctatgaaaagccttccctccctttgtaaatcattattgtattcctcagaaatctagaaaataaaaaagaaagaggaggtaaggggggataagaaggaagcggcggtactcaatagaagataaatacttttagccattgacttttcaacacattggtactagtaatgacattattattgcaagttactcccttcatcctagaggcctagaggggagaggggaaagaagaagagtgggcaatttagtcataaaaacttgaaaaatttagtgaaggagtaaatagtagtatatggcctggaaatttatgatggtatggttccaattaaccctttaattacatattcacaaccactttttttctccatttacctattgtccatccctaaaaattcttagtagtacggactactcactgcataaaaaagaaaccattctgtttcatttacttcaccagattattcaaatatttgctacaccctattaaatttaggttttctcaaaaaagttttggtttcagctattggttaagtttatttcttaggatatttaatatatcgtgtattaagtagataatttgtaagaataatctagtcgataatctaaattatacagggccagttaagcggagattaagtttcaagaggaaagaatatgctaccctttttgtaaatgacgtgtggttgaaagtataatatcaagaaatttgaataagaagtgacctttgaataagatgaatggttacatgttataatgttataccaaaaatcaatgacattatttattaaaaaacagttgtaatattttgtttcattcgaccgaagaagataattaattcgtactccccgtactcattaaggaaatcgttttagacagtaacacggtctccaaaacacaactttgacttcttgtttctataaaaaatatttattgaaaagtgatatatttctataaaaatatttattgaaaagtgatatatgtatatttttatgaaagtatttttcaagacaaaactattcatgtaatttttatattttcaaattattaatgatttatatatctaaggtttaacttaaacattgtcctaaacgacttcttttatgagtacggagggagtatactcattgaaagggcaacatcagttctgaattccgtactctttgtgcttcagaaatactgcagtttaagaactctattctacctctgtaacgagggcaaaactaaagcaatttgatgacttctgtccagctaaaatgttttttacatgccgtagtcaaaaactagttagtacagtataaatttagtatgttgcatctcaaacttttggtatcagtctctctcagggaggcaaaatgcctgtaaatttttcttggactcttcccttcaatttcactacctttgggcaaaccttcccaggacgataaaataggacagagcaatgcagcatctcaaaattcccggataagcttatgcatggttacagactgaaggtgaacatgacttgtccaaaccaaaccagtaagcttctttgtgcataaaattatctgcataaacatttgatatatcaaaaccatcatattaagagcattcaatccagtaaatagacatactgcagaacacaggacatctagcaacatcatacacatgttgaatggtcccaaacgtaggtgcagtgaattcatgtgtattacctgttgctccaaaagatccaacacagatggccatctttttccatgcttttcatgtcagctcccttatgtccttcagcaggtaggctattcctcacgctgcctgccttccagtgtagcataatcaagcatcaccagacctacataatgcacaccatcataacacaaagcaatcagtgtaacacgattttttttcacggtgaacataattcacaaagcaatcagtgtaacacgattttttcatggtgaacattattaagaaccgttgacagcaaagcacattattttacaaacagtttgccaggactgattcacagaaatagcaaaagttcaaatcacttgacaatcatcatcaacccagggcagacaaaggcaaagctgattaaatggagcacaaggtggaaaatagaatgcctggaaaaatgtaatgaatgcacccacatcaccccagtacagtctcctaaacataacataagatcaatgcaaagttaaacaaaacatcattcaggatctggttcatgttcagaagaaacaatgaaaggtcaagtgtttctttctgctgtttgaggccttcttttaaagcaaaacgaaaaggtaaaaatctataaaaggaagaaacaagcagcctttggcatgtatttcaaggaaaatggtatatcatgtatttcaagtcacgatagtatttaaaaataaatggaaaataaaaacttgtggtaacttatgtcagaaaactctatagtttacaatattcagagttgttggtctaagtgtcaaatgtaaaagtgaaacatggaaacttcacattttgatacagatctgatcaactccatgtcctccgatagacaaaaatgagcagtgactgtgttgcgtaagtacatactgcagatagtgcaaaccacatcacacatatatggtattcttttaagaggaaaatatggtaatttgacacgctcacgtatttgaggaacttacacttgaaaaatctctactactttaaaattccgtagtggtggcggtgactccaaccctggaagacacgcggaacatgagctgttggatcgccatatccaacgctcccagttatcagttatccccatgtgcttgtgcttcccccctccgcccgcaacccaaacccacgtcgctctcccgatccaaccgcctccgtccaaccgccgccgccgccgccgctccatcccctcgtcgcgcctcgccgtcgcaccacgatgcgccgccgccgctccatcccctcccgctccatcgcgccgcaacgccagattcatcgccgctcccctccctctcgaccgtttctctcggcgccatctccgcacatccccgccagcgccggatctcccttctcgccctgtttccttgctgaagcattgtcgtgatattcagtttgatctgctcgtcatatcgctgccgcacaactcgccgaataccaaggctcgtaaacaagcgccgccgctgccgccaaatccaccgaaaccaatctacgcggccaccacacgatggatgcatcaccgtcaattccgccctcgccgactccgccacagccgcctactccaccgccactacagttgtcaacgactccgccgccgccactcccgtcgtcgccggctccgcgaccgccgtccgtgctgccaccgcccttgccgtcatcttcggcgccaagcattgtcagcacagatatcgatccggtaagttaagcacctagcttaattagtccatgaaaactatcgatatatatgtgtgcgctgtattgcgatttgggttacttagctaggtaatgttaatgcatggtactgtagattaatgcaaggcactgtacgttaattaattattaattgaagcacctagctagccatccactattatattataaaattattacttataatatatcaattgcattaatatatactcctacactagcttgtgcgcagttctcaggcttgcttctttacttatatgaggaactcatctctcgcactcgcaaaactgagggactcattaacgcatgattaattaaatattactccctccttcccaaattgataatcatgtaatagaatccaaaatttctcaaattgatcatcatattactgcatggacacagatttcatctaaatacaattaatgcagtatgagagaatgtgtgcatgctatgatgtaattggcatagggttttaatcgatgcatgcattgtgggagaatacgtgcatggtgtcttgattgatgtgatttaaattgtccttggtcttggtacataaacttatatgatgatcaatttgggaaggagggagtagtttttaattagaacaaatagatttttatggttttatacaataactctaacaacataactcagcataaaatcaacctggccatcagctcattttacgaatatacaatactctgtgtggcatgattcaccaagaaaaaaaataattgatagctatgatcgagcaaaataaagcattgtaccaactaatgctacactaatattgacctccctgccgacgtgcttttttccagtgttatatataatctccatgtgcaatatagatatccttgcttaatctcatgtggtactcaggtcaatcaagacgccattcgtgctgatatgattacaacctgaccctcgaataaagcaaaaaattcggaatccgaggagcatggaaattttcagtttgaaataagtagcacagcctgaaatttctttaactgggaagaccatttgtacaggtttggtttcaatcgaagctacaggtttaatttggaagatcatgcagccatgatgctacaaatattaatcttgatggtttaaattaacctatttcatctatacaacttgattcagcttaatttagttcctacattagtgcacagttattcttcatttatttgtgcgtacaggatctatggaagagggccattaggtactaagagacctattgtgccattatattcatgaattttttggctgtttgtaacctgtgaaaacttataaggatgtgatgaaattattgttcgtgccataataaggttttcatcataataaatttaattattcaacatcattttactgtgattttaaattggtgtatattttttacccgttgcaacgcacgggcacctacctagtaaggaataaaaacaacatggaataggggagctgaacaattacttcatcagatatttattgttgtggcatgattaattgtgaaatgcactatttgaatgagaaatccccatccatatacatcaggaagctaaacatcattgaaagactatgaccgtggatatactataaaaattaaacagaggtctatttgtcaaaattgaatgacaattccaaagaggaaattatatcattgactatcagaataatatgacatggctaactacatatttgtagtttccaaggcctcatgctactcacaatatttagcgtgcactactgtcacaaatgtaacaaaaaacaattgaataggcactatcaggccaattaaaatatgccaatatgtggctatagaatgatatattactgtatgaaactatgaatagcaataagacagactcacctagaggattcacccaataaatttgtaggttcaaatcttccatcttgtgtgaataatccatgtgccttttggtttgttgaatgtccaaatgcattagtgtcatcaatactgcgtagttttgcttccagaaggttgagagatgagtctagtttcactattttcctagaaatggatagtctattagtccatagtttcatcagataggtacaagatgtaattcagagaagtatttatgctgacctacttttagtaataagcaagcaaaagcttagtcaagcattagattttctacagcaatgggaaagccattaacttctctcaaaaacagcatgattcatcttttatattccctccgtactcgtaaaggaagtcgtttaggacaatgtttaagtcaaaccttgggaatataaatcatgaataactctcaagttgttgagtttgaaaatgtaaaaattatatgaatagatttgtcttgaaaatactttcataaaagtatacatatatcacttttcaataaatatttttatagaaacaagaagtcaaagttgtgttttggagaccgtgtcgctgtccaaaacgacttcctttatgagtacggagggagtatatgctaaatctgtgctaattgccaaatcgccaacaatagcttctcatatccttctctcattgatttgcaaaaagaaagacagaagtacaaatttcaaagtaatcaatacaaaaaataacaacttctacaacacaattttctctagtgtcgtacaccaattcataagtttagaggcataggttgtgaaagcacgttcctcgcacttagcaaacaatgacaagagatatccttaatgctcagcatgaattgacttgtaaaaaatcttaaagaagatttatgcaatccagttaagcatgtcattctccaatacaacacttattccacaaacacgaggaaatcctgaacaggctattatcaaattttactccaatagagaactaaatggattcataagaaattaatagtgcaaaaatgtgcaagcctcctacaaaggtattttccaattcacacttttttgtgatggtactagccctcctagaaaaaaatagataggtaccatcacaaaaaagtgcaagttgaaaaatactattgtacttttttgcgatgctaccaagtaaaaatgcccttctgaaaaatacaaggattgaacgttgtatcccttttagagtcttgcaggtcaataattttgtaaaaaccaactcgttcccataattccggtgagttgtgagttccacacgatattgcatcaaaatagcttaaacattttccaagatactattcagaaacaacacatgattccggtaagaaataatttcccataatgctatgagattgtgatcctgaatcattgaactctagaggcaatgtccgcttccctgtattgtacacatatactgacttcttttcatgtgccgacgtatataattaccctgggtaattaactatttgccactcttacgagtggtgataaaggatttaccactagacccacatgtcatagatatatgagggtccacatgtcatagacaacgagtagcaaatccttaattagcacatcttaaaagtggtaaaaagttaaatgtccctagttacccatatcttagcacaactgtaacacacaagcagctatagcgatatctaggaatacacaaaagatttgggattttttattttttattttacctgtggaggagggaaagcttgtcattgcattgcgccgcgaacgagttgaggaactccaccgtgttcgctatgaacatgttcacctgcaatgcggagagagagacacacacacacacgcagtcagagacgccaaaagaccaaaatcgtttgctcaccccgaaggtggagcaccaccagatgagatcgaccgtggagatcggagagggggtgagggggcgagtgaaggcggggcggaccaggtagatggtcctctggtcggagacggcgatggccctcgcgctctcctcctcctcctcctcctcctcgaacccctcgtccctcggcgccggtgcggagggaggatgcggcggcggcgagcgcatggggctcctcgccgcggccgacttcaggtggcgcagcatggcggcttccggatcgagccgagccttggaagctggaacttcaccttgcgcggcagacaaaaatcaagaacacggcggcggcggcggcggcggcgtagaatcgccgacgagcgagcagagcaaatctcgtactgtgtccgtgtgggatctaacctaagagcccgttacgaactgccaaaaaggcccatcatggcccatgggccgatggtcaccttgctttaggctgtgtttagatcaggggtgaaaaattttggcacgttaaatcggatatacggacacatatttaaagtattaaacgtagtctaataacaaaacaaattacagaatccgtcagtaaaccgcgagatgaatttattaagcctaattaatccgtcattagtaaatgtttactgtagcatcacattgtcaaatcattgagcaattaggcttaaaagatttgtctcgcatattagtcgcaatatatgtaattagttattttttagcatatatttaatatagatattcaaatgttcgatgtgacgggtgaaaaatttttgggtgggatctaaacaaggccttactcattttctgcagagtaatcgatgcatggggtcccatagatatgatgatccatcatggcatcatttcctctcatgggagatgagaggacctccacctctaactttttaggtctgttttcgaatgccgaaatccaaaccgctggacagaaggaaaaggggttgttatactatgggattttgttgaatgataatggtacatataaggtattaggtgatacttgacgggaacagatgaaacaacatatatatcgaccgatatctgttggtatcaagtctcgcaccatctagtatcaaatctgatataagatcgattcttaaatatcacgcagtactatacctctacttctctctttctccacttcaattcaccaccaaacaattcatccccaaatttatccccttccccctcctcctctaagaaagtgaagaacaagaaataaagagaaaaatagtttgtggttagatctatgaacctgtggatgaaagataacacctccatgccttcaccgacctcgtagacttacttccatgttgtcactgctgcaagtggtgctgaccagcagtaacgcctcctctccctcatcgttggcatcgaggcagcactgaatgaggttgtggaggccacaagtagtgccgactgccgaccaacagtaacgcctcctttcccttatcgtcggcattgaggcggcgccgaacgaggtttgtggaggccgtaagtggtgccaactagtagtaacgcctcctcttcctcatcgtcaatgtcgaggtagtgccgaacgaggccgtggaggaaagggaagggaaaagggcgaggttgtggagtaaggggaagggagggagcacacaacggcagcggcgccacccactcttcatctcacctccttcctcaaaccatgtgagtttctctttttacgaaagaatggtatcatgcggggtgtggggtaagcattcccattccgagctaggtggatagcattttcgttattgtttggatgcttagtagaagaggacttttagatataggatttcaggagagagatagaaaccagaaaagtttcccataaggtataggcctcttttggatagaaggattttaactttaaatgccatatggattttgtttcatatgtctcattccaaatgaaaataagaatgagctcatagctcatgttttgtttttctttgagaagtcccatgcactcttttcctttctctctcttacccaaacaaacttctttcaagattccatgttgacactagttatagtagtcttgtgtgtttggcatccaatttgacaagagcatgatattcatcaattcttaggttccaaaagaagccctcaacctcatcttaattaaatatccttccaaaatatcatgaattaattcattccaaagtaatattataggaattacaaatgcccattcctttgttgtaaaagagcacctagaaaacttttctatgggatttcaatccttcaaaagctatttttcttttgttccaaaggaacccttagactaaggccctgtttgtttcagcttaagattactgtaatctagattattaaaccagattactctaagctggattataataagttgacatagaataagctgcgagctgtttgtttctctatattattggaggcatctaaggatagtgggtctttagccacccaataatctgaaaaaagctcctccagaggagattattagattatagtaatctagcttatagatcataataatctacttgtttgtttcagcttactcataataatccagattataataatagtaagctgaatcaaacagggcctaagttcgtatatacctttaggagttagctactccctctttttcttagcatacattttttgaactgctaaatgatgaacttttggcaaaaatcttcgatatagaagtttatttaaaaatcaaatattttttaagtttataatagctgacacttaattaatcatgcattaatgacccatctcaatttgcgtgccgctaaaaagatgagctggaacccacgttagtaaagattgatacctatgctctacactaaaagttgggtctactaaggcttaggccagtcccaacccaaaacactagatataattttcataaactccacatcatcaagaaattagtactagacaccactctttcaattcaaacaccacttttccatatttaaatttaatgttacttatctcacatgatgtcttgaatgttgtgtagaaaccatgtctcatgcaagacctggtttccttctttttctcatttattcacttgctacatcattttttttaatcctaggtggcaacttatttaatgctatggacactgtcggtgatatgggaccgggagtatcatgaccagaggcttgaggcagacacaatcgcccacgtagcctggcaccttcggggacgtcgggcccgagggtgaggtgtccgccctcctcctgatttcccccgaggggggggggggtcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaagatgttgtgtgaagaagggcaaacatgcacgttgccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaaaccctaagcaaggggaggcgcttgagagggtcgacaaatccgcggcgtcaccagccgcaggtgatgcaggggaacagcgagatggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccacccccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagttcctccaggtctatacgaccgggattgaggccgctgggggtgacgacagggtcatggcgaacttctttcccatggccctaaaaggacaggcgcggggttggctaatgaacctgccacccgcgtcggtccactcttgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagcggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgttgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccctctgcccccaccgccccgaggcagcggatggccacttgcgacgaggtcccggtcaaggaggttgccttgggcgacggcccatccaggaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggtgcaaggccggtccggcagaaagtgcggcggcaagccccggaacgtcaagccttcatccgcgaggaggtggctagacttttggaggccgggttcattcgtgaggtcatccacccggagtggctagcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcctttcgggttaaaaaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaaaattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaggccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgtgccccgaggggccacttggacgaagaacgccccgggggtacggcccctagcgaggaggatcggccccgccgaaaggtgcaacggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctcacagctgcctcaaaccgcccactgggtgatgcagttcgacggttctctgtcacttcagggcgccggtgcaggggtcacgttgatctctccgaacggagacgtcctcagatatttggtccgtctcgacttccgagcgactaacaatatggcagagtacgagggactccttgccggactcagagtggcggctggactggggatccgccgcctcttggtattaggcgactcccagctagtcgttaaccaggtctgcaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatatgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggctaaccccgcaccccccctcgggtgtgcagggttagccgggggctaccacacatgcacatatattcctttcagcatttcaataaaagcagtttcaatttcctaaaggttgtgtctgtgccgttttttccttttgaagaatcttgacttgaaatagggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgtgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaaaaaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggttctctcggcgcggacgctttcaaggttgcggcgcgcctgctcctcttgcgccgcctcacggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccatcaagcccctctccacggcgccggcatgttcttccagcgccatggcacgggcctcaagggcctcctcgcgccgccgggacgccgcttcggcttccgttgcccgccgctctcgggcggcagcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctaaatccgtctagtaccgcggtgtttgcggcggccaaggcctgcataatgggctcggcgctcaccggggcgacagaagaggaggagaaaagccgccttggagaaaaagcgacgcggcttggccccccggaggatacgctgagctcggggatgtcccccgggcccgtttggtcctgggcgtcgcccggtgaggtaggcccaggcgacgcgcccgcggcctcatcgcgagccgcctcggaggatgtcgcctgagggccgcccgagggactgggcccgagtgacgcgccagcagcagctgccgcctcagcttggcgagcccgggcggcctcctcccaggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcctcggcctcgaactggccggacttggggtggcgggaggaatgcgacgggacgtctctgaagcagaagaaaaagccagaagacgaacaaagtgagcaagaaaaaacttctttttggagaaagatggttgcaatgagagtaagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccggccactggtacgcaccgccccgccccctcgggggggagatgggggaggtgttcctcccagcttcctcttccccggggcgtcggcagggcggctgctccccgagcccccgacgcggggcccagaagcacgaccccctcccggggcagattgtttcccccggcggcgctcgcccgcgccgtcgttgcccttaggggctctctcctctgaggccccgacccccagcataatggatagaatggagacgcggtcgggatcgatgcagagggggaggatctcctgaggaaggtgagacgcctccgcggagctaaggttcagcaccctttggaccacgatcttgaagtcctcgggagcccaatcccatctggctccctggtgggtccgcatgaagtcttcaggcccagtgtactcccaggcgctccgagcgcgccgttggagcggcgcaatccggcgacggaggtaatcgccgtacaccatggccccggtgagcccctgggatcgcaggcccgccaggcggtcgaggacggcgtcgtactcctcccccagatctaccggcgcccgccagttagagacctgcgccgggggctggcttggaaggcggaggcgcgcttcgtcggcgaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccagtgtcatcaccgcattgggggtgaggtgcgccatctggagattgtagaactccagaacatccatgaaaaaatgagaaaatggcgggaccagcccagccatcgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtggtgtggcagtctcgaatagaccgcccattatggacaaccaaagttaccaataccaatgtgcatggattgagaccgttgggtattttgcccaactacggaaaccggtcccacctgtcacagggtggcgtcacacctgaccgcttcccttgggaagggaaattgttctggcacaacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggggggcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaagatgttgtgtgaagaagggcaaacatgcacgttgccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcagacaccatcctagtcattgggttaggaatggccttaaatcccatttgaaatgtacaaggccaacgtttagtgtgcagtgtcatgcttttgtgcttgaggttatccatttcttagaaataatttttttaaaataaattcttagaagtgtctaaataaaaaaatattcatatgtggtggtaggtgcacagatggaagagcaacctataaggtaacaacaatttgagtattctcgattttttggtgccacacggtacacccctttagcttggagttgctatagttatgacaggttgcccttgccattagtggtggtatgcaatcatcccaaatattacgaagagttaacctctagaactaacaaacatccttaaaaaaaacaaattttgctaagaacattcaaagtttatatagtttgctggtagatatcgtaaaaacatgatacgattggaggacacactcaaaatgtggtaatttgttatagaatactttcggccaattaaagagagaaagtctttaaaatataagcttagcttctatttgaaaatttgaaaattatgcaactctaaatcttccatcacccaaagtacattgcttgcatacatcatattccatcaccaaagtcaggttagaagcttttggctcgaaggacattctcgtctttttgaataatctctagccaattaggctgaatgggtcctctagcaaattattagctttttacagtgttctccaattgttatacatttttcgatgtctaccaacaaattacacaaactttgagtatcctgtagcaaaatttgtcaaaaaaaaaaggtacaaacaagcattgattttctcataactccgcatatttagctttattgcaaaaaaaaaaagaagacaaagaaccttcaaaactttctaaaatatattataaacactactactttattgaatcatctccaagaaaagagtataagctttacaagaatatatcctatttatgtgaagtactaagatctttacctaaccaaaagaataatcatgtacacgattttgaggcagctcagactgaaaacactcaacaatgctaacatcacatgaagcctcttattactatacaggaaaaagaactgctccagtttgatctaccctgcaaaaatcaatacaatcagtctaccaattgccaacaaacatagttaaaacataacgtctgcaaagaaaggaaggaaggaacaggagagaaaacggtcatagaaattcccgatcgaccgagcgccgtttccgtataagggataccgtttctgaccgtaccgtttttggctatcttaaaattttttttctaatttctttctgcatcgtattaatatcgatattgagtagttaaaatgataaatatggtcaattaccggccgatcgagcatcgtttctgaagagatgctaccgattccgatcgttttcgaccgttttcacccctaaataggacgaccttgttctatctaaataaaatggtaataagctctccccctatatggactagaacacttcaaagttgcctcaccttaaaatgtatcaagatttaggggaacatcttcatcaggcttcgcttttggttgagtttccttgccaattagtttcagaggaacatctagttcaggggggctctgcacatatagttatttagataatcagtgatgcactaaacaaactatctttgtcgaaatgtcttgatgctcgaaacattcaaagtaccatgcaacgtatgagtggccaattgatgtcttgaaaaaaggaatgttgcttgatgtcatttgcaccagcatttgaacctatacgatttgaaggatctctctgaagtaatccatggattaattgctttgctgcaagactaacctggagaatcatagtgatattaataaatgagaacaaatgaaaactaaaatacaataacgaagtgtaagataggcataaacattttcttatctaacacatgctaacacatacccttaacatgatatcttacaggcttgctggacagattgtaaattggactcaacctttgtagttgcaaattgaatacagtatgcaaaaaatattggcctgcatgacaggaaacttcactggccatttctctaaaaaagaagttcttaccggaatgctactgggaaatgtaaggtctttgtgcagtatgttataaaatgtctttttcctgttctttcctcggaaaggtgtacgcccatacagcatctcatacaatagaattcctatagcatgggaattgatgttagctggatgtcatcttattattagcataatgcatatcaaacaatataataatgccatatcaaacaagttctcatggttaggtacttaggtgtacctgaaaacacatatctagtacttacacatcttataattatctagagagactagggatgtattggtgtggtagatacatatacagatctcagaaataaacacatacggagggcagtgtaccttcgggtgcttctaggcatttgacatctaagcagcatggttcaattgacacatggagaatttggataggttggagtcagcacataaacccacatgttctaatcatagcacctaccggtaccttttacacggaggccacttccatggaagggctaggcatgagaggatttttagaagggatattacaccattcaattttatgtttgttttgatccctgttatctagttaaactgactaacctacttaatgtgatgtaaattaaaaaagtgtgatatagatcagttatagcaggcaaaagtttgctgcagtgcaacttgtgacatgagttttgtttaattatgcatagcagtgtagcacaaaacaattaacttaaccgctaattatttagtcaaagtggtaatatggactattctctgggtggaaacccatgttcaaaatcttgtttgaatggcacatggattattatgaataatttgatgagattttagttgaacctcaaacatcttttaggtgattgctataagactataccaactaccaagaagatcgaataaataaaactaactcttttaatccattctgtgcaattcttgtaatcaactagttcataagatgacccaaaaaaatatattaggttattgcttaccgagagcccaccaatcgattgcacttgtatgccctgcacccgttataacctcctaaaacgatgcaaaagttagacaacaatcatgctacttgctgagaaagaatcagagaccaacattgacaacaagcggtttcgtaagatgaactgaaaaatgaaaagcatacatgtaaaattaactaaaagataaaaaggctacacctgggtcttatgataatgcatatcaagttgaaattaaaacaattactccaacaataagcataaagaaaacacaaggatcattcttactggagcgatatactcttcagtaccaacaaatgaatttgatggagtggaaggttctgagacaaatgttggggggagaaattcttgtgaccttcttcgttttaatgatgtggaattttttatcacctgcaggagatttaaccaacatcagggcaatatcaagtgttttaagtgcgatagtttcttatgaacaacaaaaacacatgctggaaaccaccaacaagtactcaatataaacatgttcttgacaccattactgactttgaatactatgcaagtggaaaactcaaagctcattactcaggaatgaagtatatttttgttttaaagtttgcgatcacacattctagcatacagactataaatgaccaaaaaaaatgaaggtaaatggaattagcaaatattctataaaaactgcagcaagcctgaaagtttattccctcaacttacgtggggttttgaagtcgtcaaaaatgaaagatcaaaatcagtcagtacaatgtgcccatctgcttggagcaaaatgttttctggcttcagatcacggtatataatacctacagcaggaataacacatgcagattagcaatctttgatctcataataagtccaatggcaaatcagtatctttaatgaaatagaaatagatcgccgattgttaacagtaaacattattaatacttggtttcactcaatgaatctgttcaaaagataggagcactaaattatgtaaacacatctatacctaggcaatgaaggtactcgagaccaattacaacctctgcagcataaaacctacagaacggatcaaaataatgttatataataaaagagagagtaggtgagtcgaatgatatagttaacataagatgataaggattcatggcaagaatctcaattatcttatttttatatttctttactcctttaaatgttccttgtgggggtggtggtgagtctgcctcacataactagtcaaaagagaagactgaaaagaatggatatcgaagacttctggtgggtgttcgagaaaaagactactggtagtattctgttacatttctttcttctttttttttttcatacatgtagttcttcaatcctacactacatgtatgtgacaaaattatttactagaaacaatttcattctattgagcctcagaaacagtatatcacaacaactgaactcaacagctgtttgcaaataatcattcacaagttagcaaaagcttcaaacattgcaatccatgcaaacccagcataatttattaagaaaaaagcaactttatcatcattatgggaaaactacatacttggatagtttctacaacagaacataattgtttgtatcaaatttgggggaaggaataatctggctggcagatccaagttcaatcaagtagttcatatttacttgtttgtctgcccatggggtttacatggcagtaaaagcaatgcagtagttccccaaatcagtttccacagttttatttatcataagctagtaaaatagattaaaaaatgtaataatatgtaagatgtaagtacttttgatgacacatctttaggtggccaaacctattacaggaacaaatattatttgtaaaaaaaactatattccatacttgggaaattatgtaagagatacacttcaagaatgaaagaaaaggtaaattttgaaaacatcatgattttcaaatagtggtatgtacgaactgacccagatgcaggaaattggaacaggtaccttgcacattcttccctgaaaattttcatgggttgcctatcaagcactgcaaagagttctcctcccggacaaaagtctgttatgagacaaacatgtgttggcgtctgaaaatagacaacattagtaaagaaccttgtggtttttaaattagctggataatgaaaaactagtatggaagttaatacaaaaactactctctgatgtttgtgaaatgatgaacaccttacagaagccatatttaactgaaactatgagtaattattttatttaactagcaatacaaaatatctgggataaagcattggtcataacaatgtcagtctaacctgaaatgaagtatacaatgttgggagaaatggatgatccaatagtgcgtatatttctctttcaatacaagctcgatgtacctgcaagagagagggagttgaagtaattcttgcaccttatcgtactagcaacagcaggaaaaaggttgatcacatccagcatggatggaaatacaataacaacataacagcatgctcatgttcatgaattaaaattaccttgttgcggttcaacatcactgacttgtccatggccttcattgcaaataattcaccacttccttgtagctcaaccaagtgcacactgaattcaaaaacaaagagatggtatagagatacttaaacagggtggtatagaggcactataacctagacatgcaccatacagaaaagaacaagggagcctaagaaatatactctatccaattagaaaaaacctaacattaatattatactagttgtatccagtcctgctaacttgtagccacataaaagaatatttctggtttgtcctgttaaggccattaaagaatttcaagatcccgtcgaaccacttagtgtcatggtagtgactatttttactaaaaaaacattttaattaatccaaactagacaaaactatgactgacgttaccagttttttatgatgcagtcaaagtaaacattttgtttctgacagcatgctttcagaagatataacaaccatctatcagttagcaaaaagacatcgtatagaagattgttcaggacatcttagtacctgccagtgtcaccacagccgagaggttttacaggcttgaagtgtttcaagccaatcttctcccctaaatttgtagcctgcatgccaaataataataaaaaatttatggtttcatagaatttaatttgggagtttcagttaatatgtttcccattcaattttaggatgcacattatcatatttttaaaaatcagagactattaagagcttagggtgctaccagcgtccagccatttagtacaatccaggggtacacatttgctactttggaacatgtgtgattacagtcattactttgcatggattcatgtactaattcactggaacatgtttatagtcatgcggacagcacgctcaaactaacctgggtgctggttagcgcttttgacggaccatatataatataatgcataaacttttttcttgaatatgcaagagagttgcgtatcatttcattatgaagaagagaaaacggaggaacggggagggacccctctcctcaccaagaccccacaggcctaggccttaacaaactcaaaacctgaaaccgacctcatcccggcagagctagcgacctatctatataatgcataaaatgtctaaagcgtttgcatgttgagcatctttctggatgatctgtacatgtaaacaaaaatcgcaaaaacagaaactacatgatctatcgtgaaactaatattatacagagtgcaaacgtacatatctagttatgagatacacactacacatcctcgttattcacatctagatttactaggtggcaaaacatcgcaaataatgagaccatgtacactttcaataagcttagttatgaactaagttactgcctgaaaatgggtgaaatgcagcatcatacataatatgtgctctcaattacctccatcatgttctacagtagtcctactttcagcataatagtaacaaacatataggcgctggacaacacaccatcatcccttttctgccttgctttctatttaacaaatattaatgcattcttgccaggaaatctggttaaaaaggataacatgagacactattggcgttaacctccaagttcacttactcagctagtcagaggaattcttttgctataagcctagcattatatattatagagtattatctaatttggtacagtttgactcattgctgctgcagtaatagaatttgcgcaccaaacaacaaaattaacgtaccttttctatagctatccaagaagggttattccgtttgtgaggttttggagaaacacgcattgagtgaattgcccacaaatcctctggtctctgagacaaagatagattgtgttatgccccaacataacagagaaaagttaaataaaatacttctctaactacaatattcatataaggtacattaccattttttctcttttataatttagatattagttgtttacagtgtgctgcacaatggccaagtgcaaacagatgcgaggagcaaaccaaaacaatcatttaagtgtgaacgtcagcgtgcatacacacggtttgaagttctatatctctgttgaaaaattttatttagggccacaagccatcgtatcaattttcacattagtcacttataaaatgtttctaaggttgctactaggacctggtggttattgtgctcctgttggtatttcttaaatatttcatcactaagattgaatgaggtttccatttcgccaaataatcttcagttctttatgaagattgatgatggtacaaattatttgtcaccattaaggatttaatccattattgcatagtctagtatgggcccatactatttttcatgtcttgttttgaactgagcaattattgttggttctacattttttttttgggcgcaaagttggttctacattttcacattgctgacaacttccatcaagaactaactactaataaagtgaaacaacaaaaagcagatgtaccttaccaagttggcatcaggaagctccctgactgcatcatccacattctctgctgtagctttgacctaattggacaccgtatgaaaatgaattagcatatttcaaatcttaaagcaatgctacaacctacaagtctgctcggcgtttccaagtttcagtatatgtgaatctgaagcaacaataatatacagggaattattatacaatttactggtatactgaagtatgaaactaagccatccaaaaacacaacatgttatggacctgaaccaactaaacagtatccaactgattgagacgtaaccaaatcaaatgctatccaactgattgacccagtctctagattcatctcatcttattcctaaattaaaatattatacaccaatttatatttgagatcattgaaatggaaattaatacagtaagctggcctaccaatttggcactctgtatctcagtattctccgaaaggcggttcctgaggggttcaacatgatcacttccatcaagttgcacaccaatgaagtattgaagctccccctgcactcacagatgtgcaatcactaccatgtagtaatcatacccactactagttaaaaattgcaagctccaaaatacttgggagtagcattnggcacagatttttcagataccttctggtcgcgcatgggttgaaggtggaacaagttccagaacttcttccctgatcacacaacaatccaaaatcagacaaaatcatcagagcttctacatcatccaacagtactactgtatatcatctaaaatctcaatatctatccagttcaagagagggattcgtgtccagagtttggagcattaccgctcttggtgtagttgattagctggaccgtgatctccttctgctccctgatggcctccctgatcttgtccaccgtgccctggtcggtctccggcccttgaaggaatctgccacaatcagcaagaccgcaactataaattcaaatgcggaggagaggaaacaattaaattcaccaagcaacaaggccatgggaacagaagcacaaacgtcgagagttacatagcacgaccgccgaccagccatggcggcgcgtgcgcgcgacgctagtagcccacaccaccatggggggcacggtcgcggagataaccttctccgccgccggcgcgcgcgacgggaggatgcgaggttagccgcggcaaggaggggtggatgcggcggcggatcgcccgtcgggctaggcttacgcaggccgcggacgacggcgacgacggcggcggcggtgggcaaagccgctccgccgttgcgattgggctgggcttgggcttgggcttgggccttgngatatgagcctagtctgacccaagatcagatgtcacgagtaccgtgtttagtaggtcacaagtccaatttctgtcacatgttgcctgcctttgtagtggtgatttttagttgcactgtctaacttcagtcactatactactataaatattttttaaaccctttttgttttttatttaggcgataagtttagaaatgctatagaattttcttaaatttcacaaaagagaaaaataacatttttcacgaaaggtaatatgcttttttttaatcagcacaatctctagggtggaactttctagagtattttttatctagagaattatgctatcgtatttatcagggttatggataccacatacctaatagtagttgattaaatctcggcaggacccaccacataccatgtcttatacggaaataatcttcgaatatagaaggagttccgcataaggaaggatgaatagagttctacatggaaacgacaaggactactcgggttgtatccatattggttttcctagttctacatggacaaggggacacctattggtataaatacaagaccccctaggaagagaggggagacaatcaacatacacggaacaacagaagccacaacatacaagccaacatacgccaagacaaacgccagatatcgacaacagagatatacctggatcgaccctatccggttcctacagaggccgactgtagggatctagcgttgtctctgatctcgccggacacgaactcgaggaggaagactgccttgttgtcgactacgagtcagaccttcagaccgccatatcgacaacagttagataggctaccccaaatattgtattggtgtgattatgatgaataagagcaataccggcttcggccaacaggatgtagggttattacgtgacagcccgaacctgtataaaaatccctgtctccatctcttttacttcagtttcacgtataccctagtaccaacgatccccatactatgcaaataccggaatcgcgacatcaaacatcgacagtactgtaaaagagttttggcaccgcttaaacttttgaattatccataatcctcacgttaagatatctataataaaaaacatatgccatactccctccgtcccctatataaggtattgtgatattttacttatactgtttgaccattcatcttatttaaaaaaaattgaaattattatttattttatttttgacttactttattatccaaagtattttaagcataactttttgtttttatatttgcacaaattttttaaataagacgagtggtcaaacagtgtaagtaaaatgtcaaaatctcttatattaggggacagagaaagtatataacattaagtttatctactcatgcttaaaaaaatgcatatttatgaaaaccaatttacaccatcaaccaaacataggcggacgaacatcaagttttttctttatcctaaccacgacaattaggttgtgtgtgtttggctcaaagggatgggaattatccttcacacacacaatacacaacgactcattatcatatgatttattaaatattaactaaaattttgaaaaataattaatataattttttaaaccacttttctatagatatttttttttaaaaaatatacagtagtttgaggagcatttgcgtgaaaaacgagagaatagagtacaccaaagaaacacaaccttacaaattacataaaccaactcataggcaggcatgtaaatatattataaatatagatatggattctaatccctcgagacaacactttgcctctattcgagaacccaacagaggggagataaagtttcgggtattcgtggcacgcttcttaaactgttaaaatgtgcgattcgtgcgaaaattttctatatgaaagttattctaaaatatcagattaatttattttcctaagtttgtaataattaaaattcaattaactacaagttattatcacctcgttttacgtacaacactagttgattcacttgacaaacaataaaaagatgtgagcaagggggttttgaactcccgacctgcaattccttcccaggatctcttcccgcgtgtactccgtcagctccaggaagctatccgacgcgaagatctgcacaacccccccacaccacacccattctgtcagtcaccaccagcacacgcaaacacgccggcgaccggcgagaagaagagaccggcggcggcgaagtggctgcttacgatggggttgtccgggatcctggggtcggtgatgacgaagttcttctcgatgcgctccagcgtggtggccaggtcgatcccctgccggatgtccttctcccgctccgcccgctcccagctgtccgtcctctccaccacctccggcgccggcggtggcgccggcgccggctcctccaccaccgccggcgcctccctgctccccaccgagctcctcttcccgatcttgaacctgccaaagcatggacagacacaactctcagtgtcactgccgtcccggcaatctgtcgaacaggtggggtgcgagagtctgaccccatgagggaggagcggccggacttgcggccgctggcgagccggctcaggcgggactcctccttcttcaggtcccagagcggcgacttgaaggacccggctcctcctcctccgcccgagggagtgccgggtgccacgaccggcgacatggcggccatcttgtccgcgtcgctcatcttgggcggcgtcagcagcgccgcgtcggccggcgcgcgcgccccgcgcggctgcttcaccgtctgcaccacctccgtcatcgacgacatcgccttgtccttctgcctctctgcgctccacacacgccaatggcggcattggtaagacaagagaattagagaaacatcgaggaaacagaggattccgcggcggcggcggcggtgctcaccgtcgtagcggatgagcgacaccggcaactcgttcggccgcatccgcttgtcgctgagcccctccgtgtacttgctcacctccacctgcatcctgttcgctcatacccgaatcagaatcgcagcccagaactcgaatgcaaagctcatctcatctcatcaatggcgacgaacgactagtgcttcgcttacttacccgatgaacttgatgaccttgccgttgtcgtcgcggatgggggtgacggtgaggaggttccagaacggggcgccgtccttgcggtagttgagcaggcggccgcagaagctgcggccgtgcttgacggcgtcgcggatcttggccacctcggcggcgtcggtgtcggggccctggaggaagcggcagttgcggccgaccacctccctgggggagtagccggtcatggtgaagaacccctcgctggcgtagatgatggggcagtccgggcgcgtcgcgtcggacaccacgaacgtctgctgcaggctcgacagcgcgtccttgagctcctgcgacacccgcggcagggagtcgtgcgacgcgcgcccgacgccgccgtccaccgacgacttgccgctccccgtgccgccgctgtcgcgccccgccgtcgccggcgccaccggacgccacgcctgctgctggtgggcgccgctgcttccgctaggcgcatcctcggcgacgatctccaagccggcggtggcgccgccgccgccggaggtggggaacgccatccacttctccaccgcgtcgactatctccttcgagctgctgctgcccgccatggatgccgatgagattgtcctcggctatttatcagcgaaggtgtagcaatcttggccgtgcaaccatcgattcttgctgcaaacaacaccaaaaaaataataataatcagaaaattcatacattacactcacatccacccaaaaaggaacaaattaatcatcacaaaaccatgcaaccaacccttgctccaacaaatctaggacaccacgagaaaggcaaagatacctaaacagaaggattcttttgcttatctagggagtactataaaaaaaacccatccatttttttcactgttcaagttcagaaatgtaaagaacagcaacctgacagaagaatggtacaccaatcaaaacacccctctctctctctctctctctctctctcttcactgttccattaccctatccacttccttatctgggctactggtctaccacttcttccaactcaacgagaagccacataaaaagggaagtaagacgagagagagacaaattaatcagcaacctctcttcaggcagcgagcgagtgatcgatcgattcagattcaggcagcagacagcagagtactcaggtcactagctaggctgataggcttggatcgataccaatccaatcagtcaggtggcgccggggagacgagggaagaggaagaggaagaggaggaagcaagtaggcgacagaaagaatggcgggcgtagcagcagcggcggcaggtgaggataatgcaatccgcgagcccgtgagcgatcgagcgactcacggtcgtctcgccgggattctgtggccgcggcgcggccacctcgccccccggccggtgacggcatctccgcggccctcccccagaaattattgctcgggtggtggtggtggtggtggtgagaggggtgtgacggcgacgggcggcgacgacgatctttttggggcgggcctgcggccacgcgggtgagcacgacggtagctccgacggattgagatactctacattaaagcccatgtttagttttcacgcaaaaaattttcaccccgtcatatcgaatattttgacacatatatggagtattaaatatagaaaaaaaaactaattacacaaattaggtgtaattcttttaagcctaattacaccttgatttgataatgtggttatgtggtgctacagtaaacatttgctaataacatattaattagatttaataaattcgtctcgcagtttacaggcggaatctgtaatttattttatcattagactacatttaataattcaaatatatatccgtgtatctgatgtgacacgctaaatcttttcacccctaaactaaacaaggcctaaatcagataattttaagtcattaatatgtggagctcatagtaaagaggtcccacatataagtagctcaaagtcatgtagtaactcaatccggctccgactgcctgatcgaggtgggcggtgaagagaggggttaaccgaaatcaacgcggcgcaggtgtgggagaagatgactggagatgacgtagtacgggacgacagagagcaatcggtggtcctccgtaccgtcgctggatgaatgaaagctgcacacgttggtgtagtttttcttcttttctttttttttttatcgcaacttgctggtacaagttcgatctccaggacaaactgtatcatacaaatttcattaccgattggagtcaaaatgtcaaacaaacactcacttgggtctaacgagtgtaaactggaacaagcacaactttagaaaaaaaggccaaccactaacggctagcgcaaattatttttttagcggaaaacaattttcgttggtggtagtgtaaagagacccattagctaaaatatttttgagtaaaataatccactacttccgaggcccgccagatgcctatctgggatgcccaattgaaataacactgtccggcccaattgtgcaactgggatgcccatctttagatgtgggattcgaacttaagatctctcactgcaatcctcacgcacgttaccatcccacctactacacacatctgatttggatatatatgcttcttttttaaactaaccctggaagcatctttagtccgtgttggtaacaccaaacatgactaaaaatatctttagtccgggttggtgttaccatccaggactaaagatcaatgtttagtccgagttggtattactaaccgggactaaagatccctcatctttagtccaggttagtaatagcaaccggaactaaagtgatgatctttaatccaggttgttaacactaatcaggactaaagatcgttaggggcctgacacggtctgatagctattgaactgtggctaaaaatgatctttagttccggttgggggcctgacatggcctgataactattgaaccgtggctaaaaatgatcttcagttaccaaccggggctaaaaaccataaaagtgccgttgggcttttgaaccggggctaaagatattctttagtcccgattcctattcgaaccggggcaaatatgatttttgccatccaagcaaagatcagttctctagtaatgtgtcactgaggccacttgatttggatcgagctgcctcgtcccctacgtcattgccacaatcgagccctaccacagtccccattccgccaccctgccctttgccaccaccggtcgctggccgccaccaccacccttctcatcaaatcgagtgaaggagatcaggtgagggaggtatggattgagaggagaggtgtgagagttgaggattaaaagagggaggggaaaagagacttcatgatttggtttggaagcatctttttatgccttttacgagtttttaggtagtgttccttagaccccacttggaaaaatcgatttttataagtgaggtcttaagagaaccgcacccccaccaataaaaatctattttttctgaaggggctaggatttcagggcctctcgttatttttacaagcatgactttttagtcctccggtgaaaataaaacccaagtgtcctgaaaaatcatcttttagtagtgtaaaacacgtacatagaccgaacttgattacgaacaagctgaggtattacactccccatcctccttgcccccaaccccttcacaggccgatgcccttagtagcatatcactaatcggcatacgactacccaatatctcccatcggtgctacggtactatgtgtgttccctccatgtggccaacacatacacacaccatacccgtgcaacgaagcaactacctaggatatccccttggttctacagtgatgcattgtgtcccctccacaggccaacatgtacgcacacccatgtagcttcagttgaagctctggtaccaactataataccctcgcctccaataatcgtattaggtgagctccacatgttgagtgggctcatattcggaggtactatggttggagtgacatgggtgtataagctagccttaacctatttaaactttcaatgcgagactattctcaccaaacgaacagttgggactaagggcatccacaatgtgacgcaaaagtagtccatagggaatataatatttcattcagccacctattaacattgtgcaactagtccatataaagaaaataacaaaaggtacctatatgcatatggactacccatatggaataaataatattatctatctctatttctctctcatcttctaatgctatcttgtatccacatacattgtggagattgctatattaaagtctatttgtgtgggtcccatctatatggatcactttagctatatacattggtgatgccctaatgggtctaaaattggaactagaatacgcacataggccaaacctgattgtggaagtgctagggtattactgctactttgttgtataatcgtgtacgttggctagaccgttggatgtcttgatatttgttctcgcaatcccaacttatcgtgtgctttattcctatctgcaatttaattagatcacttttatatatcattcttgattgttctttgactgttggcaagtaggcaataataaggttaatttctgtctgcaagattaacaactttatgaatagatatatcgattgctacagtgcaacacaacatcttgtttgcttgttattgaattgttaacattttcttcacaaaattatagttatctctcctcatcagaagatcaagccaccataagttacataactcacctctcttcctcgtctccgatctattgtctttgcccccacctcctaaccacatagacaaatttctcctatgtgagcaacgttgacaaaccaaccttctcttctcccatggctgagccggggccataaccacctcacagtgacctaccgtggtcacctcctattgcagggatttcaagccatacagcttcaccctaccccaaaccctcttcccgcctctgctcttaaccctgctgaactaattcagcatgctttttggagtaagtcattgccaatgtcgcatcaccactagaggaaatcatgcatcgttgctagaagaagccgcaggtgagttctaccatcagtatcccgcttctccctctcccatggctagaggttgaaaatggcaccttgaccgtcagggagcaaagtcgatagcaaaaattgatctaataattaccctttttccttcgaaagagaagttaatgattagtttttaatgaatgaaaagagaagttcatgattagttttgaatgaattgattctagttttgtagataccatattgttgtacacttgaaagatgtggtaccagtcgttgtacatgatggacttgtttttgggagatcttgcgatcagactcttgtatggaccattcgtttagtgtaactaaacgacacataagatagatacagtgggggtacaatgttcaaagaaagccgtgtatcttggagctgtgctcactgtcaagccttaatttgtatactagaaaacagttgtaaatttgagaatatctcctttcagactttgccacagatagagaacttgtcgggggaatgatttcccttgttaatgcatggacagcccaacataatgacctaattagctagagccaaatcgagaatgaacaaatctataatctagagtctagataagcataaaagcatatacatgtggtcctatgaaaaatataaaacatcgcatgctaaaacttgcaatttcgtattgttgtgcaaatcaaattaaatttagatgattgatagaaaaattaggggactggaaagtataaacaaagtgatctcattgcaaactttgaattattttttattacctttattgatggtgagtatggaaaattttttgcaagaattttacttgaaataaattgttttcactacaatttttgtgaaatttctcgcgttttaaaggaatcataattattatattattcctcagggtaattaactttaatgataagtttttatgaaattattgattttaagtctgcatttttttaatcatgtgaaatatggacacctatgattgcaacgatgatatggacatgctttttggcagttttgtcactacagagtctttttgcagaccattcgttaaatactaattattatggcacttagaacagacacaatggagagcactgttcagcgacagcggcttatattggactggagcactactccttgagcattggtctcgtgctagtttgcatgcctcaagaatttgaaaattatctcctttaaatcggttcctgattcccctaaaaaaaaatcgcactacaagaaaaatactctgtatagacatttttctagtactgtagaggcacttatcaaatgcctttacaacaatgtagaggcattttaaaaaatgtctaataagtgtcttatggtgaattgtctctacaaacgaagagacattttataaaatgtctataatatggtagaggcattttttagagacactaaattgtaccgcaaacatataaaaccagtccaaaaaagagaataaaatagtttccttgcttttgataagtcttgaactcatgatcttttggttaaatcattttattcttcgatacactaaccaactcaactccatgtcattacttgtatacttgttcctttaattacttatatttagtcgtttagtacacattatcattctaaaaagtgtctctatatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctataaagtgtctctacactataaaacttctgattgtagaagcaatttacaaaatgcctctacaaaagtgcctctatacgaggtttttgttgtagtgtaaaagtgcctctatacgaggtttttgttgtagtgtcggttcctgactgataaattgttggacaatagttttcttggccgacctgttcatgacaaacctgctccaaaaaaaaacattatttcaatgaaaatagaaaaatgtattgggtttcaaaaaatatggcaaaactatatagcgccatgttgtccatttggtattgaaagtccatattttcaagttgaaagtcagacattccgtgttgaaagtcgaactacctgagcatcaattttggtgatttgtgcaagtttatgattttgaagaaattgcaagacaggtttgatcagttgaatatttccatgagtgtatataagaattctcagaagtttcaaaatggtcttgggatgtcctaagcttaccattaattatcgacatcattgaagagataatgcgatgtagaaagatgtctgattcttgaaacagtaggttcttttgtctgaagaccatgacaaactgaattaacacctagaaatccaattactacatcatctagcattggatacgaaggtacgttactcagaagattgagtggatccaccacgatggtaattgatgaaacctacgtagacaatgcttatccaaatgagtgccttccatgaattctgatcctttgcaaaataggtcctccaacggtaaaactagatttggattcttagcaaaaattagttccacatcgttgtagttcgcggcttttgctgtatatatatcgacaaagaaaatcgctataaaattatttttttaacatgatataaatgcatgtgtttatataaacgcgcgcgcactcaccctataaataattagccgtgaatgcgagcacccataccaagtttagaatttgaacctaggtggttaggttctagcacaagaaacctaactaatttagctacgctcatttcacaaatcacgatacactttaagactattattaggcgatattaccaaatacattatatgtagcatgttgacatagtcttcatctgacatggcgcttacgtggaatcacatacagaaaaaaactaaataagacctacatatcattgacaattttttttaaaaaaatctatggcccatatgtcaaccatagtgtgaggcccatatgtcatcttctctctccctcgcttcttcctcctccctatctgtgtcttcctcctattccatcttccccctttcttgcgtttgactggctggctctctcccatccccacttctccacagtaacgaggatgcattggcaacctcgacctcttcgggccatcagtgagctcgggtgctccaaattctgtggctcttggctaagagacagaggcagacgatggaggtagggaggcagtggccaacgaaacctagacgcctctgtcactaacttcttcctttgagctccgtgactcttagcgtatagatcgaggcagacgcagagaaagggaggtagtagccggtgaaccccatcgatccccctctatcgttgaccttcgcctttgcctatactccgtaccgaagcggcatccaccgggggatgacacttcatatgatgcactccccgtcttgacgctcctctggctccccaccgctactctcataggttgtgagccaatgggcaaggagcagcacgacgcgacggccatcggtaggggagatgaaagcagtatgatgcgttgtggtgtggagaagcttacggttgtttggcagcgggggtgcatatctggttagcgtggttaaggtcatgggcaatgtggcggagctccgtcatcggcgtgccctggacctcttcttcccctcccgcggccaagttctctctccctaccaccttgactctgctgtcctaggtgccttcttccagccgctccccaccgtcgctctctccctacagctgcctggctcgactcgtcgctcatcttgagaaaagagcaccggtagagattgacggagcgtggggctcctcaccggaagaccgcgcaggtccccctttgccggttcggccgggggcgctaagtgaggttcttcaccctcgatctgtggaatgttcgcgagagagccaatgcacaagacacgggcgatgtagacaggttcgggccgctgagaagcataataccctactcctgtgttatggtggatctgtgtgtgaaggagttacagagagctggagagcaaaagagttcaggctctagaacccctcttcctctttctctcctctacgagctcaggtattctcagagtcgtccctcctattcttgttctggatctcgatcctcttcttcggtgggcaaggtcctccttttatatctcaaggggataccacatgcaccacttctacctacccttcttttgggtggggatccaccctatcttaaccataacttggctcgcgcctttgcttggaagctaaatcacagcttgtccttgagtgaggcccagcgccgtcactcgcctgacacaggggatcaccctgtcattcctccattaatgggcggagatttgcaatggccgctgtccgaatgaccctccgatgggatgggtcatacctacctccagttcgccggaagcagatgcaacgtgggagcacggtttgtctgctgatgacgtgaccagcgtcagaccagtcacagaccggtcattcttgtccaccacgtgtcagtttagcatgccgcacgtctgtccttcttcatacaatgacttccttgcaatggttgcgatgaagcctggaatgtatctggccgggactggcgtgctaactccaggagttagcacgccggctccggctagggacgagtgcctggaggctctcatcattccgacgggacggggcgaggcgtgtgacaggccgcctgctgccacctaacccgcgatccgaccggtctgtgaccggtcacggaccggataagcgagcgcgctgcgctgcattaaatgcggcgtggcgcgctcgtccaacccgtaataaatgcggttaggtgagcgccgctgtgctcacctaacccgcacacgtggcgctaacaccacagggggtcggggcgccccagccctcggggccgaaacgggagcggcccgacccctcggggagacagagggaggggtggccacgtcaccctcgggcccgacccccccccccccgagggggtcaggccacgtgggtgagcgcggctgcccaagcctctagtcacgatactcccggtcccatgtcaccgacagagatgaaaaaaaagaagggtaatgatatcccactgaaatgtgggtccattgtattttttctttttatttttatttttggtgccacgtgtcctacactcaatcggtttgaccagggtcaaacatgccacatcagtgaaaccactataaatactgccgtgggagttattttgcatagtttcagtaataggaggcggttgtggggtaggaatcatatttgacctacagttgggggagttaagttagactttttacaagttaaatcacaagcccatcacaagctcatcatggttcccacgtgataggccttaggtgtagctcggtccggtggtcaagaattggcccattacatatatcccttctccttttattgtttttctttcactaattaaggcggtgaggtcgggctggtttattatgatgcggagagataatgtggtcatggttaattggagtacccccaaagtgaacggagagacgcaacaaaagaaaagggtgttagggtacatcgagatcttccgatttcgatagtaaatttatctttacttctttaggtttgttttgtggacgctccttacctactgaacaccgatgacagttactgtcaatgattttcatttctggtgagagatattcagtcgtgatagttggacttgtagtcgatattttgaatttgttgctgaatactcacatgtgtttttacaggaagcgcggtgaacaagttcaaaattagcttctactacaagggtgcacatgactggaaaagtgttttcattatctgaaacgacgttctctggtttctttgatgtcatctaaatagttataaaaaaataaaaaaaaatcatgtcatctaaatagttattattatcttttaaaatatcaagataaattaatatgagatatatcatttgacttctaaaagttataaaaaaataacaaatatgattaggaatgtctagtttcagtttaatattttctttttaatgcaacttgtagtcgaattttaccttgcattttgtgaagtgatatacctcatattaatataacttgtcaaaaaaaatttcaaaactttttcataactatttatgtggcagataaaaatcaagcagatgtctactcaagatatgaaaatacatcaccatgatgattgggaagatgattcaactatattccatcaatttaactatttctcaatattaggtatcgcaattatccaaatattatttttatatttaccttttttcccttacaaagaggtggttactcaacaatttaccacttttgcccacgtggtataccaccatggcaacccaaggtagaaaatagcgtgggacccataaatggcaacgacgagcacctcgataccaaggtcgtggtccctttgggctcatcacctagtggacggagcaatgatgcgaatggagggcgtcatccgcggcaacgtggacggaggaggcagcggcccgactgttgtggcaggcatgggcgccacggcggttctacttggcctgtgcgaggttggcgtcatggacagagagcgggaggcatcatgcacctctagtagcaccaggaccccacctcgcccgcacacaccaccgtcctcgccacactcctccgcacccacagtctcgatgacttcttcgtgcttcaccgatctcacatcatatcggactccccgatgccgcattcaccacctccacctcatctcgcgttcctggactggcatggcaatgggaggtcttttgtttagttcgatggtgtaatagcgctggcaacaacgtggtagcatggcttctatggtatcatggtggcacgacgctttgtgtgagtggtgcaccatgcaatgaggggttcgactagggaggcttggatggcctcagagagttggagctgaaaggcgagccgacgataaaggagatgactgaggaggatggtagggctagaactttatgcaaaagttgacagtcaaatttggtacttaaggattgtcaacaagatcatatcattttaaatgtatatacttccacatatgtattgtatgcaatattgttttaaattattgactgcacacattcattctagtaaaaataggacagttaggtatcaacaaaatgtgctacaacttgcaaaatgatgtgaataaaaattttcacctacactctttgtctaaaaaacctaatcctatctatattcaaaccaaggattgaattctctttggatagaggaaatatatttatagtattttatagtactttaaaaatagagtagcggtggactggtgacggtggttctacgtaccgccccactaccaactgcctacttctttttgaaaaaaaatgaataggtagggctatagggcccatatatcaactatcccacagactatctaccttttataagaacaaaaaaaagataatgtaggccaaattgtctacatatcagtaataaatatatataaaatgattaggagataatatataaagaaaatgatgataataacgcatttgataattttctttagttaaaatcttgttgcaacgcacggacaatatgctcgtatttgtagaaatcttgtgaaccctattgaaaggaagacagccagacagggccgtgctattgcagggttccaaaacctcgtacaatacaaacaatcagcactcagttgcaactttttatatgaattgtgttagtgaaggccaatactgggattgccctttcacacaaagtagttcagagatcgatgaatcgactattctaatttaacatgaaccaacttgcaactgagctcatgcatcaacatttacattttgtcttgcaactaattaaatttaactaatcaagccatcgactcgcgcacacgagcccatctcacgcgcgcacagatttgctgccgccagtttcttccccctcgtcgccgtcattgccgcctcgtggcgcacggttccgccttcgccatcaccagagagaaactcggtgatagctgcgggagaaagaggaagaagaggagaggagcgaggaagaaggggagaggagcgaagaagaagcaacgactgacatgtgagacctcagtgtcatagagttaaaatagggtgggtagatggtgaggctgttggagcgagtaactagtttgactagccaaatcagatggaaagttagctatgtgggtgtttggagagtccgatttagatatgctgttgaagatgctcttaatctttgtcaattgggtcaattaacatgcatgccagaaagaaattaaacctaaggtttttttttgttttattcgtcctaatgagccgacctaaaactttaccaaaatgaggaggtgaagtactaaccacattggggagaacaaacttttcgtaaagggcaaagaaaaataatgattcgtgaataatcccaggtcatatgagatctctctttttttccactcatctcctaaaagacaccgtgcaatcgtgcatgctacgaaaaagatctaaaagctagataacactttgctgcatgtataatccactatatagcaagaaataattgatgtgtggctctctgctctcttggaacaaaagacgaactcactaacaccataacattggcacaaaaagatactatactacctccatttgaggttataagatttttttaacattgtccatattcatatagatattaataaatctagacacacatatatgtctagattcattaacatatatatgaatgtgggcagtgctagaaagtcttataatataaaatggatgaaatggaggaagtatatatatattaatcgatcttgaaacttttgttttgcgaatctatagtgcaactacatctggaaatcttcaatggattcctgagctagaaggatttaataattacacaccaagcaccacttggattattgattgaattagcttttgaataatatgccttttcttcgattttgatgcaagagcaatacgaggttgatctgacacattgtccatgaaagcacaccatacaccaaataaaagatagagtaaatttaataaatcctaagttttgaggcatcggtaaagtaaaatcaaaatctgaggtattaccatttgtttcataaaactctaggttttggagtaaaatgtttaaaaaaagcatttgtttcatgaaactctagattttggagtaaaatattttaaaaaagcatttgtttcatgatcgaaactctaggttttggagagtaatatgtttcaaaaaaccataggtacaaacttatattgttccttcggctaatatatttatccatagtaactgtaaaaaaaaaggcatgagatatttttcagcacatatgcacattacttgtattttcaataaatgttggttgtcgacagttcgatcatttctatgtatattaacccgttaatgtgtcattattagtggggtattgtattgaatatatttgcaatagggaaatgaggatgtgaagaaaaaagtaaagtagatgagagcgatgtgtatttagtatactatgagagcgatgtgtatttagtctactatgtgtatttagtctctcgcaccgccgcccgtgagagaaagaggggaagagagagcaaagggcgccgccgtctccatcatccccacctccaccaccgccgcccaccgaccatccgcccccgcgcatcgccgctacacgccagccgcgcgggccgccgctcgcagcacacgcctccgcgtccgcccccgcgcacccgcgccgccagtccgcccccgcgcaccgccgctagccgccagccgcgcccgccgccgccgcctcggcgctgaggccggcgcctccagccgctgcccgtgatagaaagaggaagagtgagaagagtgaggagagtgagagagagaagagagagagaagagcgtatgacatgtaggccccacattttttatatagaatgctgactggactgccacgcgtacgccacgtagaccaaaaccaccgtggattgggtcgaggggggtaattcgtccagtttgtatagttcggggtgaaaaatgtccggttttgtggtttaggggggtaattcagatgaccgcgatagttcgggggttaattcgtactttttcccatatataatgatgaaatacatgcattttacataaatatggagtttctttaaacgttttacccccaaacatagggttacatgaaaaaaaatggcaattcacagggattacaatacggataccctaattaaaactgggattttataaaatttactcataaaagtaaaaataagcttgtacatgtgcgccctttttagtgtgggaatgctgcgtttaggccttgttcggtttggagggcattgaagatgattgaaggagattgaaggggaataattctacaccataatagttgtgaataaatctcctccattccctctctcattgggattaaacgaatgatgccttaattgggcacacacaccatcatacgcagcatagcaaacatatacacatatagatgttctcgatgtaaccacgcttacaaaggcctggtttagttcaccaaaaaatttccaaaaaacatcccattgaatctttatatacatgcatagagcattaaatatagatgtaaaaaaactaattgcatagttaggggggaaatcacgagatgaatattttgagtctaattagtccatgattagccataagtgctacagtaacccacatgtactaatgacggattaactaggctcaaaagattcgtctcgcggtttctagacgagttatgaatttagttttttcattcatgtccgaaaacccttccgacatccggtcaaacatccgatgtgataccaaaaaatttcttttcgcgaactaaacatgcccaaattatcaaaggaaccaaagatcctcctagatcaggcgtgtgtcagacgtgcccatgcactaaatgacatacaacatacatgtatatatgtgtactcttaactttgaaattattatatatgtaaacatgagatagagtgtcaagtttaggacaatctatataaatactatagagaagggaagtactgcaactagctagtgatcatagaaagccgtcatggttgatctcatcacatggagtagcacatgcttatacaggttgtagcatctgcgccgagatgtgtatcatgtgagcttaattagctcttgaggctttgcaaaatcaagtatataaaacccatttttttaagtgacagtgcaaaagcaccacatgcatcgatcatatacacacaccagtttaattatcttggtctaggcaatgcatgtgtgagcttgataagatgttgggcgtatatatgtacagatatgatatcctggaatttagaaaaacaatggatgggaaaagagaagataaatggtgttgccggctaagcggctaattaagccacaatatgtacctagcctagagaaggaatggagaattatcagcaagaacatatacatagtgtgtcaacacaaaggagggagaagatatatatatgtgctgtaatgaaaatagatgcacaacggagacacgaattttacgtaaaaacccttgcgggaaaaaaaccacgggcaccaaccgacaatgatcagtatagaggagttggatacaaacgcaggggatacattgggctatcgcaccctactcatgcgactttcaagggatatataaaggagaaatatatgagtcctaatgggaaaatacttaagagtcatattaggaaactaatcctaatagtcaagttctattatgaaacttatccgaatatattgcaggccaaaaattcgaatcacatatttaacatgcacacatgtgtacatatatacagtatctgcagtttaatttgtgtatagagctgtaaacatacatgtggcgattgttttttccctaaaaacagaaaagaaaggaacaatacatcaacattaataaatgcatgtaactttaatgtatattcaacaaagattatgtaaattatatctcttaaaacaatatatagtggcaaacaaaacaatagctacacagaagttatgtttggcaagcaactagaaatgtttagcttgagaaaccaacatggtaaaccttacattcgaaaaatttatttatatgactaatcgcctttcataaagattcatatatcatataacacaatatccctgcacacgcatggttcctaataaagtgtaataccccttgaaatatagaatggattcaaatcacatgcatatatactatgctagctctgttctcaaaaggatggcgtcctgaaatgctgtgtcagtccatcatttcgtctacaactaattataagccataatgctcattagcaacaaaaaaaattatagtaaaacttttacatatgtgttcttgacgacttaaaagtcaatattgaaaataaactgtgttgaataaacattaaaatcaattctaaaattaagttttaaaatatttaaattttggttgcagcaaagctgaagagcaaaccatggagctaacaaacacatgtataattgactggttgccaatttacattttccgcctcctaataagctagcatttaatattgtagcacccacagatagtcatccggaaagcagtaaaccagaaaccagacacattttgtgggatggtggcaaaatgtgtataaaaccaacgggaagcacatagctagcacacgaatttaggtacctataacctgccctcctcatatcatgtcatatgcgagataccaccaaatagaaaaataaaatgtgtatttacatttctcgcttactaagctagcatattattaagagaaaattgtgtgcccctgagtttttactcatccctttcatgccctttagtttttgttttcaatcacctttatagccattccttagactacatataacagtcaacttaaaaagcctaagtcttgtgttgaaagcaatttcaactcaaaaattaacatcgaaagggatagaattatttgacacccaaattaatttgaaaacaaaaattcaaattttgaaattaattctagttatgtttgatgaagttttcaatgataatttcacttgtatctcttcatagaaatttgttcaaatttgtttgaagttgattttaaattaaaatacaaattttagtttaagatagaaacagtgatgatatgtgtcattttcccttttgtaatttcatcaaattttattgcaattcatttaaaaaatttaaattttattgttcaaattcggggtcactcaactttctccctttaagttttataactaaagattttcttctagatatattatgttcttatctatgagtgagagacaatataatcattagaaaagctcaattgagatgaactaacaaaatgagtatatacagaaaagctcaaaagaaaacttagggctatgtaagggataagacaaaactcaaaagcatggaagagatagagcgagaactgcaaaggaaagacaaagatttttctctatttaataatagagcgcacacagtttatcattcggaaagcagtaaaccggaaaccagccacactttgcgggatggtggcgaaacgtgtcctaaaccaataggagggacatcaccagcacacaaattaaggtatctataacctgccctcctcgtaccatatcatatgcgagataccgccaaatagctttagataatagaatagcttaataaaacaatgtacttgttgcagaagtcgaggaaaataatactgttggttctcacattatagtaatgctctctctacttaatttatcaagtgtgctgtcagggatgacaacaccatggcaccatcagtcatcaggacagcccaccacctttgcaaatagagagaaaacggtacaatgacaggtataaacaaagaacggatagcttgccgatgttaccatttagacttctggccaactaaattatacttcactaattaagctctaataagaagccctggctgcttaaaccagcagcagctaccttagacatctattttggagcaatagatccgccatacatatattaattatctactcgatctctccattagtctccagctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaaggttggtgattatcatcgtcgatccccttctatagttctatatgtatatagctgctacctgctaggtcatgaaatatatcccaatccttcagatttttgtctatatatctcgatgtgtccagctatctagcttttgctttactctagcttagggttttctttgattctttggatgatcttaaggtgaaagacttctgttttttttagaaaaaaataaagaaaatcgatgcatccatttagatcactccttctcccatctaaataatctctatacactattaatttgatgaattgtgtatgcatatattgactctttctgtttagtctggagcattattcctgaaagagaaggagatgcgcagtaggagctggtatgcaaggggctgccagaatgtgagaatatatttctagaaatggtgtatacgatttttctaagttaaataactcacaagttatctctagatatatatttattttgatttgtatattaatttacctcgtttcttagctgaaaatttaggttaatttcccctagatgcataaaacatttgctatatattggatcgtaatggtatagtcttcctttttgttagcatgaaatcaataatagagcggtaccaggaggcaggagaggagcattgtcggttgctgaacccaatgtcagaggctaaggtatgcattctaatataatggtagcaaatttgaggtaaattaaaaattcatttcttgaggtcatctggttttgcatacagctacaaaagttgttgactaaattgccgcactttgtcgtcataaactccattttcccaattcttaactaaaattcctatatattccaatgtcattatttgcaattatcctgacatttctacttatgtattggcagttttggcagcgggaggttacaactttgaggcagcaagtgcaaaacttacaccacaacaacaggtaaaatcaagtccaatgtcaatgatatattacacatacaaccatagctaattacacacctcttctcaagttttttttttacccaaatcttagcataaccagatgaactcaagaaatgaagtcccccgcctgggaaaatgctttctctagtagtgatgttgacctcactttctctctaaattagtttttacttgtctgcaaactatttaaacgaaaacagtgcatactactttattaggatcaaccaatatgaaggtgaaaatgaaatcttttttaaggcccatgtggaaattcatgtttcaaataaaaggtgaaaataccttttaatgcatgattaattctacgtgctatcaattctagtcacattcttatatgacgtacactgataggcaacttttgggagaggaaatctccaacttcacagttagagatctgcagcttctccagaaccaagttgagatgagcctacattccataagaaataaaaaggtataatattgataatacccttttctcgactaataaataaataatcttttcctaattaaatggcgatatatctattgtctctttactaggatcaacttttggcagaggagattctaaaactcaatgaaaaggttgtacttgcatcttcttcttcttgatgaaatagctcatgatttaattggtatcagttcttacatctatacactgttcatgattgaggtaaaattacacgaatatatatcgctctatacttttaattgtaggggtctcttgttcaaaaggagaacagtgaacttcgcaagaagttcaacattgctcatcaacgcaacatagaattacacaagaaggtaaagtttctattcgatctactcgaaacatacaaaaatgtcgtagaatattattgatatataaatatacaatttacatcatcttgattaattaatttcagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacagtgagttttcaaatctttaattacgtaaaccgtaaaacctcgctcttgtaactaatatatatttcttcaatgtttaatcaaagttgtcagagttccttaccttttgctagtatcacaaaacaagtagctatttgtttgtgatactagctagtaatttgtgttaagctagctagtaacttgtgttaaactagctatataaattaagtcacaaaatacccataaattaagctagctagcccttcaaattttgttgtttttctctgattagttaatactatggtttctagctagctagctagctagcccttcaaattaagcactgtacagaacttgttaattttctactcatctttactagtataaattatgccactaattaagttcctagagttacttttcatgttcagaagttgcatgcatgcatggcaagttactttaattactgtgctcttgtttaaagaaaagtgttaactttattctaaaaaaaaagtgttaactttacagttacacagatatgtccctcattagaaggtgtaataaatctgtttgtttgcagacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatccatattatattgcaactcttacgtgtcatatatgtcatgttatatttaaacattatgtgcaaagagatcaccctcaataatgttctatggtatgtacatatatattcatatatgtatataaacaagatgatatccactccacacctccctccccctccctcacggccgctacagcatggtgtcgtaaactgtgtggctgcaaagatagctgtgacgaggccttcccttccttcccacatgctcccagaggcatatttcaaggcaatgaaggttgcgactacactgaggtggccagatgggcagagccacagaggtccgtacatttcatcaagcaaaagccagtttcatttaaaaaatccgtttgaagagaagagaggtgaagaaaagcgcatttataaagtggtgtggcaagaacttcggaggtaattaccattaaagtggagtcgcatgagataccaatgcctactggagatgaaactaaggtggccaaggcgagaagaccgcagttggagccaacgcagctcaccacgctggtttgaccgagccctccaggagtcgtgtcacctcaaggggccagtctgactgtgcagagaggtcggtttgaccagggtcatccagggagctcgagggcatcatcttcgtcggtcaaaattgctagaggtcactatattgcccccggaatagagccaaagctaagtggatgcccgcggacttgaccactactcaaagaggaggttgcaacatcttcgtgcttaagaattgaagaaaaaatagctgaaaagttgagaaacaagattcaataagttgtggttgtaaaatcaaggagttagagagacttgagttgagagaaagttagggtttcgagtttagtttgagattttggtgaggagtgctattggtgcactttgtaaacactagttgatgcaataaagtcgagaattctaatctacatcttcgagtttgtcatctaccggtgcttctgggttctgacagtctaaccgcaggtgtgcacctggtttgaccagtgggatagcggcggtctgaccggcgaggttttggcggtctgtccggcggtgaacatgcggttcgaccgactgtgacagggcttcgtcatctactccgttcgaggtaaatcttttatttcgcaaaagattttgggtttttggtttttcctaccattcacccccctctggtaggtttgtttggtcttgtgcgatcctacagtggccgcctccaagacaatagtagaggcctaagccaatggagattgagaaaccgatgatagatcaagacgatggtgaggacaaaaatggaggtgggttactggttattagcaatgattcgctgccaagacagaacatggatgtcaacatggtgtttgcattgccgatggaattttgtgtcatggatgaggctgaaatttctcaagatgtggtttttgagaagtctaatgagtctaaccatcatatgaggccactcatctcaaagggcacattgattggaaaatgatctctagaatgttggtggttggaggtgtcgtcgtaaatttgatgccacactccttattcaagaagttagggtgtgaagttgtggtgaattgaataataccaacatgatgctcaacggcttcaatggtgaaccaacgaaggcgagaacgatctttttttgtgaagcttaccgtgggaaacaatatgttgccaaccaatttcatcgtcgatgtgcaagataactatagcgttattggattcataccaattgttgtgttccttctaccttgcaccagtgcttgatttaatgggacaacgatgagattgagatcgttcaagcagatacatcggccgaggttgcaatagttgacgcgtcaattgagtggtatgggattattcaatgcttattagggttagatatttctaactataattttattagtgtttctaaagatcgttttgtacccattatttggagtggttgcaaaagagagtgcaataacatcagtctacaaagaatgacattggttttgcatcggctgatccactataagagggagacatacataatggatctattgcatggaaaacatatgaaagttgattactaggttaaagaatatgttgatttttttgaatgggaatatcatgaaatgtcgggagttagccgtgagcttgttgagcatcagcttccaataaaattggatttagaccttataagcaattgcctcatcactttaattcaaacatatatgatcgtgtcaaggaggagatagaccgattattgaaggtggaggccatgtaggtattcggagtgagtgtccaatattgtccccgttgagaagaaagggagtggtaagattagagtatgtgttgattttagagatttaaatagagctactcctaaagatgaatatactagacctattgccgacatgttgattaatgatgctttgggacatagagtcatttgctttttggatggtaatacttgttacaataaaatctttatggccgaagaggacatgttcaaaacggcctttaggtgtcccggttttgttggcttgtttaagtgggttgtcatgacgtttggtttgaaaaaggccggtgcaacataacaaagtgcaatgaacttgatcttttgtgatttgctaagtataatattagaaatttatgttgatgatattgttgtcaaatcggatggtatggatggtcatatagcctgtttgcgtttagcttttgggaggatgcgtcggtatggtttgaagatgaatccactctagtgtgctaatggtatgtcatcgaggaagttattaggcttcgttgtgcatgagagaggtgttgaaattgatcctaggaagatagaaaatattagatagtttaaagcgtcagcatgcaagaaaaaagttcaaagattgctaggtcaggtgaattatttgaggaggttataatcgatacttttgttcccatatttcgttgggaaaaagaagccgattttacatgtgaagcaaacaacaagaggcgtatgaggaaattaaaaagtatttatcacctccacccatggtgcttgcgcctaaagttggaactctgtttcggctctacattgccaactgaggacaatgtcattggtgttgtgttaacacaagaagtggattgcaaggagcatatcatcacataggtgggctgtcatcttttggatgccaaaacaacgtatgtctttatagctttgcttatgtttatattatgattgtaccaaattacagcattatctattatctagtacttgcacttgtcaaactgatattattatatacatgttgcaaaggcaaattctaagtgggagaattcacaggcaaatactttgattgaatatgatttggcttatgaatcgttcaagtctttgaaaggctaaatcatagttaattttataataaatcatcttgtggatattacttatgatagtgaggtctatttacgtagtgttacaccatggaaaccttattttgaaggtacttcttgcgaagaggggtagggtatatgtgcagttttgttttcacacaatagagctatttttgaaacatcggtttacttagagttttcttgcacaaataatcaagtatatgatgctttgttattcggcttacaagtattggaagctataggagcaaaacatgtataagtttttggtggctcggaattgatagtgcaacaagttgccggggtgcataagtgttttgatgggtcattaaatagatatttagatcaatgcttagacacattatcaccaatttttatgattttgttattagaacatgttgctagagaaactttaaggcaaatgatttggctcaacaagcatctggttatcatgttaaaaaaaaggagtattcttcatttagaaaaaaacggtgcttcaattcaagagtttggacaaaattggcgatgggccgtctgacagacgcaccggggccaatctgaccagggaggaccggtggtctgaccagcctggcatagccggtctaaccagagaccttacctgacctgatcgacctattatggctagtctaaccagattccaacaatcagctaggtggcacgagttcatgaacaagttggaggccgaattaattgtaaattcggacgtttgtccctaggaattagaaaatgattggagtgtccctttgatagattatttgaaatatccaatttttagggttgatcggaaaatttggtgtcaagcttttaagtatactttgtttgatgatgagttatatcgccgaaatatagatggggtgttattgaagtgcttagatagtgatcaatgcaaggttgctatgagagaagttgatgaagggatttgtggaactcttcaatcagcccacaaaatgaattggctacttaggagggttgggttctattggccgaagatgttgatgatagtttcaagtactatagagggtttgaaccttatcaatggttcgacaatgttcaattggcgcccaccgccttgttgaaaccaattatcaaaccatagtcgttctgaggttggcgtttggatttcattggtcaaatttaccctttatagtgaaaagaacatcggttcatgctagttgcaacggattatttcaccaactaagctgaagttgtaccgctcaataatataactcacacagagctagttttctttattttcaagcatattatttatagattcggtatacctcaaattttcactacggatcaaggagcttcttttatgtctaagaaagtaaaataactttgccgaatcttagtattaaattgttaaattcttctccttacactacgctcaggctaattgacaagtcgagtcgagtaataagggttttcttgaaattagttaagaaaaagattggggaacatccaaagagatggcattaagtgttctttgaagcattatgggctaatagaatatctaggtaaggtgctaacatgttaacaccttttgagttagtctatggacaagaagttgtttgacttggctctcttagatatatcaagtaagatgatttatcggtgacggagcgtggggctcctcaccgggagaccgcgcaggcccccctttgccggttcggccgggggcactaagtgaggttcttcgccctcgatctgaggaatgtcagcgagagaggaagtgcacaagacacgggcgacgtagacaggttcgggccgctgagaagcgtaacaccctactcctgtgttctggtggatctgtgcatgaaggaatacagagagccggagagcgagagagagagagttcaggctctagaacccattccccagagtcccaaccctccttcctcttttctttcctccctttttttctccctccttctctttttttctccctctttctctttttttctcctaggcctgggcctcctttttatctggtcaggggtcactacatgggcctctagctgcctaagaagggaaacatgctttttacaatgagggctagtctacagccggaagtgacctctgacaagcagagcacacgcctcctgccccgctcgcctgctttcccggtggacgcccatttcaaccttcatttaatggccagcgacttccttgccatacctgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacctgcgatctgaccggtctgtgaccggtcacacaccgcgactggtcacggaccggataagcgtgcgcggcgccgcattaaatgcggcgtggcgcgctcgtccaacctgctataaatgcggttaggtgagccccgctgtgctcacctaacccacacacgtggtgccaaaaccacagggggtcggggcgccccagccctcggggccgaaacgggagcggtccgacccctcggggagacagagggaggggtggccacgtcatcctcgggcccgacccccccccccgagggggtcaggccacgtgggtgaccacggctacccaagcctctagtcacgatacccccggccccatgtcaccgacaatcggtcaaggagtataagacattaatggaagataatctggataatgtgttcgataaacgtttgaaacaactttagaagagatagaaaaggataaaaagagagtagcaaaaacctataataagagagtgagcaaaatcgtttcaagtgggagtttagtatgtaaaacaattttcccattagaatctagatctaaggagttcggtaagtggtcacctagttggaagggtccttatcggatattttgaatcattcgagggaatgcatattttattgaaactttacgaggagaacggtttcaaagagtgatcaatgggaaatatttgaagaaatttttcctgagtatctggtaagatgcttaggaggtaataaggccagtaattagattatcaccctaagatcacgtgttctatgtttttcggctcacaattcgacaaaaggcagggtggcatgtcttaccgcccaaatttggcacctagaaaagaaatatggaaaatatggctgaatttggaacatatcgggtctcttccgtgatgacggtctgaccgccaccataaggccggtctgaccgacggcatggggctggtctaaccggcaacatgtggccggtcagactggccgagtctgacttcgagtctaattttatcgagtctcgggtttccccaattttattgggtctcgggtttccttgtaattggtctctacccccgagtaagacatggagaaggccctgtacgagataagaccaacccatttataaaggctatgattggtgcaattgagcacacaatctacttccaacacttttagccaattgaattgctttttcaatatggcatttactttttgcctagtttctagtctagttcatccatctttgttgatttgtatagtaaatcgtctgcctttgttgtaggagtgtgaatcatctttataggtttgtcccaataaccttccattccacccacgagataggtgtttatctctattttatctaaatgagctccgctagccggttttgatttacaaaactcatcttaatttggatttgttcagatcaaggtggttggcgactcccaaattacagcaaagcattggttgtccggtcatgattggcgatgtgatcaaaaaagtttccaataagaccatactcgtctgaacatgcccattaaaactatgacaaaaagtaagatacatatagggtggagctgatgtgaataggcgcctgatcttctcacatagatactattggtttgatttatctacgtgaagacgtgtcatgagttcttcccattgattgtttttcttctgttgttcatcgagtgatacaattaaattaagcacatttgggatgaaattacatggagaggtctagtgcgtactatataactagctaggaccccatgcattgccgcaggcatatgatgaaattagaagttatttcaatcttttgccaatcaatgaaatattctttatacatgtatcgattgttacacgggtttatatatacatgacctctaatcgtttacttatctacctaaagtgggcataactcaatcatcataacataatggaggcattgaatttgtgagagaaccatttcctccattagctaattaaagaggctaacagagcatgcatactcaattcacttcaaatccactgaaagatgtacttgcagaatatggatgaacaaattccttatacttggtagcaccaatagaaaaatctcttcatagaagcggcagcaccagcttaatgaaatacgtatttatcctactcactaattggtgagctgaaataatagacctggaggctatcaaaatataatatacccaagcaagtacattggtgtaaaatcaaaggtgtttttgattattattctgtgatgaacaattggcattggagattattggttttgatatttggaatttatttgcgaagtgattttggagatgatcgggattttacaggcgatctacaggtactgctgattgggtccggtcagaccgggcacgggttgccggtcagaccggcagtgatggagcggtcagaccagcgcagcccgcggtctgaacggccgactctgtgtcgtttttgattttgggttgtttgtttggatatccgtgattgtttcatgattaaggattctagatggatactatgcgtatgtaatactgtcgtttgctactaatgagtcaagttggggatagcttggtcttggaatatggtttctttgtttgttctatgtgtaggtgactcgagatgccgaagagtatttgaggtgatggaccgggagtcggcttggggataagcgacgtacgtggtggtcagagatcatgcgggatactaaggctagagttcaatgcacgtggttggtgaagattccatatgtcatacgatggaggtattgtgtgcgtatgggatgcgcagtcgaatttggaaggagtccaaatttggtatgattggttatgtaaagtttgtttcttgtactagagggtttcctagggtgattagaacttctagtatgagtttggttcatggcttttggctgcctacctcgggtataaatagagggggagcgtgaggcttcccagtatcgctttcgagagcaaatgagttgatagttgagttagggcttcgagtttagtcgagattttttgtaaggagtgctgttggtgcactttgtgaacacatagagaattaataaagtcgtcatctattttaagagttcttcgatttgtgtttcatcgggtttcggcggtctaaccggcatcacactggcggtcagatcggcggcaagcaacggtcagaccggcggtggcagcaggcgacgggagctgatccaggcggtcagacaggagttactacctcggtcagaccggaggtatttaggcggtcagaccagcgcatctacttcggtcagaccgcaatccatcgaatttgagggtaacatttatttccgctaaaagttttcggtttttgggtataccaaccattcacccccctctggttggcttagttattgtgattcgatcctataagtggtatcagagctttgttttcttctttggattttaaccggtctagagtttttgccatggctgctaggttttcaactaagcctcatgttttcgatggaactgatttttctcatggtgtagtaggatgcaatcttacattatgactgaggattatgatattcggagaaaagtcaaatccttatgtgattcctgaacaaattaatactgctcctttaaaaactgaatttgaacaaaattacaaagctcgcaatattcttttgagtgggatttctcgttcggattatgaccgtgtttctcatcttcaaactgcccataagatttggattgctttgagtaattttcattaaggaactaataacattaaagaacttcgtcgagatcttttcaaaaaggagtacattaaatttgagatgaaatctggagaagctttggatgactatctttctaggtttaacaaaattttgagtgatcttagatctgttgattcttcttatgatgttaattatacacaatctgagatttctcgccactttttgaatggttttgacatgtctatttgggagatgaaagttacatctattcaggaatccgttgatatgtctactttgactttggattcgctttacacaaaactgaaaacacatgagatgagcattctttctcgtaaagttgattttaagtcgagtgctttggtttcttcctcaacttctttggatgttgattcttcttcatcgaagtttccgcaattgctttgtgtaatgccatgtccgatgatcaactctaacaattcgaggaggaggacctggttttgttatctaacagactttctcaagctgtgactaatgttaggtacaggaaaagaggtggtccaaatctttgctttgaatgtggtggtacggatcactttcgttcgcgttgtcct

SEQ ID NO: 62253 - DNA, 33964 bp, Oryza sativa
tccgactcagataacgcagttaaaaaaactgtgtgattctaaagaaaaaggaattatatgtgaggtagtaaaaaaaatcaaatcctattatatctagaaaggtccgtcactataagaaagtggcgaaaaaaaccattcgtaaaaaaaatgcacgagaaacaaataaaaagggcagaaagaagcatggcagaaaaaaaaaatctaatttctattcgtctttttagtagtccgtttatatctcttctatatctctaatctaaataatctaactattttaaaacataactttctaccttatattaaaaaagaaaaaaatacgtgagaaaatagaacggtttaaaaacgcgtgaggaaaaaatatcagaaaaaagcgcaaaagaaaacgcgctagaaaaaaagttccgtagtccataaaaaaaacacgcgagaaaaaatatttacatcgtatgtaaaaaaaagcataaaaaaaggcatacgaggaaaaaactgttagaaaaaacactaaattgatggacacttggtcggataggatccatcaatttttttccatctcctacacgacttgtgtttcgtcatcttttctcatgtattggacacgctgcacatctttgtaggcaattatcagactatttttgtgaagtgtagctattattcttgataacatattatatgaaaataatattagtaaataaacatattttaattgttatttagagaagagtgtacaatgactctattttgtgtagacttgaccatacgaggtagggtcggatttgattggttgcaagaatgggattaaaagaatattttagattatatgcatgttgccttatgaataattcaattattttaggtaaagcaaacatcgtaaggttgccaccatcgaggttgggccattacatttaagatgttctaattttctgattggcatcgacatggttatgcataaaaaacgtatattatcattatgtttttttcacccgttgcaaacacacgagcgtgtttgctagttttagaaaaatttagggacttgaacagggtcaatcggagttacggttgaatttctaggaattttcaaaggataaattgattttctggaatattggaaattgattaataacggaaaggaatattccattggaatattccgctaacttggatggcaatggggggcccacctgtcagcgacttgatggagggagagaggcacgggccctgcttgtcagcggcttgagggaggaaagggaggtggggccggcttggcagtggctcggcacggtttcttcttcctcctctcgctcctgctcgatcccaggcagcgtcgcagcgatgtgccgcggcggcgaggttcggctcggtgaccggcggccggggaggcggcggcaacctccggcggagctccggcgaggcaccgccgacgacggcggccctagaaggcgcggcacagcggctataggtggcggtacagagagcaaaatgaaagagagaaagaggagagagagagatggcaacggtgatggcaaggaaggggctcgggttcccctttaggccttgttcggttgggttgttcccggccgggatcggggcccaatccccatggatcaccccggcgaggaaaaaatcccggcccatgcgaaattgtgcgttcggttaagccctaccgtgaattttagcccagcccaccacggggtttccctcttctctaggcccgggaaaaaatcatctactcctggagcgtggaaaatttcctcgagtggaggcggcggcgcaacgaagacgtgacggagggggcagcgcgcggcgcgacccggaggcgacggcgacggcgacggcgacgacacggctctctcctccggccgccaccttgtctccagtgagcacgctgcctttccccttcttccctcctcttgcaaagctagggttagggttttcttctcttctccctttcctgtcgtcgccgccatctctcttctcgccgtgtagctttctggtgagtgagcgcttagcgattcgtcgtcctcctcctcgtatcctgctcgatctggtgagttcttgatttgggcgtggagctttttttcttggttgggtggggatgagttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtgactgatgctgtgatgcttgcctgagcatgtcttgtaaaattgactatacaagtttttacagtgaagtactcagttcttggtgcttccggagtcccaacttgtggttgttggttatatttctgtttggaaattacaagggttgggtgtcctgattttgaggattgtagagctatggaggtactctgtaattagtttaacatttctgaattgtaaactaattctatcgtcattgtttcacaaacaaactagcaacaaattgctgcagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgagctgattgggtgattaattctgtacccatgttataatgtatttgatgatgagatccttctatttgattgaaaaacagcagctcctactttgatgctagctagcactagttctgggttttatgtaactctagttctagttctgaatttgagttgtcagtgatgtgtataagttgtgcttgttttgtagattgcacgtgcacccattagagttggagaagaccaacctcctccttcaattattgttgcactgtgcactctttaagaaaaaaagatccttattgttcttttcatttttcccatcaatttttaaatatgcttcataacttggacttcttaagattaattcccatagtttagcgattcttttgtgattatctttctagatcttttgttgctgtgctaagtgcaaaattgtaaataatttgtgctctatctatagtactactatggatatgagagcaagagaccacgctagaaagaggagggaagaggaggacgatgatatgatgttgtttattttccctgcactacatttgttgagttctagtggagcaagggaaaagaagcgacgccatacatcaaagataacaggcgaggagcgtgttcgggagttgcttgaagggcatgtaaaaaattgccgggtagcattcaggatggagccggaaatatttatatctttggccaattaccttagaactgaaaagttggtcgatgatactaggattaaagttgaagagaagttggcattcttcttatacatgcttagtcacaatgcttcatttgaggatttgcaagagaaatttgggcacagtggggatagctttcatcgtcacgtaaagcatttcttcaactcagttgtcccttcgctctcgaagcggtttctgaagcctccaaatcctaatgaagttcattggaaaatagaaaaagatcctagattttatccctatttcaaggttcttacctaaacacttatatccttattaatatgctgttttacatttttagaaaatcatatgtggtttttttttttgctgcagaattgccttggtgcaattgacggcacccatatacccatatctatatcatctgacaaagcagctccatttagaaataggaaaaatactcttagccaaaatgtgatgatagcttgtgattttgatctgaagattactttcatgtctactgggtgggaggggtcggctacagatgccagggttcttacctctgcagtaaacaaaggcttccaagtaccccctggaaagttctatttggttgatggtggatatgccaacaccaattctttccttgcaccatatcgtaaagtcaggtatcatctaaaggagtatggggcaggtcggcgtagacctcaaaactacaaagagttatttaaccatcgccatgcggtattgaggaatcatgttgaaaggactttgggggttgtaaaaaagcgcttccctattctcaaagttgcaactttccacaaaatcaagaaccaagtgaagataccagtggctgctgcagtgttccataatattattctatcactgaatggggatgagcaatggttaaataaccaaccacataatatccatccaagcaattatgttgacctgccagatggtgatgaaggcaatgatcaaagcactaatcaagggaaaggaaaattttcacaaatcatgttttcgaaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcactaagaagaaaactgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaagaataccaaaggatggcgtaatattggctcatttgcaaaagcagcatttagcaaaacatttaagagaagtaaaaatagtggagtaattaatcagaaattttaatcaacactgaacagcacacccatgctgcacaggcccaaccatcctgaacaaccatacccggctgtacagatctaatctccaaaccaggagctaagcaaattattatcaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgttccacaatagtagctcgcgaaccggtccttaattgccatgagcacgactctcaaaaccatgtgctcacaacccaccattatcaagttttagttggcaagtaattaattaatcaatcacgattgaccatcgtgaactatcattaagccatcattaaataatagtgagtcataagttatcccaatagtgtgctaatgtttctaagcatggctaagcaattatatctaacatctagttgaaccaatatatataaagctcaactagtccaattataatcacccaaggtataaaggaataaagtaatcaagaacaaaagggccataacaaagaataagttaattccacccaatgacatttgaaaataaatgcacagttgaaataaatagagaatttaaatataggatcaacatgctcaaagggttgtttgggatctgtgtgacttgccttgcaataatcggtctttaattaatcttcttgaatacttccggcgcactcgcgaaccttcgcaacgacggaaacgacaagctaacacgcaaaacgaggaaaaagactaataaaaaccaaataaacaatacataaaaagtaaacaaacatgtagattataattttagatgaattatgaggcttgaacggcctcattctgatttcatatgaatttattatgaattttacaagatttaattccaattaagcctattaaagaaaagactattccaaattaattaaacaatttacaaatgatttatagctgagacagaagattaaaacaacctccggaaaagattagatcatatttggtagatgacatatattaaaaaggaataatatgtcattgaaaagaacggatttatattgattttggacggctgagattaatcttgaccgagagttgaccaagatcggatggcttagattgatctggcaagcgggcctcacgagataccgactcaacgagtcaattctacgtgacacgggatcacctaaatgatcaaccgaaaccggcgaacggaaccggcggctctgaactaaaggacgactcaacacggacgaacgaacgaagcacggggaacacctcgttcgaacgaacgagcgaacgactcaacaacggctgtggctaaaccggtcggctagacacgattcacggtaaagccctggtacgacaaacgataggccggtaggaacctagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagcgactaagcagcggtggctaagaggctcggtagagcgacggcaaaccgcagccgcacggcgtgcagcagctacgacacagcgacgacgacacacacggagacgatgatgacgctagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacgaacggcaacggaagatagccggcgacgagcttcaaagggcggcgaggtactgtccacggaggcgatgactttccggcgatgtgcggcgacaacggaggggtggccgggcttcacttcgcagctgcgaatccaatggagtcgatggcgacagagggcgatgacgggaggagcagcagggcttcgccgaagatcaaaacgcgacggcgaacttcgggtttacggcgacgatggagctccggtggattttggcttcggggagatggctgccgggcttcctctccttcttgcgaacccaacggcggcagcggcgaccaaaagcggcggctaaggcggctgctagctgcggctggagacacagcgaccacggcggcgctctggttcacgacgacgggcaacctccggtgggatttggcgcaaaacaaccggtggccgaggtagctctcacccttgcgaagccgagggaggcgacggcactgaccggcgatggccggggcgacggcgcacggcggctggagcggcgccggcgacgacggcggggtggagcacgtggcggcggcgctacgaggcacgggagaccacgggagagggggcaaacgaaagaggaggactagggggtcctttatatagccatgggagctcgggtccgggcccaaaacgacgggaaaaactcgggaaagtttagatcttcgccggaaaaaggaaaggttgaaccgcgaaattggaaaggatttccatagaaacttttggggatttcttagggaaaaggaagaggagattgagaggattccattcccgcaaccaatttggaaataggagcaacggggaggtcggattttggaaggtaatcggcggcactgtgcacggcacgggagacagtcggctggaggaggaagatggagtactgtagcgccagggacgaaaaacagacttctatgcggctgagaggaagggagagaataggagggaatgggctgaattcggcccaagctgaggaggaggatttttattacttttccaaataaattaaccaatgagatgatctttcaattgttaaaaatattccaatgctcaaataattccaagaaaaatcttgaacatacttggacactcaaagtatttaatataataatatccagatcatttaatgattaatttattttttaaataattgctaaactgttctttgtattattaacattaggaattgagctccgaaaattccgagaaaatttcagagagtataattaaccatggagaatttaataaaaattaaatccatccatgctttatatttaggaaattttatttcccacatttaacttcacttgtaaattaatgaacatttaatataaattctattaatgatttattaaataatttataaatcctgaaacgaaaaacaggatgtgacaactttccaccaggattttagggcagcaagccgaatagagtatggctgtggaaggtctacaaaaaccttgtagggctcgcttatgttatcgttagcatgagggaatatatcaccactgtctgatgtgaaaaaatctatggcctcttccatgagggactcaacagtgttaccctctttttcaattcgcaagactaaattccttgctcgttctacgtaggactgaagggaaatactatccccttttttatctccctttcctgtccttggaacgtgcatatcagagctgactaggttgttagggcctgtttggtataactccaactcctaaatataactccaggagttgagtttagagtggagttgtggagctcctaaacccagctccacaactctagtacattttgtgagagagctccacccaactccactcccagttttagtggagctgaaactgtttggctgagctccagctccaggaggggtggagctggagctggagctgtgccaaacagggccttaatgctggcgctcctgagagcccatggtttctcaatgcatttcataactccggggacgaacagcacaatagctgcctgcaacaacttcttgtcgccgcctggccatgacttgcagaagacgtagatggacacggtgatctggcatcagaaaagtattgttttcagcacctaggctcttgcatgtttctatatggacttctagcataagtgcataacaatatatttaaccattttttaaaaaagaaatctataactatttaagctacatttactactagctagaaaatcaatcatcagtaacgggtcaaaaaagttatgtgtaatgggtgagtgaaccgataaaaataattggtcagtgctgagacaagtcaaacatataacggttaattaaattctatttgccactcttacaagtgacacaactaaggatttgggcccacgtgtcatagactgcgagtggcaaatctttaattaccacatcttaaaagttgcaaaaagttaaatgctgatgtgatacaggttatctataacggttcattacatatacataaaataaggaaaaaaatcctagctgctcatcgatgccaccgtggtgtacaaacaaactagaacaaagtgtcctgtccataacgcttcggcacttagaggggttttcggtgcaaacgagcctatttaattgataggataaaactaagaaccggtatataaccactcattggtgtcggttcatgaaaaaagttgacaccaataatcccaccaagtgataggtgcagggataaaccggcacatatcgatgtcaaatgtgtcgatcggtttgcaacaaaagttagcacttatgagtccataggtattggtttataattaaaaccggcacatatgatgacttcactattttctatcatataaagtcagatgaagaaaattttatatcaaatttgtagagcttgaaggtatctataacgtagttataaccttttcatttaaggttgcctggatgtctaaaaatgtgttataaattttcatatttaaccaagaaaattttgaaaatttttaaatgatctcagatgactcaaaatctatgaaagttgcagatcttgatgagttctacaactttatagttgaccacattttcatttaaattaatctatgttcttaaatatataattcattaaaagggagtagtggtagtggtgagtgatgaatctgtcaccacccccaccaccaactccctagtccctaccgttgtttagagtgaagaaatgacacatgttgtcaaatgacccatatgtcaatcacccctactttttgtgagaaggacaaatgatattgtgaggacataggatcaatatattaggtacaaatatatgtagaatttaataaatgatgtataccgaaaataataagaataactggttaatgatcattttcatcaattaaaatcctgttacaacacacgggcaatatgctagtgtattataagttttgtatgagagttgtctcaaatactagctaggtgagatggtaaaaaggctttggatgaagagagaggtcttgggttcaaatcatgctaacaacatgctcacaatactgccaccattaagagtgtcatggtcgccggttttataactaacaccaatgactaccctcaatacttccactatatttatgcccgttctaaaattgacacatattaatcgggagttcagaaccggcaccaatgagggtgtctctactagattactactccctccgtcctaaaatataagggctttcggatggatgggacacatcctaaatcaccgtcgctgcatccactcccggccacctcttcgtctgcggtgccgccccccgctgcatgctcccggccagaggagaggaagagagagagagagtctgcggtgccgcccgccgctgcccgcttccggccaaaaggagagagagagagagagagagaggggaggagaggaggaggtgaaaataatatatggagaagagaggaagatagagaggagagaggaggtgaaaaagtttgaagttgtgagagggaaaagagagaggaggggagaaaaatatgtgaagaagagggagtattttcgcatgtggcccatttaagagacctgcatgtgaaaataggctcattttgcatgcggcgccttaggcacgcctgcgaaaatagttttacatgtgggcctcttaaggagccatatgggaaaatggaggttgtttttttgcaggcgcaaccagttacggtccgcatgtaacctatagggctcctcatacaaaaaaattatttctgtagtagtgatggtagtatatatagagtcctttaagaaacaagtgcaaatgcacttagagcaagtacaatagcaggctataaatacatgtggaggagataaaagagaatagagaaaaaaaagtggcaacaaatttatagccagctgcaacacgaactctaatacgttctatgtgtatgggaggttggaccagataataatggtttaatatatgtttatatgcaaatatagtataaatagactattagattgactatagatgatgtgtcattttttggagttacagtagttgactatattattaaactttcttaaaaatccatgtctgacctggcacgtcatggtgacgacgttcctcctccagagctcgttgtcttcgatgttgtatgcagtgatggagtcttgtccaccaagatggattaggagaacgggagcccacaccacttccaggatgctgctattgccctgttctgtagaatcttcgttcttgtggcggttgaagagggtggccagggcataaatcgccatggcgtcgctgccaaggtaagcaagccatactataaatctgaaccggggataagtaatatgcttacgcctgttagcagtaaggaaaaggagcagttgaatgattgtgctggcaatgacgaggatgcgcagctgcgactcctgccaccattcaatggcacttgagagacccattgatctctctccctccctacctacttagctatactatctaatatctatcaataatatcgcgctctgtagctctctagctatagctacctattaatacagggccaagaagtgtgtacaggccgtcagaggtcgactgattgtgttgaccttgattcccggctaatccaatatagggtgtgtttagttcacgctaaaattagaagtttggttaaaattagaacgatgtgatggaaaagttggaagtttatgtgtgtaggaaaattttgatgtgatggaaaagttggaagtttgttgaaaaagtttggaactaatcaaggctacctattaatacagggccaagaagtgtgtacaggccgtcagaggtcgactgattgtgttgaccttgattcccggctaatccaatatagggtgtgtttagttcacgctaaaattagaagtttggttgaaattagaacgatgtgatgaaaaagttggaagtttatgtgtataggaaagttttgatgtgatgaaaaagttaaaagtttgttgaaaaagtttggaactaaacaaggccataagtaagccatagtccggagtccgagcgatagctgcagctacgttatcacatgcatcaatacttaagttgcactaatgtcaattatattgctcgattccgctcgactggggcgccctagctagctaacagaatcgttcgtatattttgcttgactgtgctcttgtggacttgtttaagtcttaacatattactatttgtttatactactagaatgggttcgcgtgctacgcgcgcggcaaaaaaaaatattagagagaacaataaatattacgtgaaatattagagaaatatagcgcatacataggtgcactttgatatgtcaatgatgatttatcggttacatggtacattatttcatagagcaccaatatacataaggcacaaagagggggaaaaataattgtaataagaacccattcagacagtacagacccactataagtccatgtgcaagcttcttatcctattccaatccacaaaagaagcacaatagcatgaatggctgcctggtcatgcaaacatgaaagggttatacctatgttggaaaatataactcacataataatttctttacaaagcagtcttgattgaacagtcataacatcaaaccaaatagaatgaacataaaagaagaatatatggaacaggaatgattattggtacgcatcaccatggttttgccatgctcctgtgacatactaaacctaaaaaaagtgtttgtgctctagaataacataagaccaaggacgttgtgatttattaatgttttataaagaaataatattagttatttagtaggcaaccaagatttatatcaaacctttgaaattacaccatggtatgggtattgtttagcaatgatacacatatatcactataagtatactatgcgagcacacatcaaaccctatagcagggtaaggatgagaagttcaatgtaactcctaggagtagtataaaagaattagaacttagaagagaatggtgcaaacaagaataagaatctcatgatgctaagtttcttcttagtatctcactttttccttttcaaagaagtaagagcaactcaggtgtattgaacaaggtaacaaatcaagtataatcaccctttgtagcgcactcatgatcaacttttggtttgggcacagaatcagcacgaaaaattgctaaatatttttgatgtggcagtctagcatcctttagaatttcaacttcaaattcaatgtttcagaagaggcaaacataaatagtgaaacgcctgcccaaggataaaatttgataggaggtaataatcacggacaaaaatttgcatcagcctttagtcaaaagcaagctggggtagctaaagatcaaacccaaggcaaaacgcatgaaccaaaagggaacaaataatgtactaataaagtaggataacacaacatatgagctgagaatggctaacatcaacaaataggattcttcagtcatttatcggtttggactcaaaaaagcagcattacctgggaataatagttaaatttatcaacccatctaatcgaacgtgcatgtggttacttcattgcgtgctatgaatgctgttcctggtatatattgcgttgacacttgttggagttctaattacaggatcttaggctttagtttacaaacaatcacctcttatttatgcggaaaaataattgatctaatgacctgtgtttgaagccattgctgttcttctttcttcttcttctagagatgcctcacaaaccccttccagtgcctagatcgatcgggcgattaatttagggtttgagattagagagagagagttcggtcaacagcctccttccttctctttctttatataggcgacactagtggggctcgggggttatctcaattagtttagaattcgttttctgtaccgatcacacaaaaaacgaatttatctcttagtttgtttcttgttaggataaggaaaccggtggtttagatcctctcctaacccttatcgacacaagtcgacaaaatcaaccaacaacacttagatacacaggtacacaggtcttaaaaaaagagcacataggaaccaactgacctggtgcgtctaggccgcctcaactaaatgtgttccatactcctgaagcatctcatagagtaacaggaaaactttcgaccggtctttacgacttgagcagttttcatctgattggctcgtttctccgatgccaagggatctggcctctttctgagcccacctctctctttttgtcattgcagtatttggtttgtcttgaacaggcagagcggcggacctcttcctggagcattgctgagcggcatcattcttagatgagggaaagatgtctagtgatattctcaagatgtacaaagcctgcttcctcactaaagaatccttgtcaacctggtgtgaagaggctaagcatgtcagcacaatcaacaggatgagtataaagagtaaaaggctaacataaactgagtcggggcagaaaggcccaccagtcccctgcgaatttcatcccaaaattcattggaattcctaagatcatagtcttggggctcgtgaggtcctgagaaaacatatttcagtgttgacaagtagagagagagagagagtatgttataagcatccaggcactcagcaggcctcagtgcaaagagagaatggcacgaggcccatatagactccaagaagccagacctgcacgagacaaaccatcgaaattaacatgcacagcatctatagaagatagaaagctgatgaggagcaggccaaccttgagagcttaagctgatgaggtgcacctgtgactccaggtccataaagaggattgatgatacatgacatgaggtgagtaccctgtatgtgatccaatgtacttaaggctgagaattcaagagctctggctgtccaagacacgaccagcggcaggaatgtcctgcactacagaacttctgcacagtacagtgcgtgtttagcatgctttcttgcaacaattcatccaccatgcattacttttcagttaacggattacacaaaaacaaaactgggagcaaggtcatcagacctgttaattatcacataagatctcttccaatcctgactgaatctgaagtaaaatatgaaagaaacaactctaattaagtaccaacaggaagcctaaacaaaaaccatagatccataaagtcatagagaggatttgatgctacatgacatgaaaatatgagatgagtactttctatgcgattcagtgtactcaaggctgggaacgccagtccaagaattttttttttaaaaaaaatgtgttggctagaaggagctagccaaccgatggaattaagataggaaaagtcacatattttcaatccttcatttgatccagacgaaaggtgaagggtttaggagtgttgacaactgaacgcatgtgtcaactgcaccgtaaacacatctcctagtccaagaatttccaaggcaagagagagctgtgcatgtttaacatgctgccttgcaagttgcaatcatttatccgccatgcattattttgctcttcactaattctatgtcatgacaggaaaacaaaagtgggagaaagattatcatacctgcgaatcaccaaataagatatgtaatctctttcagtcctgacgagcacggaacacctggaactatacctggaacaagttgagtttctgaaaccagcgaagagctaatgcggcacagctgcttctctccgccctcccgccgccaccgcatcgtgcagaggataaggtaaagggtgcacggagaagtcgagggagcacgagcaccatccccggcgccagagcccggagcgagggcaaccaaatccaccggtggggaggcctagaccattagctccgcccgtcctcgaaccagatcgggcaccgagcggagtggagagcgtgaaggagcgggaagcggtgggcgcgtggagatgaaaggggagaagggggaagcgacggccagcaccactcttgtccgggtggctggatcttccggcgcggcgaagatggctagaagagcgtggagctgcggcggcggcggcggcgcatgcgaggagaggagaagggtgaggcggtgcgtgggagggaggaggtgaggcggcacgtgcgagcgagcgcgattgcgcgagacggcgagagaggagaaacgggcgacgtgggaggctcagctatagctggccaaatgagcggcccggcccagcacggcacgggcccaccaaaggcacggcccaatagggcacggcccgttaggcacggcttcatagcgggccgtgccgtgccagcccacgtgccctcccccggcccaggcacggcccaaggggatgccgtgccgtgccgtgccgtgccggcacgagtccattagtggcacgtgggccggcgccggcccgaaggcacgcgagagcccgagagaggaagcacctggtgcgaaaagtcgcgtcgtcgcctaccacccacctggcgcaggacgcgtggaggcgaaagattggagccgtggctcgcctgacgcggcgcggcgacaacgcatgcatgcgtaggagcaggagatttaatggtttttgacgtccccgaggtcattttgggggaagtatcgtgtgccacttcccagtgggagaatgcaatcagcaaggtggatcaccagatgcgaaatgtgcggcttggattgaagcgggtcatgagctaggatcactttaaaatatatgcagatgccccccaaagtgtcagtgcgcattttgcacgcaacaccccataattcactctcttctactccatagtccccacgaaattcccctttcatctcatcgaatcaaacacaatagagatgaaggcgaaatgtacgcgatgccgaacgactccctcgtcggccccgccacggagtgggacaagcggcgggcgagatccaacgagtggctccgccgcgcggtctacagctccgcccgtgacctcgacgacgcgcgggccagccccatggccgcgcacgcgccgctccgcttctctgttgcgccgacggcagccgccaagcccaaggtcgtcggtacattttttaaactttcaagtttcaatgttccatagatctagaacaactacctttccttttgtaaaaaaatttttcagggattttttcgttatgtctaccgttggtgctgatatgatttttattacttggccgaggaggattcaacatttttatccattcttcacacgaggtagaagcagatctcggtttactgctccagattcttgtgaaccaacggttaagcgagtgtaggttacagaatgagttatgtttgtacatgcacttttttttgttcttatatatgatttagtttctttcgtccttgtcctgaaactttctgtaatgttccactctcaggaaagcttccactgaaaggagagaagtattctttgaggctatgtctgacaaagtagcagatagttcttctgagagaacgactagtcctttagaatcagacagcgacgcattttataaaaatcttgatcccctcttttctgtattacatttttgtaagttgttaagttcaaaaaaaatcaagaagaagagttaaaagattaaattgaattctgcagggtaaaccagattaaaccagaagatgtggttgcccagcgaggatgaggctgctgaaatgtgctactggtggttattatgtcataacattagatgtgctactggtggatagatattaacgtttacataacattcttcttctttttgatcaaattgatagggaaaaatggtgcaaaacgacgtacagtgtgattcttgataacacatgtcagagttaaatgaggggaacaaccatgggaaggaatggatcaagctaaaacaagaactatggttcagatcgaagccttaccctaacatcttgggctcctcgctgctccacggtgacctttccttcttgccacggatcgatccctgagctctctccccaccgaatcgatccacttacctttccttctatctctgtcccagacctcgccgccaacaagctagcggcccctcaccccgccgcataccggctagaaacacaacggcgacgaggtgcactagcgcccaacctgagactgcgctgccgctcagtgcgacgagccgaatccacagtgtactagaaaccctagccctcaatggggaaagctgaaatgttttggagagagaggagagtcaaatgttcagccttggcttctgctataatagagggactgaaagcattttggcacataacatagggacatttttgcataaacaaccaacaatgtgggaagtgtttcgatctgagcagtacacttttcatccgacggtccacattgaagattgcatttctcccaccgaatagtagtattgcaatggatacttccccggtcatttgaccaaaaaaaatgcgaaaagaaaaaggatgcacgttggttgggtacatgcatgtttttgactgcgtccgcctgctgccgttgggctattgcgggctgtcaggctgtggttggtggctgggggtggcgctgcgcgcttgtgccgtgccgggccatgtgacgtgccgtgccgtgccgctacagtaaccatgccgtgccgtgctgacccacgggctttggcgtcggcccaggcacagcacgcccggccgggctgtgctggcacggcccattagctcgcgggcctgtgccgtgccgtgtcagtttgtgtggcatcgtgcttgggccggcccgacaaagcacggcccatttggccagctataggctcagcggccacgaaatcgacgcctcggcaaggacgaccaacagggaggcacggacggatggatgaggcccagacgcagaatcggacggcccgcaagacgccgaaccaacagcaacatgtctcaaggtgattggtcaacagtagccaaatcgctgtgaggccggctaatctagcacctttaagatatttagtatgtgtgccaagctgcgctataggggtgggtgagccagtgtgggcttgtgtcaactcttacagtgtatatatttatatatactcgattactagctagaaggaagtaacgtatataattaagattaaagtaaacggcacaaaaccctaattttggcacatggcatgcatgtataatatatcacgggtcttatggtattggtcgtgcttcacaaaaaccccatggttgaccaattgtaccaaacctgaactgtagggttcatattaggcttatgtggcatgtccacacatgcgtctacgtgtatcatgactaggatatgcatgcgtggctatcccgaaatttgatcttatttatgacctagcccagtaaaacatactaaaccgattacattgaagcatggtcgttcacgatcttgtcataaatactgacgcgcggtcgttgatatgatgaatgtgttgtagccactagatcctcgagcttacgcttgtgatccttgtaattgattctgctaccacacgccccattaattgctgccactgtccttggatttccagctactgctcgactgcttggaggcccgaacagcatcatcggacttagcatactcgttggccttctcgaacatttgcttgaccgtcctgggaggcttgcgtccaaacttgccgacgagtaggtcgttgcgaaccccttttgtaaacgcagcaatgatgttgtcgtcggtgatgtcggagatcttgttacgctgctcagaaaaacgccaaatataatccctaagagattcatcgggcctctagatcacgttgtggagttcgaagtgtgtgctgggccgctcgaaggtgccttgaaaattggcgatgaagtggtcaaagagctcgccccaagaaccgattgtgcctctgttgacggtcgttatagaccaatttcaaccatcaatataactataataatggagaattgactatgcttataatgcatatttgttttagaataatatagttccacttgtacttggagaataatttgttgcaggaattgagcaaataaaataatgaagaaatgaggaaaactcactcctatgcaagcatatggataaggagggcccacatgtcaggtgtaaccgtcaggaaaccgccttaactgtcaaaaccgccataaggacctacctgttagccaccatgccaaagctggaggcctgttgggccggcccaggttcggccgaaccctagtggtgatggctcagccgagccctctacgtggacgtccaggatgcactctcaatgacggttatggggtaggaaggtcatttcgccttttctacaaccgtcataccgtccctataaatggaggagctcatttcacttcacaacacactcaagcaagctcaagattcctctcatactttattttagtagttttagtgctaagtggagtagtatagaatagttctcatagtcctcggagcttccggaagagtttcggtatggctctattagcttttctattctcttctgtaatactttcggaattaatgaaaaactcttctttatttatacttggtaatttacttagtacttggtactttacttagtatgagtactgctcttactttatatttgtgtcggtataattgtgtgggtagcctaccagagaagtgtaatggtgtgggtatagtgtccgattcatcgactactctatatcatctgcagaggtgtagagtagtatttattaatgtaaccatggtgcttagattagtaaatatcattatctgggcatatatgttgtgggatagtagaggtgggtcgctgatggtgacagctcagtatggtattcctctacgttagtatatattcataagacaaattcctgaggagggtactcctccgtatttatccctggttggacagcaatgacaggttgttgtaagaaactcggcaacccggggtggtctctcgaaataccaggagtgcactgttagggggtattggccacatgattgtatactagcaaatgtagattagagtttgagtgtatattagaagtataggaaatgagttctttctatctcttctcccacttaattagaattatttatttgaggaaatctataagcttcgcttcgtgtcactctacccttgtattaaattaacccctgcctagactttgatgaaggcaagtaatatatatatgtgtatatattagcatggttctctctttcacaatcttcccttgggattaaataaatatgataccttgtaatagttccgggtgaaatgctacaatggtatatccgtgcgcttgcggattacttctgtaaccataaatataccagggttatttctacgccattgttgggaatgaatatttctagtaatatcgttaagaaatactaatagcctcgtggtaacccagcgagccagttccgggccgagtcaacaaacgcaacaggtaaataatacgccattgccttgctatctcctcctgctgcttggattgcgagagtgtagatagtgagccacgactcggggtcggttttgccgtcgtacttctcgataccagtcggcttgaagccagtcggccaatccactcgacacatgtcacttgtaaaggcagcaactccttcatcgttcgcgtcatagcgatccggtgtgtggtgacgtcgtcagtcgtctctttctgctcggcgacggttaagggtgtcacgtaggtcgacaggctgccgtggacggggggagcgaggccgtttgtggtcggcatgatgctctcgatgtctgttggcggaagagtgaacggaatgctctcgatgagccctgcccccgtgctgtgatcttgagttggtgacgttgagacttggttgacaataatcccgagatcagagtggtgggacccaaatgcccgacgttgtacgaactgaaccagagggctgccgagtgcttcccgagtcaactaggaccgacgcggcgatcatcgtctttgtttgattcagaatttgagcgacattctctggtgctccggtagccatgagggtatccaagagcgcgattgctgcaaccgtgttctgctgtggagtacggaacacattagtgccatcaatgttctgttatccaatcagctcacatgctcaacgcccagatgttgttaacaaccaaatttggtaatgccacgccatggattcaaagctagagtcaaagccgatttgaagaaattccgttcgagaaagcagaatacgcatcggctataggaggtatcggctaccacatatcgattaagtgacagatccgacagagttaagccgatgcaaccagtctcaggaaagatggacccacgtccgtcatcgggattggtcgaagcacttcatagctattgccacgcgaggattggagtcctaaaaatgggcaattatatctattaattaggacatttttcagtttccttagagatatgtttggtaagggtccacctaaaggacttattcgtattttaagttgtgttagagataagagtcgtatccagcaaggacatattatgtacttcgggtataaatatgacccaaaaatcatgtaatcaaatgatgatagttcaataatacttcggcgcatcgccacccttttctattttcgttgtttcgacgagtttttgctttcgagttgggctgcatcgggttcgatctccgacgaagaggtaaaacttgttatggcggtttgcgttctcgggattagtgcttacatcttcatgacactctaatcatgtctatgtaaaccgccgagttatcatatataccgcataatctagattgatctcgtcatctaaacttcatcggctagcctctatcatcgaaaatggctgccaggtttaggtctcgatatcaagctagactatgcggtgtatctaccatattgaatgagttttcatcgatttgcttagatcttatgtttcttttcatgcttaatgctgcatcagttaggttcgatctgttaagtactgtcttgaaacattttatctagctctttctttgattgctaatagagatagcatcggagtttcagccgatcttacctgatttagtcgtcttgttttcttatttggttctggatcgtctaaatatgccccttatatcaagatctcacccgttttaaatatattaagcttcctatcaatctgctagttcaccctgctcattagattggtttcagttttgtatatttcatttgtgctgatatcttggtataaagtggtatcggagtaatagccgatacaggttaggtttgcccgatcggctatgctgtgaacatatataatccctactttggggcacatttagatatggagtgatttatactgtctcggtgcagcgaccgatcaatcccaatcactcaatctaagtgtgttccattagctagattatgtatcgttaacatctacagccgatcgagtagacccaacaatcttcaagttttatctgcctctgccgatctgacgcatcggcatggcctcggatgatacgtcatcggcaatcgtgccgatcggctatcgttgatgaatttaactctttgtcttttctctatcttgttggttgcaggatcaaaccagctggcacgctcagaacccgaaggcaatctctttggacctacactagagttaagcagatttctcaggccagtgcgtgtttttcacgtcaacagatgccaaagcatgttgccttcgttcctcagcctctcttgctagtcgcttccattcttgctgctcacgcagcaatctggcttgcccttgctcttgccgttcccactccaacctgagtcgctcggcttcttaacatgctcgttcctcattagcttcacgcacgagccgctgttcttccgtctcattgtctgccataaaaacgttgaaaaagagaggagtatagtcgtcttcatagttgtcgtcgaattcttcatcaaggtcatcgtaatcgtcgaaattgtcgaagtcatattcatcatcgaagtcaccatagtcgatagtctcagtcggagcgtaggaatcgatgcttggagtgttgaggtattcttcgatttcttctgtagaacacgattcgagtcgttgaaggattatgccgacttccttggagctagatccgactgtggtcgaagccgagtcagatctaggcctacggggagaaggcgctcttgaaccaaaaacagtagctagatcatctggtagccgcatcatgattgatggataaactgtgctgtcttgatctaatcttgaagatgaaaacgtcgaggtcccatctgagtggtttgaagccaagtcagatgagaaaaccctggagtagatctcggcctagtccgggagaccgaatggggcgagccgctatctcctcccgactggttcgaatccgaatcgagaagagagatcttgctgaagctgtcggtggtgaagtcgaggctaccgaactggtacgcctgcccgggagggaaggcgaagtcgtcgatgcccgaaacgaatcgcatcgcactagtcggccaaacacttgacgcaacacctacttgacacaccaactgttgaaataagatttcagcaatactaaaagggggtggcaatcaagctagaaaagtggatgggtcaggagacaaaggtttatacaggttcaggacttctcgatgagaagtaatactctactcctatccggggaaatatttcgccgagtgtattattgatctgacgatctgggggataagtctatgcccctaggagcacccgaacccctccttatatagggggaggtgccgagattacaatgtactacccatatgccttacagcctaggctaacagatatattacaattgtaactaaccaggactacgggatatttccttgatatacaagttagcataatacccgagtcctttcctaacataatctatctacatagtctatcccccgcaaccagtaggatatccatgctatgcaggtatatggtacccataatctccacaggcgggataggcgagaagttggaggtctagcggcggcggcggatcagcaaggcaaggaggtccgccggctgcggcagctcggcaaggcgaggagagtcggtagcgacttggcgaggaggaggaggccgggtccagcggcggctcagcaaggcgaggagggtcggcagcggcttggcaaggaggagcggtggtggcggctcggcaaggaggagggccgacagcggggttggtgcggttcggcgaggaggaggtcatgcggcgcagtggcttggcaaggcgaggaggtccagcagcggcagctcggcgaggtgaggagggccggcggcagatccagatccagagctcctcctgtcacgcccggaaattcactagtaatttccgaacttatttgtgcataaaatcctcgtccaggaatcagccgaggtacacaaactgacaatttaatatacagattcatcaaattaactaaaaacgataaatacttacttatgaggcacttagtcctcaacaagaagaaaactgcagcggaaaataaaatctagcgaagctccggctccactcccacaggcagctcaactggggtataagccaaacgtcttctccttcgggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgtacaggcccaaccattctgaacaaccatacccggctgaacagatctaactccaaaccaggagctaagcaaattattacccagtataacatccatagttatggtgagaggtgtgggactaatcacgaaaaacattgctcaacccgcccataaccgcgggcacggctattcgaatagttttactctggccagaggtgtaccactgtacccacaagacacagcctcaacatcatgtctaccatgcttcgcgatactggaaagtacccgaatagaggctgtgacaataccctctgcataacacaactcaccacagtgcatgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacaacagcggaattaacggtctagcgatggcttcagctccactcccacaggcagctcaactgggatataagccaaacgtcttctccttctggatcctttatcttcaactgaggtttgatgattattgcaagaatgagcatatgacatactcaacaagccacacagcaaatatgcaagtgcacaaggattccaaagaatggcataatataggctcatttgcaaaagcagcatttagcaaaacatttaagataagtaaaacagtagagtaattaatcatcaatttttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccacgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgcggacttctcgccacttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaatcatcgtgagctaccatttaatgtaaccataattaataataatataacatagtttataattaacccctttagttagctaatgtttctaagcatagctaagcaaacttacatatagcatttagctgaaccaatccaatatataaggttcaagctaatcaatttattacccaaggtatcaaggaatagagcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaatcttcttgatcaattccgacgcactcacgaaccttcgcaacgacggaaacgacaggctaacacgcaaacgaagaaaaagactaataaaaaccaaataaacagtacataaaaagtaaacaaacatgtagatcataattttagatgaattatgagacttgaacggcctcattctgacttcaaatgaatttattatgaattttacaagattaaatctaattaaagcccatttaaaaagaattaaattaatttaattcaatttatggacaattttaatatgtagatctttattttagaaaaatttagcaacttgaaccacctgaaacggatctacggttatttagttatgattttccgaagatttaatctattaaaagaaattggaaaaaaggaatcatgacgtcatgctgacgtcatcatcgccagcatgacacgggcgacgacctcgccggcgatagagaggtcggccggcctatccaagggcacctacgcgaagaggacgacgagacgaacccgatggtactcaccaaaacgtcccacgacaaccgacgacggccggcgacgacgcaagaggcggcggcggctcggttgaacggcggcgacagctctccggtggccggcggcgaagggggacaggcggccgggcttctccaccccttggcgcacctacgggcggcgatggcaagcggcggcaacggcgaaggcgacgcggcaagcggcggcgacgggctagggcgacggcgcggcgcggctggtggttggccggcgacggcggcggctaaaacgacgcggcgacgactctacggcgcactagagagctcgggaaagggggcaaacgaaagaggaggactagagggtcctatttatagccttggattgaagagatcggactcctcccgcaagaaatcgatccgggcaatccataactcggttttggagataaactcaaaaacgagttcgattcgggcaagatacacaacgatttgctccgatttttgaggggaaagatagaggaagacgagaggataaaaacccctcaaaaatccggaagaatcggggccggattgaggcggatttgaagcggcaaagcggcgcggtagggcggctcgggctcggctccatggccggctggaggttgaaggagctcccgacaggtggggcccacctgtcggtctccacaggagggggagggctggcggcttggctgggccggctgagtcggctgggccggctcggccgcgggcgggagagagaagagttgggccggaaacggcccaacaactttagggagggattttggaactttttcaattaaaataattcgtgaaatgatgtttcatttatttaaaaatacttcccttgctgaaacaattcccagaaaattctagaaaatagaggaacaagcaaagtatttaataaaattttatctaacccaattttatattgagatttagcaaattaaaattagatcttctcttttaagcttttaaaattatttctaataattccttttaaacaacaatttataatttaaggatttttaaacaagaaaagctcttaacaattataattagatcatttaatgattaaataattactgaactgttctttgtatcatttaggaattgagctccgaaaaatccgagaaaattctagagagtataattaaccatggagaatttaataaaaattaaatccatccatgctttatatttaggaaattttatttcccacattttacttcacttgtaaattaaagaacatttaatataaattctattaataatttattaaataatttataaatcctgaaacgaaaatcagggtgtgacagtgcaccattcctggatcataatcacccccttataaaacaaggcatggactccccagcgacccccgtgggcttatctccgccacttctcagtctggtgctccgcaatgaatcatgctatacaaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaaaccatcattaaataataatgaatcataagttatcccaatagtgtgctaatgtttctaagcatggctaagcaatcatatctaatatctagctgaaccaatatataaagctcaactagtcaaattataataacccaaggtatcaaggaataaagtaatcaatgcaaacaggccataacgaaggaataggttcacaccacccagtgacattcgaaaataaatgcacagttgaaataaatagagaatttaaatatatgatcaacatgctcaaaggattgtgtttaggatctgtgtgacttgccttgcaataattgttcttcaattaatcttcttgaacacttccggcgcactcgcgaaccttcgcaacgacggaaacgacaagctaacacgcaatataaggaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattagatcggattaaaacacttatattgattttaattgaattatgacgcaataatgaattatttttgaaaaggaaaaggaggattattgcgtcagcggctagggtttcggtggaccgggtgcacggcggcggttcacgggaacggacggccgagatcaaccctatccaaaacggacggccgagatcgatcggtccacgaccggctcacgggagacggggacgatgacgtcagcgatgacgtcaccaccggcggcggcggctcggcggctcggacggcgcacgctcgccggcgaacggcggctctacggcacaaacggagggcaccaagacgtagagggcgacgcggcgaactcaccggtgaccaaagaagcagcggagaagcaacggacagcgccggcgacgaggaagaagcgacggcggagatcgggttgacggcggcgacggagctccggcggtcttcggcggtggcgaagcggtggacggggatggcgacgactttgcgaacccgatggtggcgacggcgaccgacgacggcggctgcaacgacggcggcgactagggctacgcggaggcggcgctagacacgacggcgggctaaggcaaaggtggcggcgggtagaggagacaccgggggtccttatataggggctagcgagcggcgacggaggcccacggcgatcggcggcgagaaggaaagatcgggttcgggagagagagagaggaatctgattcgatctcgaatccaccggtttccaaagaaaattagccgatgtttccaaaagagaaaaggaagaggagatcgagaagattgtttcccctctatcaattcggccggagaaggaaaggatcgaccgaattttggaaagcggcggcggagcggctcggctagggtttcgggcggcggcggcggcgctaggaggaagacagacctgacagacgggccccacctgtcagcggctgagagagagaggagagcggcggctcggcggattgggccggactgggccgagggaaagagagagagagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttctaggcttttaaaatcatttctaataattccttttaaacaacaatttataatttaaggattttaaacaagaaaagcacttaacaaatataatttgatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaacatcatttaatataaattctaataataatttattaaataatttataaaccctgaaacaaaaatcaggatgtgacacctccattgttcttctttctctagatcttgatccatagtttctttttttttcactttatttatgaggactatgtgaatgttgttcttctcatttgtatggtgatatttgatatgtgaatcttattcttctcatttgatttgtatggtgcttaatctgtgcaaatggtagctggatggggatattttcagatatattttgttgcccaaaatattttcaaattatttttgtaggtggtctgctttagatgtccagcggaccggttaacggagtcacctggaaaaataattttcgtaaacggacaaggggtccgcttgcaaaaaatctttgatttttgcaggcctctagggacagacggagactatgaccgcctgaaaaaaaaaattctagtaatgaatggactttttgcatggggtgaactgatcttgaataagaaaggtcaattgaagatgatgataaaaagaagacaaacacttgtacgatagcatgtcatatgatgttaatgaagctagacaaagatatatatgtctagattcattaatatcaatatgaatgtggaaaatgctagaatgacttacattgtgaaacggaggaagtacttatattcgttgatggaaattggtaaaaccgatacattttcattcgcaaaacgtagaattcttttcttaaaaataaaaattacctgaaggtacagcggaatttgccctgaatgggccacaacaccgtgggctagcccattgcccagccctgcccagcgcagtcaacatctcctcctgatggaataagaccactttgactccctcaactgaccaccgaatctaaatcgtatccctcaaccgcaataccagaaatctcaacccccgaactttcaaaactggtgcaatttgactccctcggcggttttgggggcggtttcactgacgtggcgcctacgtggcgatattgacggagtcttcggtccacgtggcgttgacatgacatttacatggcagtagaattaaaaaatatgcatgggacccattagccattcacacaaaaaaatgtggacccactgacatgtggggcccacatgtcagcccttccttcttcctcctccctctctcccttctctctctttctctccccttcttcccattcggccgacgggcaggagggcgactggcggcattggggcgcatcggaaccggaccgggggcgcggcggtggctcggccgtggtggcttgcggtagtgggaggacgaggggaacggcggcggcgactcgcagcagtgggaggacgaggggaacggcggcggcgactcgcggcaatgggaggacgagtggaacggcggcggcggcccgcgctgctgcttgtcatcctcgtcctggcggttaccggcgtggtctctgacggcccgtgctgccgctcgtcatcctcgtcctcgcggttaccggcgtggtcgctgtcggtgatgaagcgactggcgcgaggggg

SEQ ID NO: 62254 - DNA, 2055 bp, Oryza sativa
aaaaattaaatccatccatgctttatatttaggaaattttatttcccacatttaacttcacttgtaaattaatgaacatttaatataaattctattaatgaattattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgtaacacttgaaaacgcaactcttgaagacgcaactggcactgcatttgatctcaccaccgatgtttaactgttaagactgtccttgaccagcggaagaagattcaccaatttggagtggcttgatacgctgcctctggctactaccttgtgcctcctggaatacagtcattttccttttacggttatccatcctgttcttcttgtcttcaagtcgagttgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcatgaagatactctgccacggtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaattgatcccaccattctgaagcagatcattgcaactgatgtgaagcgaaaacaactttctcctgatccgtgcactggagcagttccaacttcttctcaacagcgtgcaaccaatcacctgcttccactgggttggtagtgctagaaaaggtaggtggcttcacacgaagaaaatcagttaacttgttctgcggcggtggagcattgttgttcccttggttgagctggttctgcatttgctgtatcatcatattcattaactgagtctgttgagccagaacttgagcaagagttgggttcccttcattgttattgtttccacttccactggcgcgagtgttcaccatctgttgcagattagagaagataggaggagagaggttacactaaagataagaccttaaccaggttaacactgatctgatgtgtgtagaccaatatattgttcaagttgattaagcaagcaacctaatatagttacacactcatcattgaatcacaccaatgacgggaatgcaaccatacctacacacaagcaagcaacaaacgttctatcctactaactattcttcaaagacactttggcggcataggttctaaggtaggatccaaacttcattccatcttgaccacttggcacttcggttcttcctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacaaatcatgttttcgaaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtg

SEQ ID NO: 62255 - DNA, 7059 bp, Oryza sativa
  unsure (1)..(7059): unsure at all n locations
tgctcggcaaaacttgaaggaactcatgggcttgcaatacccatggtgcagagaaatcatcgcacaattctatgccacagtttactttgagcccaacaaagaaaagactattcattggatgacagatggcatcatatactcagtgacatatgccaagtttgctgccattttggggtttccggctcgctctcgcaccaatcgtgtcaagattcatgatgagaagcccatggacacaaattctcttcacttcttgtaccaagatgtggactatgagttaggcaccatcaaaggtcttcttcccttctatgcctatctcaacaagctcttgcgcaaaactctcaatcccaaggaaggtgatgctagcaacgtccttgcctatacaagtaatttgctttacaagataaaggctcacccacagctctttgactcctttgacttcatctttgaagaaatccggcttatctccatgatgcctaagcgaggacttggctatgggccttacattatgaagatgattgagattgtgtccaagaagaagtttcacaaggaggtggcacataccggttaccaactccgtcccatcaaggctgctgctgtgccggctggatgaaccactcgtgcttcttctcgtgccggtccctccgctaccgtcaccaagccggactccaactcgtccttgcggttcttcaagtccatcttcaacttatgcaagaccatctcagttcggcaagccaaggaacgtagagcaaggaagaaggacactcgacggatcaagaacctccttcgcaacgcccatttgccgtgttctcccgatggttctgaggttgaggacagtggggaggatgtgattgaggacccttttgcagctgaggcaagctcctctcgtgcggatcatggcaaggctcctatggaggaagaagaagaggaggaggaaggtgactatgctgaggagtcaagtgaggagggcgaggattctgatgaggatgagtgatcctcttttttcccttttggtgccttgatgccaaagggggagaaccacctatgaacaaaaatctctaatctatctcctttcgtgatgactagtcgaaccttgggcttttgtgtcttgttaagtgcaattatctattatccatgctcaaatgtgtgaaatatcttgtcattggcatatgcatgaggttatattgtcatttctaatctaatgcatagattgagggggagctctcctatttcatttctagcatatctttagggggagctccactaaaatcctaatcttttattacttctaagtgtgttgtcatcaatcaccaaaaagggggagattgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagagggatgccacatgcatataattgatagaacactagtgctcaaaatcatttatttgaagtgttcatgttttatgtctgtcggactatccgatgttgatcagactatccgatgctcagactatccgaaatttcacagaactttgctcactgtcttgggtctgagtgttggctaaaaaatatcggactatccgatataaggtcggactatccgatacgtcggactatctgaaatttctcagaacttcactctttgttttgaattgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactatccgatcgatcggattgtccgaaattctccagaatttcgttctctgtctctggcctgcttgggggtcaaaaacatcggactatccgatgtcacctcggactttccgaggtgggatgaaaagattctctcccaacggccacattttgggggcttctataaataccccccacctaacccttttctagggttacccaactcattcattcacattcactttgggttgagcttggtgctaaggtggtttagatctttgagctctctctccctctctcaaatcccctcttgttctttgtgtggtggatcttggtggttgtggatttggggtttgagggcctagtgtgtgtttcactcgatcttgagcactagggttgaccaagagttgtgtggtgtttgttactcttggaggttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcctctcaaggatttgaactccgggaacaactcggtgaacttcattgttggtgatatctcttctctcattatttagatttgttttttgtgccgctatagatctagtcgctgtttgcgccatactcttgtttgtgcactagatctacttgtagtgttcttttagtggatcagacagtctgatccaacatcagactatctgatattttcggatagtccgactgtggatcagactttccgaccctaactcagttttagcttccacataaagttttaaattagcctattcacccccctctaggcctaattgaccctttcaaagaggatataaagatgacttgaaaaaaaaattgaagtgctcagagggatttgaagaggtaacttagacttctagatgaatattctacgaaaatatattttttcgtgcagccacttaagagacccgtgtagaaaaatagctctattttttagtatggcttcttaagagggccgtccgccacgagtgaaggtcccactcaccagcatgcgctgaggagataatgggccgctagtggccctgtcctcaagtagctacacacccacaaaacgagggcgtgagggtgttgaggcagtcgacgggtggctctcgaggctgaccaagacatccgcgggtgcagttagccatgaccaaatgatgggttgagcccaccagctccacaatctaggtgagccaccaaccctctagagtctcaccggtagctgactgaggtgggtgccagaggagctcttatgttgcaagcaacgtgctccccgggtcgtttgcatcgattggaagggcaccatgtttgcatcgctcgcgatcctgccccgacattcgttagctatagacacagctaactcacaccggggtattatgtattagctgtgatatagtaccagttctaggatatactagctggtacacacagaataaatatggaatcaaagtaaactgctttattacatcactaggtagtagtccttacataagttgccatcatggacaggcccatagatgaacaacacaacattatagaaagccataaaagcgacagcgcagaagcgaacagcgtggagaactaagcgactaagcaactatgcactaggcaaagaacctaggcactaacttattccacagtcgaggcttagggctaggcacgaaacatctagaagtcttcatactcggcttgctcctggagatattcctcggcggtcgggtcgacgtcttcatcttcatactctatagattattataaggagcaagggtgagtacttaacgtactcaacaataagccaggggaaagaatgacatgtttggtgatgtgcactagggttccaaatcttccgaaaggttctgataaacaacgatttgggcggagtcacgacacaaatcgatccggcttcttgaacacacacgctcttgagccccgcaatcgcagcaccacgtctcctctggttatcacccgtgtcaaaatgcggatgacctcgccgagaaggctaatccctgtttgccaatcgaagaacacaagcaagaacgagatagaaaacaaccaaaattgtagatgaatgattaagctcacgaattggggtctaacaaaccgatctagcggcgaaactgttctcgatagattaatctaagcaaacccgaccctaaacaatggcggctactgaataaatgtgattagaaacgtcctagggttgccctagggcgcacactcccttgggctaagcccacgacacaattacaaggcccaaaactcaaatcagattcggattggatgagttacgtggcttgttttgcagattcccggcagctcggtaggaattttgatgtgggaccaaaaccatctgaaagtagacttcataagctttccaacaagtacttatgggccctgaaattacttctagatcagcggctaggtctgtttgaagttgatgctgtcaggaggcccgaatccgaatccaaaacatgtagaatttcatctcttgtcttatatggaccaaaagtgacgtggtgagatcaaagaagacttggagaaggtcttgatttggtccccaatcaacttcttcaatcatccatccaattccttacgctcggtctcttttctttcgcccaagcaagtaactctgcaaacgaaaacacacaaaactcattgtgtagcaacgtatgttcaaatatataacaagtaaatctaatatagaacatatgcacctttggttgattaatacataaggtagttatggttatatccgagctagttgtgtcctcatcatttggtttaaacaaggaggcaaaggttttatttgcgaaagctgcctctttggcaaagtgatttatttcacaaaaactcctagtgagtgagtcaagttttagttgtcgggaggaggctcatgcctcgacccattccacaagttgctttgcaacaacttgtcacgattatcgaacaacaattaatttgtttcctctattagttccttttcacaacaacacagttcacacatatatctcagcacaacaacgccatcatggccctaacaacacctcggcgtcggatgacaccccaggtcacacagacccgttcctaaccataaaggttagccatctgccacacaggcggactttagaaacgttacccttcccaataaccacttcttcacaaacatttgtcaaacaaatctacgctatgagaaacaccttacacccgcccttgaccgtgggcacggctcttcgaacagttcaataatctctgcagaggttgcacgctttatccacacgacatgaaacttacaccgtttacccgtcggtaacggaagttcgtgataaggcctttccaaggctaacccatgaaaatcgcatgagtatcaggcaaggacagccgtcatccactcaggaaataccgaggatgtctcctacagatatcgcacgccacaatagaggcaaaaagacacccatgatgggccaaaatgtgtaaaacttcgtctcctcatcctcggcattccacaaccattggcacaccaactcccatgtgataacaatttacatagccagagacatcccataaatacccgtgcgatcacactgtaatgtgtttggatggatttcccaaaggaatcggtccttaacaacaatacgtggccaaaccacaaaggcatgactccgcatcaccaccactttcacaacacattttatttcacaacacctcagttgtaccggatttttaagcaagtaatttggaataacccaagtttcccacacggcaaacaacgtaagcatggctaagcgaaactatctcggtaatcatataatgttaccgctgcaaacatttgtggagctatcaaaggtatggaaacatcaacctatgtaatataagtgcgactactaggtcggtccgtcggatgtataaacaatccgagggctaaacatattattcgtgtatactaaataatgcacttttcaaacaacatatctttgcaaatataggggcaatgtgatcaaagaggcttgccttgcacagggttggggtcttctccctcgaaagcgatgtccagagcttcctcgtactcgggctctaaacgcgaaaacaaaactaattaacaaaaggcaattaaaacaggctcaaatcagagaaacaatagagccactgtgtagatatcaatctactactaattaaaaaaaaaataagagatgcttccttcgtccatcacaaataaaaaaatagcgaagaaaagaagaagtccgattccccttaaaaggaaaaacaaaaaaatcggagaaaaaatagccaaaaaaacaaaaaaaaatccgattcgaaaaaaaaaaagaaaaagtagccaaaaaaatgatccgatcccttaaaacgggaaaaaaaatcctattccggcccacgcacggtttttctgtttttttttaatttttcgtttctttcagttttttctttccttttattttgtttttgttggtttttttatttcttaatatataaactttgtaaacatctctttctctactcccgtccctacttaaaaaattcacatctaaaaaggtccgttcgattccctaagaaagtggcaaaaaaagggttagtctactacttttaaaaaaataagaggcgcttccatcgtccgtaaaaaaaccgacggaaaaaacctagtgaaaaaagtccgatcaaaaaaactgggcaaaaaaaaccgtaagaggtgcttccatcgtccgtaaaaaactcagcggaaaaaaccgggcaaaaaaagtccgatcaaaacaaactaggcgaaaaaaacaaatctgtccgataaaaaaaaggggccaaaaaagggaaaagtaaatcgaaactaatccgnnnnnnnnnnnnnnnnnnnnaaagggcgattttttttaaaaaaaattgtccgattccatagaaaaaggaattatatgtgacgcagtaaaaaaaatagaccagacgaaaaaaaccgagcaaaaaaaccgggcgaaaaaactgggcgaaaa

SEQ ID NO: 62256 - DNA, 3184 bp, Oryza sativa
ataatgttcttatggatcagttcgggaaggttcagctctttaccacatcgatcctcttcatgttcagttccttttatgtatgtcttcactgccacctttctataattctcaagaattcctaggtagacattaccaaatgcacctctaccaataattgttgaattgttatttgttattacttttatttcacgtgctgtgaacattctttttccactaatatacagaggggttcctttctttctagatttgtacatgttccggttgaaaatgcctgccatcttagggaacgccatcaaactggagctgacattgtttgtaccttgctggctttgttctttatcttcattctgtgtttcaggaaagaggtgccaaccaaaattttctagtggagcaggttgtctcaaacagaatttcctaagcatccgaaggtgcccagccaggtcgcacatatccggacgtctatgaatgtcctctgttaggcattcctgtagtaattttccaatctccactaaaaccttcatgttgctctcattgcaaattttgggatcaagcaattcagtcaccccctttccttcagcaagagcttgagccagacttgccgcctttttcttggtgataagctcctgaagaactattccaaaactataaacatcacttttggaggtgagacgtccctcccgacaatacaggggatccacgtaacctatactccctatacacttaacagtatgagttttgtctgtcgagagaagtctcgatattccaaaatctgttatttttgcattaaaattgtcatccagcagaatattggaaggctttacatcaccatgtagaacagggctgcacatagaatgtaaataccctagagcatctgcacactctatagcaatatccaatcttatgtccaatgaatcaaggctattcttgtcatgaagatggtaatcaaggtccctattaggcacatactccatgaccatcattggagcatttttctcgatgcagtagccaattagcctgactacatttttatggttgatttgactgtgaacacgtacttcttgggcaaacatttcttcagaatccattttaatatacttcttcactgcaacgaaatggttatcatcaagaactcccttgtaaacttttccgaatccaccatttccaagattggtgttgtagtcactggtaattctttttatatcttcttctgtgaaaggctttatattagaaatgttctcctctatccattgtgccctttcaatatactctttgtgcttgctttctgaaagatccataattatacaatatgatcgttcttgcttcaaataaattgatgatggcctggtcacatgataagtataagttaaatatcaatttaaatgcattgttagatttttttttaccacacatgtgcatagtataaaaaatatatggctatattccaaaggtaattgtccctaaaaagcagagttgcaacagaccttaacttgaactgctgacagcttataaaacaaaaagcataacctaaattaaattttcaacaatctcatgaaaatcgatgtcgtttcttatatgcatgtgacaagaaaaatggtttatgtttgatacgagcctgacttcatttgacctaatatattttgcagaatacaatcgccttcagctctattttgcgccgcaagttttaggataaatttgtatgcctttgaacttttggattcagggtgaagatttgttgtgtccattatgttatgccgtctttccctgtttgggacaccttttaattatacgaggatttaggccctgtttgattcagtttagaattattataatctaaattattaggagtaagctgaaacaaacaagtagattattatgctagattattataatctataagccagattactaaaatacaataatctcctctagaagagcttttttcagattattgagtggctaaagacccactagccttagatgcatctaataatctagagaaacaaacaactcgtagcttattttatgtcagcttattataatccagcttagagtaatctgatttaataatctagattacaataatctcaagctgaaacaaacaggaccttagttgtgtgcgagtctaacttccagtaaaattcatccaattaccaaaacagatacagattgggatagaagatccaaacagcaccagtcgacgtttatgcaagctctatgaccatcttggtggtataatggtatactataaaattataagtggtatttttttttcgccgagaaggctgaaggaggccatccgagtacattaaaaaggaataaagtttacaagaaaaaactcgacagaagctgtcgaggacggaggtgcatcaaaatgcacaaccaaagccacatgctaaccacacagacacaacccattgagagaagaacctagcaccgaaacgacccccgctatgcgtgaccgatcgccgccgggccaacgacaaaacaacaaagacgagactctgaaaaacgatgcccccatggaggtcacgacatcaaagacgccgccatcgcccatctaaggaacatgtggttttcacctagtgaaactcaccaagggagaggggtatcattgccaacgcccccaaggaggttacgacgcccaaaggcgtcaccgctgccagcccgatgaaccatcaggcgaggctttcgcccagaacccatgcaaccttgcttgaagttcgtcgcccatcaactcaggaaccatctcgcaagcagattagcacgaggcctccaccgcaccacgtcggcacccctccaccggccgaccaccacacttgctgcagagagctgccgccacccctaggaactggcccaggcctcctccgtcccaccatctgccggcctccttgctagttttggccgaaagagaacccggaactagacagcgtcgtgatggcgatctgagcttccctcgctaaccggctgccgcctcaatccaacatagaaactccccacatagaaggggaggagctccaggaagggcaagggtgcagatcgacaacgaggaagacgacccaccgctgccagctcccttagcactgccattgctccctttgcgccctgcctcaaggcctacgaccgccatctccacctcgaacgccaccaccgctgcaccagatggtcagaccgcggcctccgggcg

SEQ ID NO: 62257 - DNA, 9792 bp, Oryza sativa
aattaccctgcacaagcataaattctgcactcatcagttagtggaaagcagggcgaaaacatgataaggcaacatgctcaaatgggtaatgacagtttgggagcacgttttcttcagcaatttgacatgcctagctaaagaaagatataatattcatcttaattctgtttcagtaagccctagtgaactgagcaataatgtacttcgatgcccataacaaccgtagatataaactttccctgacatcgcttcagtacaacaaattacaatagcaaagatatgtgaataaacaataaaatacaaaggttatgttttcacacacaaaaattgacctgacataagttggtcgagggcgtggatgtacgcccagaccacccaagttcaagccctcgtcgaggcgaatttgggtgcatgtttcttcctaatcaaaacaacaggcaacctaattcctcctaggttggtcgattttcagtcataatatccatcaactcaaatgttcgtccgtaaccattgttaagcttgtaaatactactgaacccattttctaatagtacttaagcatattttgcgggggattgcaattcataaccagagcagccatcctggtccatgcatttagcttgactgtgcattctcacttgaacataaatgtactcaaaaactaatcaagggttttatttgacaagtgggggaagaacaatccaaatagggattgggtcggtcaatccacctcccaaaacccaaccccctgaatccatcgtttggtaggaagctcaattgcaacctacgaacatattcagcgagcacaaaatttgccatccccattctgcctctctgccctctccctcagaccctcactgccccatcagcaacagctatggcggaaacaaatcggggaagggagagaagaaggaggagggagacgacggcgactaacttgacaaagagccgccacgccaccgccgccgccgccgccgtcgtcgcaggggaggaggacggggagtcggggagagcagcgacgagggttttgttttttctttttttttttttcctcgatggcaagtactttgtttagaaggcccaatttcagccctctggcccagattgacaggaatggaccgtgacaggaaaaaagtctaccgcacaccccttcgttatggatcgagttccgcaaagcaggtatagaaattcccctactattaaaaccaatacaaatcgattctctggatagcttggattacgatttcgttctacgtggtgcccaataaatttatgatacaaaactgggcactcaaagaaaatcacaaatggttttgtagttggggtttatggttgaggtacgtgaaagaactttgttcctactacaatgtaaaggtcaccactaatttcgcaatgggcgcccggagaaggtcacaagttgcaacgagtactcaggccagcataaaaatgttacattcaaacactatttctttgttacagttacaatccactaactacattaatcctatttatctttgaagttcatcctcatttaggttggttcagttggaaactactttcctccgcacgaaaaacaaaacaacatattaacgtatgatcaattgagtattagctattttttttaaaaaaaaaggaataatatgatttttaaagtagctttgatatataaattctttttgaaaaaaacgtaccatttagcaatttagaaaaacgtgcgtacgaacaacgatgtaggtagaattgggaactcacacaaaagaacacaatatacttaatgctaatttatcttctctcataaagccacatcataattatagttaaactttggatgggcaaattgcatcttttctcttcaaaaaccacaccatacaacataattatttaaaattttaactcatatatactatgttattacacaattatccgttactgccgggatacccatatagttattataaacaaaggagctttcacatttagctacagtcgaccattgcatcaaagtgaatattaagatatcagtcgtaataccaatggttttttaataaaggagtttagaatactgctgcaatgcatgagataaatgaggtcactcccaataaaagtttcattctcattaaatagaatgccatgtcaatatttttagtgatgtagcaagaaattgataaagaaagactctttccaatataacaatataacttgtctctacatgtatttcctaatacccctctcaaaataattacaattctaggttgtttagcatgtattaaggtttgataagaaaatctatagtgcccctcgttaaatggtatatagttaaagttaaaggtgggagggtggttaaggatagaataggaaaaattttgaaaaaaaaaagattgatgagataaataatactctattgtgagataaatttaaatcctagaaatataatcattatgagatagaggtagtacaaaacaaccaagtaagctattttaactatcaattaaatatcttaggagtatgtgacactcaaaacataaaatgaatcctcccaccaagatggcccaacaagcagaggtgtccacacgtggagctttattaccaacatactactatatactagtatggctaactatatgacatgcgcaactagggattttccatagagcacctgcttagaatgcggccattgcctctctttacaattcttcaaattgaaaagtgatatatagatgttctacagcttctacacagtaaaaaattctgcggtgctgccaaacgacaaaattctgcagcaacttataagtaatactaactagaagctgatcttattatacaaacaagcagaagctgtcttccaacaggttctccaacaaactagtagcagcttctgcacagctatgcagaagaatggtcccaaaggacacatcatatacaagctccaatagtatcactggtaacctcacgcagcacctgccagcaaaaggaggaagcaaaacatgctaaggcctcaacaaacagagaaaaataatcaatcaataaatggagaaactaagtgtaaggaatgttagatcaacaaagtacaaaatagatttaggcagaaaatttctgcaaaactacatttagcctaaacagagttatgggggaagttaaaacttcatctcccataaaagacgacatgtcgacatacatgatcagtcaatttcctgatatacgattgcaatctagcttgtatatagcattcttcatttgccaaaaaaaagaggtaacaaaacaaccaagctctttccgctaatggaacataatatttgaaataaaacaaatacggttctgttgttgcaacaagaactatcaaagctagtttaatattttcgccaggtaaaactagtttaatatagtctttgtaataaatttaacaggcatatgcaggattaaacagagaacaaaacacaaactgaagtaaaagcatattaatgtcagcacctgtggtataaaaggcggtgtagggataaaaagttgcagatacatcagcttcaaacacctttttgaactgcagtgacttgagctggacagcaaagacaccaactgccgtccatataaaaaacaaatcatcttcctccacaagacctaatatcctgactggaggccttctaaccaaatgactatccgtcaacggtacagagggcacttccagcggaaggactgcacccaactcaatggtcttgcgcagcacccatcctgtaacgccccctgaattaatctccaatgcccataactgaaggttgaaccctgtcatggtagccagacctagcccaccatcctctgccttcatgatatggacattccttctgtatacactatgtgtttctggtggacactcaatatgatataatctagaagtggccagctcgaatgcaagaatatgctttgacttaagtggccaatatatgacattcccaacaagaatgctaggcctggaatcaacctccgatggtgctggtgaagatgccatcatgtcccaggtgtccttctctgacgagtacctagagatataagcatagcctatattggtgaatacccatactatgaagaaggggcatgagctgcagtcaccatggtcattgtggccagctgcgcaaagcaccgcagcatggctctcgggcacacgtccataattgatacgaggattcacatcaggtgtaactggtacagcataccggttgccagtcatggggttccacacttgtagactattccagcttgagctaatgaggaggacacggctgtggcggcagccaaggacatgccagtaggggtcaggtagggagaatgctcctaccgtgacacattcaggagggttcccaatgggtagaaagcgagggatgctggtggaattggtgaagatgccgagaacagggggtgtttgatggaacgcacgaaagcgcttgataaatttgttatctctgatgaggtagcgccagtgcttgcagacaagggatgcacgaaggaggcacgtggggtgttttgggaggtgaagtaagatctcaataagggcatcgtctggaagcatgtttgccatggtgaggaaggatgggcaatgcaacttcaacttaaaaaagaagcaaaaggcgcattatttttttttaattattgtcaccaggaaacaacctatactcaatgccaaagatggaacaacattagcaacaatggtgacaagatgcacaaaaaacccgatagctgttcaagatcactccattaccttagatcctagtattttgattagcagcggtagttttggcaaaggtgtgatggtttccccggctatactttgcaatagccaatatctgaagtttgctatagtctatagaaacaaagacaacggtatatatcattcactgtggatactgacttctgctccagcttttattgataagaaaaaagtgacctgcacaattgtacacgaataatttcagctcttgtcattgagcattgacatttccttgcaacgaactacttcctccgtttcacaatataagactttctagcattgcccacattcatatagatactaattaatctagacattattatatgtatagattcattaacatctatataaatgtgggcaatgctagaaagtcttacattgtgaaacggatggagtaacaaataacaacataagcctatatcaagctactaaaaaaaataatgatgtcacaatccgtccatcttttcatgcctaccgtcattcaattcaggaaccatggctacaagtttgcgtacaaagcatagttgccggtgacagacacaagtttgaagtaggttattatacaatggtgtgtataaggaaaatggaaattagtgagggcaaaatcagtacaatgtggttagaatagccatccatatatattccttaacccaaaacattgttgatttaaaacctccaccctaaatcaatactcaaatcgaggtcatcagaatatactagctagcaccatcataccatttaacttacagctgaaacaaagcaatccccaaagtaagggtaaggacggatctagctcggaggatgaggaagcgctacgagaggagaggacgaggaataccttggattcgattcgacacgagacgcaggtcggtggaagaggccaggtgcagctagcccctcctcgcccgccgccctccgcgagagtagagtagggctcactcacaggggagggcggggactcggggaggagaggagccccgccccgtccacgccgcccgcgcgcacggtcggtccggcctgctcgccggcaaggaggcgaagcggcggaggggaggagtccggcggcggcggcggcggcgggcaggggcagtagctgcagcagtaggagacggagagaggagagagagaaatagcccaacaaggcaaaaaaaatcggttggttacacgtgtgcgtgtcagaacactcagcagaacacacgagggagtaccgtacgatacagaaaggcttgaacacagtcgaatctaggattcggatcctctgcattagagaagctaacagcaagtttaatagtatagcctattattagctccaattaatctataaccaatctaatagctaatttatacaataattgtttactatactattaatattggtcccacctgatatacatacattgtgtcttggagtctgtgctgtagctggctatagatctgtagcccgctgctcttctctctcatcgtttatcttattaaaatatgtttatagctggctattgtatctactctaatgcagagggtggcattagctcctatcctatccatccatccaatggttgcggctagttctccattagataaagcaaaaaaattaaatgggccttagagcaagtttaatagcatagccaactactagctccaattcatatatagccaatctaatagctcattcatacaatagttacatattacactattaatacctggtcccacctatcatacacacataacgtcttggagtctatgttacagcttgctacaaatctgtagcccgctgctcttcctctcctcatttatttccttaaaatatatttgcagctgtcttatagcctgctattgtacctgctcttagaggaagagcagcagacccatgttaattttagacgctaaaacagagcgtgactcctccttttccctccaatttcttcaaacttgcctcatatgagtcttttcatttctctctcacatgccatacctctttcaatttctctcaacactgaagtggatttagcaaactatattctgttcattattggtatgcacttattgctacattattgtgcagaatgattccagtgcaggaaatctatttggtggaaagcagtgacatcggagaggtggattttatgctgctctgcatattttggtttatggattataatattattttcttcctccctaaaatacattttgtacttaatcagggtatactgttatttccctatgtgaaatgccctttgtacttactccctcaatcaaccttgttatttttttttgagaaacacagtacaaatatagacgctcacaacatgcacacacccacttctatgaacgcacacacgcaaaccctaccagtagttattatgaagctttactttggtttgtgacacaagtcagtgcttcaaacatgcaagaaccatgaacattcagacttgtagccatctcttccctgtcaaaatatatgaacagcataaataagaaagaggttcactaatcacagccgttggatagagatggatggacaggattggagctaatgccacactcttcattaacttctctaatgcagaggatccgaatcctcaaatctagattccagggttcacgtttcggaccaaaaccggtgaatgggtgtggattaacctgtgacgtggattcagatatactctttgttctaaaaaaaacaaatcctgaaaataaatctggacatagccctacgatttaattttttataggacagatggagtagtcgtgttggcgcaccacgcactagaactcagcggccctacggcatatttgcgaatgaaaaataacctatgaataaaatttttatgtacgtgttcttagcgatataaaaacaaaagttgaaaaataaacatcgatgaaaaaactccaaaatcaacctcaaatttaatgttaaaaatttaaattttaactgataaacataagcataagcgaaaagatgaagccgcttcagtgtgaccttctccctctacgttgataatgccagatgatgatggctgtcttctttgactgttaccatacaaatcaccactgatatcaacttccctagtcaaaacagaagtaaaatgaacacttacaacaagtaaaagtccatttataagacaaacccacccggcagcaaggataaacttttctcaagcctgtgcatgcaaccatgataaacttttctcctaatactctcaacatatcaacaactaggatgatatcaccatatcagcctttcaggttttttttggttcgaaacagggataaactaaccatggtcagtttcttgttgcttggaacagtcagagcagcagcattgcatcatgtggctgaccattatgacagctgtgcaatattggtgtccaacagtacaagctaagtagatccttcaagtaaaaaagaacatgatacattgccatgaacattatcaagtacatcaagcttataatccccaggggagcacctgaagtttacagcagcatgtgcaagtggcacatatcaggtgccagcatatagagacctcacactgctacacgccatataaaagattgtggaaaacacattcagtaatctctgctcccccaattgaaatgcctcagatgatctatcagataggagtatcatataaaccagcagttgaagtaccatacatgcatttgaggagcacacaactgattaacaaaagcattcatatacatgctcagagtcagtcttataacatgtctaccaatcccgacaggactattattggcaagaggctgaaatgttactagaaaatggtcgtcatggcagcatattacacagcaagatgtaaatactctctttgtttcaatattgaagtccaatcatcttgctggcctttctcaaataatgcaaccatctagcagcaagccagcaacaagagagaatgaattagtccctactataaaaatattaagatatgaattaaaaggatggatccatctaccactatgtgtatgcactaggaagtcaagctctgtaaaaagtgtttgttaccaggtttaactatatccttttttggtgtttgttctggggggaggggggggggttagaattgaattgaactaagtatttaaagaataactcttctaataaaaggtaagggtatttcgctatacataagatacatgataggtgcaagataaatgctagtaataaagatggtttctcaagcatttaaacaatagctcttctaaaataaagttgagtactttgctgtacataacatgcatgataggtgaaaatgattaatatggttccgtaaattttcattgtcaaactgaaactcaaaacgtaacaatagtacaagtccctacacttaaaaagaaatatagcagatctacacgtatttttatctgatatgaattacagttcggcattcaagtggtagtgtttcaacttttcaacagccaaccaaggtaactactactcagttcattacttgctagaatcacgaacagatgtacctgtcaaatagaagcttgaatggggataaacccaatgcaacctctccatagggagcaccagcttgaactccatagtatcaagctggagcatgatgacgccatttggcgtctgtagaaatgccacactaccatcctcagtaaaaccaagtagcccagaccacgctatcaatcgatcaaaaagcgcctccaattgccgcaatggtggatgaggaggaggaatgaacatgcacagtttaattctcttcctcatcacccaactggcagtgctatccgagtcactcttgcgcacccacagcttgaggtacaaaaatttcactgcgccgaagccaagcttgctaccaccctcagccagcataatctgcagactccaattcggagccggaaaatacataagatctgggccagaaaccacattcacagccaagctcttggcatccatgttgaactcaaggatgcagttctccacgagcagccagtagagaacattcccaacaagaacaggaggcttcatgtcaatggcagaaatcttttcccccgagatgg

SEQ ID NO: 62258 - DNA, 2185 bp, Oryza sativa
tattatgtcagacagtaaatacattaacatcaccattgtggtgagtttattaacagaagcaatcattcagaaaagaaatgaacaatagaagaacaattgattttggctgggatacttcagacaacagtcactggatgaaaggaagtagatttaagcatcctaaattccaaatgcgtcgatttgaattatcagctactactgggatgaaaataattagatttaggcatccaaactcatcaattttaagtatttacattgttttatgggtttcggttggtagtttacaaatgcttgtatctcaggatgagaaaatactcactcaaaagatcgtaactttgataccatagcaacataagttacacactctggaatacatgagctaaagtagattgttctaccactggcttatgcagaagacgatgaactatctgcatcatagaaacttgcgatcggatacacggcatatataggacgggagtcgggggagtccaagaactcgtccattttgcaaagctccttgaaccgcaatgactcaagattgaccatgaagatcctggtggacgacgcgacgaacagctcattgtaatcctgcgaaaaccccagcaccttggtcggattgacacactcccccgcgctcagatgaagaagattgtcgaggtagatcggttcgagcggcagccacccggggaggccgtcgaaatcgatcatccactgccatatctgcatgcaggatcttgacatgacaatgagcccaagctctgtcccctcttggagagtaatcgggtagaggccatcatgatcttcatggatatgcgtcggcacatacaccacggagaggctgtggttcaccaaattgaactcgaggatgttgttgtcgtagccgaagagcatccagtagaggaaatccccaatctggatgcatctgcacccaagcgagatgcaattccccactggggtttcggcagcatggtctccccaatctccggtctccgacgagtagacgaaggcgaaggcggtggacctgtcggtgccgacgaggaccaccttgaaggggttggacttgcagttgtcgccgtggacgtggtcaccggcggcggtggtggcggcgcagatcaccgtggcctggaagaagaccccctttagggcatcgagctgcggcgggggggagaggtggatgaggtcgccggagacggggtcccagatgaggatctggcggcagccgaggccgctcttccagttgaggaggaggaggcggccatggcggcagccgtggtagtaccagttgccgccgagctcggtgtcgtcgtggaggcggatggagaagcgctcgggcgggacgcggtcgggggcgtcgagggtggcgcggaagaggggctcccggccgcgcgggttgacgaagaagccgagcagcggcggctcgccgtggtgggcgcggtagcggcggaggaaccccggctcggcggcgatgcggcgccaccgcctgcagactgcgccggcgcggatgagctgggtcggcagcggcgggacgcggaggaggatctcgcggagcacgtcgtcgctcagcggcatctcgtccatctccggcggcatctcgtccgtctccggcggcggcggcggcggcggcggcgtggtgtggcttatcatctcggcggcgcggctaatcttgaccgttggatttggcgagtgtacggaaacaaagtaatctgtggagaggctgtactaggaattggttttatttatagcgatcggacggctcagagaccgccacggagtcgggttggaaacggtaattatgtctgacacgaactcggattaaaaactggattagaattagtaattggcctattgggctttcagcccaccgcccccatctgggccggctcacgaaggaaggagaggaacgagaccgacgcggatgacacatgcggccatacggacaagaggtacgtgaggtaaaatagcgtcatggtttgaaagtgtatctcttgttcttctcttcccatttttttctaattattattatcttcatttacacttttataaatatatgctttgtgatttgttgcattcgtacacatccgaaaatgcttcgtttaagacgtccggacgagctcaaaatatcggacgcttattctaatccaatggcctgttcactttaatgtcattttcaaccatattatttttt

SEQ ID NO: 62259 - DNA, 1308 bp, Oryza sativa
acttcagactttgagaattctcatatcatttggacagtatggaatggctggcttatgttggaattggacacacacctccccttcttttcaaaacccccaaaacggttttaggctgggctcgaggtgcgtggttgggttttgttagtcgtacctcgggtactataaggattaagctcgggcctctgttgcaaagcactaccgtacttccacatgtctagtgggtcaggcttagtttgtggctcaatctggttataaacaaaagtacacggatggagatggacgaagtcgagggtcgatggacatctctaggacaaatgaaggctacacgagctgcggcccggtagtcgagatgtcatggcacagggctggtgtcctgctgctaggggctcaatcctgcctgcctgtcccagaggttccggccgtaggcggggttgggtcggtactcttgtctagggctaggatgggttggaaactatgtcacgtcttccatccgtataccgtggtggtatgtggcacgtggttacacgtgaggaagatgtgtcttgtgggtaaagatgtacacctctgatcagagtataacctattcgaatagccgcgccctcggttatgggcatgcctagcaatgtacccaagttagcgttttaattcttaaaacctgcttaacaactaaaatgtggaatggttggcctgggttggcttggaacgagctgggacccagggtcgggttacaagttcggtctgaatcatcgtaggccttgggttaaggcaggttcttgtgggttcacggccttgactaataatattgtatagctctggaatcgtgtttacaaaatagctttgagcactaagtgtcttttaatgctgtttactgcaaaccttaaccctttatattataacccccttgtactcccttgcatttatcctgcacttgtgggtgtgtcttgttgagtacggtggttgtactcagtcttgctcaatttttcccaaacccagaagagaagcccctgaaagatgaaggctttggtgtctagctcgtgcctgccgtcaaagcgcttgtggtcgtcgcccctagtctttccgctgttttcccgtttgtcttttgtgtgtggtgggcctttgccggccatgttattaatttaatattttacgtttccactttattaacttttaaaaggaatcaacttttggtggaccttgccttcttggacaaagaaataatacacgcacgtaagaaaggccggttgggttaattcgggtggtgacaggatttataccaatagagtggttcttaataaaatttgaaattta

SEQ ID NO: 62260 - DNA, 2373 bp, Oryza sativa
ttactttgtaaagggcataatatgtaaaatgcaaaacccccctttttaattagagtaaagtgcttcttactttgtaattcaggtagcatccatcaacaacaacagaacttgaaatcatgcagttcaataaatttttgaacccgactgcttatttgcttagccaaatcacggttattggcttcaccacctctacaacaattgccacctagcagaacatatagaggattaatagcccgattagattatttcaacttgcaagcatagatacatatgacctttatgttcacttaatactcaaaattcatcataataattattcgtgtacaaaattatggcatccattgaaaaaggttttgttttgttcgatttacattttcttaggaaaatttagacagcacctatgttattttttatagtggaagaacacacatttttttcttttccccgctatacaacacacaggtcgagcatcacgatcttgcgcatgtccctgatggatgcgccatgggtgtagttgcgcagcgtccagagctagaggacatacccggacatggcggtaaggctgacgccgccgtttttgggatgacgatgctcaggttggcctcgggaacatcgtcgaaggcatgagcgggcaccaggatctagtgcagctcgtgtatcttgagtttgaaggcgatgatgctgtgggagatgaggtgctaatagaggatttaagctaagtaccgtgagctgtttttcttattaacatggtgaatctccccaaatatagaaaaaacaaatatgataaaatttgacactaacgggaatttttagggtaagtaccgtgtgcagttttttttaataacacaaagtgataattttctgctgaaaaactaatatgggtccttattagtagtaaagaacatactcccaagcttattatttccaaaagaaactcatgtggaggcacttttgtagaggtcccctcaaaaaatcaggagtttcaaagtgtagagacacattttagagacattttaaaaatgcctaacacttttactctagggaaactttagagacatttttccgacgggaggcggagcaggatgctccgcaaggcgtcgttgggcaggtcagccagctgcagcttcttctcctgctgctgctgctgctgctccttctcgccgtcaacaacatcgacagaacaacattgatctcggccatggtgatcaggggctagctcagatgacaacgaactcgatccgacgagtgatagttgctggaaagcgatcgagtttggtgagggtgaagtgaagagcacagagatggatataaatcaagaggacgagagtgatgggtgccgtgacgcgcgccatggcgagagagagacgcgagacagtctgacgccgaaagcactagcattcgtcctggccgtgggtgacgaggacggcaaggctgctagcgccatgccatgcgatgacgcagcaattgtgcgtttatctatctatttcacttttttccaatccttttctcaactgctcaagtgttcttacattacatgtgactgacttggctgtatatggagaattggggatacggaaatgtgcatggttctatcaaccggtagaagaacgttctagaaatttttagtttctgctaatctacgtgcccgaggtgattttagtttcagctagatatatacggtggtaatatcctgccattttgtatgggcataattaggcaaaattttatataggatactcgaatttttgtaatttggtagtggacatcgcaaatacttgtaatttgtcggaagatactacaaccattattttattatttctagtccaattagagagatatttttaaaaaaaaacaagaatgcctctccggccacaggtttgtaacctaggactgagtaaagaagaaatacaatatgtggtagtaatgtacttggtttacggcagattgagagttgcaaaataaacattttaattttttttttgaaaatttaaaaaagttatgagatatactcatggccgccgacctaaggttttggaggggatcggatcgagtagagatggcatggtatattcaaacaaaccaagctgagtaacctgtgcttcctcaagggcaaattcatcttttcaacgtagtttctctctttagttggatcaggaataataaaataatggttacgacatcctccaataaaagtaacagcattctgaagatatccttcagccgtggcacctttttcaatacccaccagcaaattatatcctgtaataacatttgctatataataacggtatgagatcgagtaattgaacgacggactgctggaaagggatatctgtttggatgcttattagcattgttaggtgataagctaag

SEQ ID NO: 62261 - DNA, 3742 bp, Oryza sativa
gggttttaaggtttttctttttataaaactttgataaaggttgttgttgcttaataaataattccgttgctctgaaaattcaagtaaaatttgagggctccttttagaccaaggagaatttaacaaaaatttaaattctccggaccacattcgaatttttcttgtacgtattttagtgtttgccaatttatttttgaattttaattaattccattattccttttagagaatgatttttatttcgggatgaatttatcaggacgtgacaaatccaccgcccttacaggaatctcgtccccgagattcgagaacgctagcaagaatataggttgggatgtcttctcttctggactgacttcttccgctccgtcttctataacaaacttgcgtaacaaaacttctccgctctggagtgcttggctcgatctcctgttataaatggaatcttctcttcacctgacttttccctggttgcacctctagctgactttgactgggctgcggcattggaagatggggcttcagttccagaacttcttataattcatatctttggagtcaacctcatacaagttaccacttcatgtcatgcgtcaacactagcttttcattactaggataccatgtttgtcatcataagaatatcatgcttgtcatttacttctaacatgccaccaactgcctcatattagctttcctggtctccgggtgctagctacatctgctatttgatgcaagggtcgataactttgcctttgaattatgtttctcaacagaaccaacttatcccacttgacatgctttgacgtcttcccaaatggctttactgctggacttcttattgtttgatcgttatcctgccaaatctgaagcttcgttgttagatgtaattttaatgtgacctctatagactatcttcgaacatatcacttggttcataactgggaatagctcccacgaacaagcaactcggattcactttctttatgttcagtttactttccactattctcttcatgttgtcatcatttagcattcaacgtattcctttacaccttcgaccttgatgagttccttcccattggatcatcttccaagacatggcattgcctggtaaccggtgcctgcacttttcactccatgtagcatctgatccatagcatgttgatcccgtttaaagctattgtttctattcaactattgcatttattttcgaatgtcattgggtggaattaacctattgtttgttatagcccttttgttcttgattactttattccttgatgccttgggttattataacttgactaattgggctttatatattggttcagctagatattagatatgattgcttagccatgcttagaaacattagcacactattgggataacttatgactcactattatttaatgatggcttaatgatagctcatgatggttaatgatgattggttaattaattaatttgccaactaaaacctgataatggtgggttgtgagcacatggttttgatggtcgtgctcatgacaattaaggaccggttcacgagtttcggttgtgaaacattaaccgtgccaaccacaagccagcgtgggtaacgactttaccttttgtatagcatggttcattgcggagcaccaaactaagaagtggcggagataagcccacgggggtcgctggggagtccatgccttgtatataagggggtgattattgtcacgtcccaaaacgactttaaaatacatcctttaaatgatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccttttccctccctctccctcttgggccggctcggcccatctccctccccctccctctcctctccccgcggcccatccggcctctccccgcgcgtgcgccgctgacgggcgggcccgcctgccaccctactgacgggtggggcccacccgtcatccccttcctcccgccgctcccgccgcctcgcccacgccctagcgccaccgccgccgcgaatcccgccgcccccgtcctccccgcgtgcaatcaataggggggaattatttccagtgattccctccccctttccccccaattttccctccctctctcccttggattcgtttggaaaccctcccctaatcccgccggcgccattgatggagcccgagagcgccgcgccggtttccttcccctccggctgccctctcccccttccaaccctatataaaccctccccgcacctcctccgttcgtttccgcctctcgccgcccttcctcctcgccggaatggagcttgcgccgtcgctctctctctccgccgtcgccgccgagctccggtccgccaccgtcgtcgccccggaccacctcccacctcggcgccgcctccttcggcttcgccgcatcctcgccgacctcgtccacccctccgtttcgctcgtcgaccgccggagcgcccccgtccccgtcgacccgagccgcgccgccgccttcctccgctccggccgccttttcgtcatcgccgtcgacctagggtgagctgtggaccgccgcctcgtttccccctttccctcccttctctcggccgccgctccgatgtgcccatggccgccgccggcgaacattgggacgcgggcgcgccgcctaccgccggccgcgccgacgtggccgccttcgggcgcaccgagcggctgccgcgtggggcccggccgtcagccgcccgcgccctcgggtgcggctgacgcgtgggacccacggcgccggccggtgtgagcccgagtgcacccggtccaccgtggaccgtgaggctgccgcgtgggccccactcctgtggacccggtccgcgcgccccctcccctcgactgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttcttttccattggtcgtgtagacgctgcagcttcggaagatccgctcttcgtggaagttgaagccgacgtttgggaaagcgagcaaggcaagtcacatcatccttgaacatatttgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatggttttataaaaagaaaagctctaaaaagtctttttccccccccccttccccctcttgggccggctcggcccatctccctccctctctgtcctcctccccgcggcccactcggcctttccccgcgcgcgcgccttgactggcgggcccgccc

SEQ ID NO: 62262 - DNA, 3228 bp, Oryza sativa
ttcgcggcgccctatcgtgagtaaaggtgttattatttatagtcatatgaagtaagcattgaaatataaagcaatagaatgataggaaaagcacattatcactatgctatgaacagttcaaacgaacagaacaaatcattacgcatagagatatgtaactaatctagcacatttgcaaagcatatcataagtagtatagcgattaatacattaagtgatgctccaaagcagtagttagatagcatagcatggtacataggaagccatccatgtggactattccctccgtcctattatattacaacttaggatgggattaggcccattttaggactacgaatatggacaatatcatggttatgtccaatttcatagttctaggacccatcctaggttgtaatatattgggacggaggagtaacacatatcgaaaataatcgaggcaatgagaatctattatgtttatttagatggcgtcgtattgcagtttatctttatcctccttcaacatgtccacggtcggttccctcagaatcaatggttccttgtacccattgaaagtccatggtcagttccctcaaaatcaatggttgcttgcacccattgaaagcttttgatggttggctttcttggcactacaataagtacaataagtacataggaaacgaaacatgtaacaatatcatggcatcgaaaatagtatatcagtgagcaccatgtgtagctaaaccaacaaaaatacctacacgaaaatcaaacaaattgaaaaagttttaggagcacgcataaggcaaaaatattcctttccatttcctctttagaatcaatcttcatagtcagcagaactgcatccctttgatcatcatctatcacctgagacagtttaaaagaagaattttatataaattacaacacatttagctaaatgagttgcctgtgactatgggagttaccacagtagattattcactgaaatgagtctctggagatttaaatgaattcttactttgactttagatttttcagcatgtgcttggataaggacaatcttcaataacaacacataaatcagttagaagaagttctatagcacatcagcacctcactatttcgaattgtaggtgtttcggttcatggcaagaggattttatgccactattttagctgacatgggacagtctcaatgggatgtgaacatggaggatatagctgctagcaaccatgagatacaatatatggacagtccctaaagcttgcatgtctgctctcgttgtaacaataagtcatttacagtgagcgtctaaacatatggtccttttaccagtgtagaactctttacggtagagatgtactttaataatcgtcataaacaaaatcagaatgtcaggaaacacaaagaacataaaaattgaaatatttcacattttctcaaataaaaaaaaatgctaagatgcaaatgtcacgtcaaagacattcttatccaatagttcggcgtgaggcatagctaattccaaaccaaaccaaaccaaatctagaacctcgggtactgttacaaacaaattcagtatgtaattgctagggaatctaccttgatgctgaggggaaaaacaaaacatacgcacaaacaagaaggaatgaaaataatctctctttttacagaacagcacaaggcatatatcacattgtcagggattacatcttataccgtcataaatacaacaatctttagttaacaaaaaaatcagtactccttataatgatgcagaaataaagcgaaagaactcacatgtctgtgattgtgactcggtgtggcattgtcatgctcgttgagcaatcagtgcctgttgtatacattgaggtgtgagcagttcggggcaacacggttgggcagcggctgcaaccatggcctgaggcccgagcgatggattcaagggagatcatattgtaaggaggaggccaagcatgcagatagctgcgccacagcgctggcacaaatagacttcaataccagcaggatgaatgagctacttgtacttccggtcgcaaaataaggtcaattgggtctgcatctgagtgctcgatgaatcgctgcagtgactcattcctccaggttgcaagatcgattccttctagtgtgctcgtatcagttgaaccaccaaattattagtagagtgaatcgaagccatcaaacctggataggcaaaccagggagaggagtgcgtaccggcagtggctaggcctggagtagtctacaccagggtagttagtatccgccgtagcaacaagatcccacacatcgcatcggaggaggccagcgagcgagctggtgaagccggtggagcgacgcggagcgcgtgccagaggacggagtcgaagacgccatcggaaaggagtgcgccgagggcgtcgtcgccgcccacacaaggttcgacgcgagggtgcgatctagcctcgccccgagccgtgtgttgccgtcgtcgagcgccgcatggtccctcaacagggacgccgccgcggcgtccgtggcgtcgagcgcagcctggaggtggttcaccacggcatcgaacgaccgtagcagcgcctgggcgaaggaggacgcgcaaaggagtctgtggggaggagggcgaaggacggctggcagcgtcgctgaggaggaggaggaggcggcttcggtgcggctagggtttttggaacgcagagcgcaatggacggaggaaaacgcccgacgggtctgatgaacgagcgagcggtgaaacggcgaacctgccagcgcaccgtcccttggttgggccccaccctgacagcccatttagagatacccaagcccgcagcagcttcagcacaagcgccggaggcgctcccctagcgcgggaaacggcaggaaccgggcccacagccgcatcagcctcgcgcgcgcggagggagcgggacgatgtggatatcagcagaagcgagcacgtcggcccgaaaaggtccggagcgctgtggggaggcgaactcgccctcatctttaatttacaccgataaatagtactccactatattgtgttctccaatctccaatttcttactagttatttccaaacaggtaaaactaccctcataattaattatcaaagtcatacagaaaaactcatttagttttatttttgtttggtgtatgtgctctttatatgatacttcaaatttcacttactcaatgccatgcttcagaccaatattagaggt

SEQ ID NO: 62263 - DNA, 594 bp, Oryza sativa
cagtggtttggtgggaacgcaaacctcgccgacgatgctctggagcgcgcactgggcgccgccatcgggacatcgtcttcgttgccgtcgaaccggagcaagccgagccgagccaccgcaccatcaacatctcctcggtgtcctctcttaaatccctcatgaacccctgccagtggtgcagcgagcttggagatcggcatcgtcttccccaattccggccgtcaagctccacctcgatttctccctctccggtgagtcacagttcaattcctcgggcataaagctttcctgagacctattcaacaccgtgtgtatgcatgcatggtagatcatcagccatatcaagccggcgtcgtcatcgagcgaggctccctgccgtcgccgagtcgttctgctcgtggtcatcgctatctggacctcgccaagtttcattggacgctcggtaagcatcctaggatcccatagaggcacatgcatcaatgctctagctccacatgcaccgtcacccgagaaccaccgccgctcgcgccgccgtcgccattaattccgatgaccaatgcttgcaaaaataccacctatagcctcgccttgaac

SEQ ID NO: 62264 - DNA, 1830 bp, Oryza sativa
ccaatgagcttcccatgccagaagagcatgtccccttttgtcatgattgtagagaacaaggacactatgccctgaattgtccatgggtatatgctaaagaagccccttcctttggtttagcagggcagacatcgctaagccagcctcctcgcaccaagtcaagcttgcagcctagtgtgcaaagcagagagcccaatgaagagaatccattgaatcccgggaattgctttcttcctagcctttcgtaccacgtggggtcacacactaagcaagccaaaggcaagaagagtaagaatcagaagagaaaagcgccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatatgatagtgaagggtcagatcaagtctcctcggattatgaagatgagtctccccgacatctcggtgaggaagagatggaatcaaaagcatgcaaccgttgtggagaaattggacacattgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagttagctccaacagcaacatcgacaatatcatccacagcaccaatgctcctcctgctgcacctgactctgcaataaatcatagcaataataccttcagcaccaaccattctctgcaccgatagcctcagcaaagaattgtcatcgatggaagaagctgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctatcacatcatcacagaaccaatcaaggatgcagtcactagaacaatgccagctatacctctccagaatcagaatgagtagccatgtttgtggttttcagttcgctacttatcattgtgtaatcgggagtttgcagcaatcatgtaataaataaatacattcatgattataaacaatgagtttgttatgtttatggatgattcatgttgaggatgcaatgtaccgatgttaagcaccttccctttttgtttaaggcaaggccttgtattcatgtaataagggagacatgtgtaataaaaacaagttctatgaggattatttcggaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagtttttgacaaaccacatcaaggtttcactgaaaggcagcaagccaaaggacctcatcgtccccagaagcgtccgcaatccacattaaagaataccagctgttagagataagccgaaagaagattgataaaagagattggcaaagatgttctctagcatgaaagaagtaggccgaaaggtgattgataaacagaaacatgctctgcatcgctcaaggaagacccctgattg

SEQ ID NO: 62265 - DNA, 1682 bp, Oryza sativa
agtcagtgttttaattcttaaaatctgctcaacaattaaaatatggaatggtgggcctgggttggcttgggacgagctgggacacaggtcgggttgccagttcggtccgaatcatcgtaggccttgggttaaggcaggttcgtgagggttcacggccttgtttataatactgtgtagctctaggatcgtcttacaaaatggctctgggccattaagtgacttttaaatgctgttttctgcaaaacttaacccctatatattattaccccttgtacccccttgcattaatcatgcatctgccggtgtggctcgctgagtactgtggttgtactcattcttgctcaatcttttcccccttcagtaagagaagctttggagaagaagtcttaggtagagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagtggataaaacctaaggacatattttatacataaaactatttccgaaagtccctttttcctcctttcccctgtgctatttgcaaaaggtttactcccttcttccttcttcagatttcaactagtactagttggttagttttgcgaagaagaagatgtcgccaattgttcgccgaaggtccggaagaccgcagggtccgctagcgaagtggaggaagcagtgaagccagctgtgaaggagtgaagatcttgggaactcgtcgcagaacctaagccaccctctagtgtttcgtttgtcgtgtgtttccttgcttgtgtgtgtagtgtgcggtttgcatcggtgggctgtgatgtgaccatgctaggttgtttgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactccagttttcaactcaatccaccactggcctcaagagagttaaccagggcacacccttggtccattccaagcatgcggcttagttcacagctaccattggttggaagtcaagaccaaaataagtatgtgtttgatcgagcatttgccacccaggccaatgagcttcccatgccagaagagcatgtccccttttgtcatgattgtagagaacaaggacactatgccctgaattgtccatgggtatatgctaaagaagccccttcctttggtttagcagggcagacatcgctaagccagcctcctcgcaccaagtcaagcttgcagcctagtgtgcaaagcagagagcccaatgaagagaatccattgaatcccgggaattgctttcttcctagcctttcgtaccacgtggggtcacacactaagcaagccaaaggcaagaagagtaagaatcagaagagaa

SEQ ID NO: 62266 - DNA, 1998 bp, Oryza sativa
atagagtacccactagttgggttttgtttatcctagggtgagcaaggtaataataacaatagcaataataataaggtcataacaaaggtaaataggcatggctaaataaatcagtgataacgcgggaatttaaataaagcgacaatgcattaatttaaatcaaaataattttataaactaggattcaatatgctcaaggatgatgtgacttgccttgctgagagacaacggccttccgaaccttcggcgacgaccgcgacccacgcttcgagaacctccggaacgacagaagctacgcgaagcacacaagcaaagctacaagcctataaagaagcaataacaatacataaaaagaaagcacagggttctttaggttataacaaacattaggagacttgaacgggtcgattcagagttcgtatgaccaagacatggtcatccgaagtttaatgatgttatatggagatttgcggattattataattaggttttacaactataaaacatgtctaagcgctagcctggaaaagacaggaaggctgcgccgttgacatgcggaccccacatgtcaacctaagggaccacggtggaccgggtacacagagacggtccacgggttgacagaagcagatcccgtgtgtcaaccgaggcgagtggccgacaaacggactccactagacaccacacgtggaaaccacgcggctaccgagcggacacactaacacggtcaccacacacacaagcgaacgactaccgacaccgatacacgggtaccggggccgacaaccgcacaacaggcacgggcgacaccgaaaggacgaggatggggcagcgagggagagggatccttaccaccacgcgacgaggcgtgggaacgacaacgacgaacgggcgcggcggaaacggacggcgagggaacgacttcggcggcgatccttggacgaaggcgagacgcggccggcacaaggcttgacgacgcggaggcgagggcgaagacgacgacggggctgcagcggcacacttgacggacgcggacgacggacgggaacggcttgacggagggacgaatgccacgacgaccgggaacgacaagaggacaacgaccggaaccggcgaggaggcgatgagggcagccggcagcagctgcacggagacgaggacggcgcggaacacgccgctgcgatgacgacgagggtggcggcgcagcgagacgatgagccggcgaggacgaacgaccgaccggaggagtcgtcgacgaggacgaacggagacgacgataacgaacaccggcggggttcggatggaggggatgcgaggccgagtgcaaccttgacgctgcgatgccggaggaggagatggcgatgtcggccgacgcacgggcacggcggaaggggttgccgaaggaactccggcgaggcggagggcgagaccggcgtgggcgacagcgttccggcgaaaccgagggcaggccagggtggaggggacgtcgagggaggatggcgatgacgacagccgtggcatcggcgaggcggcacaagcggctggaggcggtggcgacaccactagtcgttggcgaggacgcgtctccggtggcttccccgcaaaacggaggcgacgccggggaagaggtagcggctgcgacgccgggggagacgacggcacggccggccggagcgctgacgcggcggcaggggcggctggaggtcagccggcgccggagagagagaaggagaaggcagggagacgtggtgaggccacgggagatcgcgggagggggctaaaacgagtgaacggagtgagggggttccattttataggagaggagagggatccgggcacgggagaggtgggaacggcggcggaaaagtcggccgggggcccatcaaaagcgcccggggttggcgcgtccgttcccggcgatttggggcacgaattcaaggggaaaattaaggggaattgaaaaggaaggaatgggaattacctccccccaattaattt

SEQ ID NO: 62267 - DNA, 6658 bp, Oryza sativa
gattttcgtgtgcacccttcctattctgctaaataatatgtttttaatatattttctatagataaattattgttttgagaaaaatcatattaattcaattcttaagtttaaaacatttacaattcaattaattatatcctaatggttaatcctgtttttgcatatcttttttccactctttttttaatccattgctttccatctacactacaacaacccagctttccacacatcgccggcagcatcaacaacagcccttctcttctactccctcggtaaaaaaaaaaagacaaaccctgagtttccgtgtctaatgtttgactatccatcttatataaattatttttataattactccctctattcctaaatataaggcacaaccacccttaacccaaagaccaagaaatagttattatcatcttgtaattgaatcatcctaataaatgtaatgcatgcatccaatagagttagagaatgtgaggatgaaggatttaaaagaataggagtgaatttcagaaaaccccatgttttgaggctaatataacacataaccacaggttttgtttattttctcacataaccccgtgcattcaatccaattaacataataccacaggtttaagtaaaagaaagtgccacaagggcaagtgatatggcaaacctgctccacatcagctggccccacctaccaggtcaatacatggcctattagggtgggatcacgcgggagaacagaagcgcgtgttccctgtttctacgcacacgacacggcgcctcccgtctttcttgcgcacgctggcggtggcgacgttccccaaccatctcttgcatgatggcctccggtgatgatggtgatgttgacctagctggaggaagagaactcgttgggtaccattcctagcaggtaacattcatcccttttcttgtgatgatcatatgaattgactccaaagcatgctggttggtgatttgcaaggacactctgcttcatggttctttgacgaggaattaaatccagccattttgatcatgtttggcttgtcaagaaattaggcctagtaaaatgtaatttaggggaaccattattgttagggcattacaactatgcaatcgttcttctgtttgtcattgcaaaattgcttttcatcatttgaccataattttttaaataaaaaaagcatgtagattggaccgtgtataagactattgtattacaactattatattgcagtcagatataaaactaaccacaattaacatttaaaggcctgcaacatttttttctgcttcacaaaagagcagacatggcttcctctttttttttctcggtaaataggttgtatttttctctgcttcacaatgtatatatttcagatatggattcgttttgcaaatttcctatgccctggacctgcaatgggtcacatattaactgttgctatggtgcttttattcagacatgggatgtttttataacgtttgctccattgttctgcttaatgcatagaaattgtcagttttttcctttcatttttttttcataggaacacagtgtcaggcaccttggtgatcgacctacttacaaaaaattcgagcagaaacattgtcaggtcctgccgtcctggccacgtttaatcaaatacacacacaagctttgtattagaagataggaagtatatgtacagtttgatcagttgatgcaaaacagaacaggcgatgcttgcctttgcatgtgcacgacgagctgcccctctgaacttgtaggaggaggaaaactgccgcagcgagcacgaggaagacgaggggtgcgtcatcgcgtgcgcgggaacagaggatgggtgcttccccgcgctaaatagcccacgcattgatctggcaggtggggccagctgatgtggagcaggtctgccatgtcacttgccattgtgacactttcccacacttaaacctgtggtattgtgttaattggatagagtgcattgggttatgtgagaaaataaatagaacctgtggttatgtgttacattggctccaaaacaatggggttttctaaaattcactcaaagaatagtaatttaatgaagaatacatgcatgtcttatattatgtaccataaaaaagtggttgtgttttatattatgaaatagaggtagtagtatttttattattgttagatgataaaacatgattaatactttatgcgtgacttatctttttaattttttttcatattttttttaaataagacggacggtcaaaacgttagtcacggaaacccaatgtttgtttttttggacggagggagtacttgccctgcccgtacggtgtatacgtgctgtcgtcgatcttgccttacgagactgacaccggcccactcaaaagggataccataccaaccctgtaagactcttaacatttttttttggcaacattgctcatagggttagtacacagtacttgctgatccattgattgacagccgtttcattgggttgatattcaagggcgagaggacagtacattagaagtactagtaatcaacaaaaaaaaaagcattaatttcttcatgtacgtgggcgtgcttacttttacatatgtaccacgcatgcaccttaaattctcttaatttagagctcatcaacagtttgtatgtacacaactacggctgtctgccagctagcttttctacgtatacccttggcaaaataccctaatttacggttatgttaattaattgtgatgaaatatatatcctcctaagtcctaataacagtctattgccacatactaagttctggaggggtaaaacatttcacacacaattcagagaataattttggtacagctccacctttaatggttcttgtctagctctaacttcaattgttgcgatgatcggatggacgttgtttgcgtcgtggatgtaaatttcttctttgtctagaagacattgtcatatgtttcttggtcattggttgtacatacagttgtttattcataggaagtcagagctgctcttttgagctcgacaacaataatttatgtgttggaattaatacgtggctaaaacttatatggagattaattctttgaaaaatcataaaagcccatctcataataaggtatacatataaatctttagtaccacctcacttattataggagagggatgcctcctaaaaaaaggagattgctcttctagttacttgagccatgtgagatgaagaggactagagaaacgcacgtgctcccagacgaggcggcgtgagcatgaatggtcacaaaaacggtatttatttttggaaaccagttttaggaaacacaccgaactgcgtggaacgacatcgagtttggataagttacacacaacttatccagttcggttatacggtgaaatttggtgtttgttatcggaaacataattgtaggaaacacgctgaataatccgttgcgtggagcggcgtcgagtccggataagttacgcgcaacttacccggttgggtttatagtgtaaagatcgtgtaggtgtcctgatcacacgtcttgatatctctctctatataaaccgagccaccacctcctcacaacatacgccaaaacaacctagggtttgtctcctcctctatactacattattgctcgtaatctactacatcccgctcgccggcattcactgatgatcgggagagcaggtctccgaaaccttcgccttcggtttcatgcaccgggagaaggcgacgataagagttttgggaaacgattcgtgcgactggtcgctgttctttcacaataatttgtcttcctctacgcttgacgtaagattaagtgagaaagctattatgttcacattttagacaaggtagtgtcttaaatcactttattttagtctacaaatgtcatatttggcacagctcaggatctgacattttctggagctgggtgttcctagcttcacaaatccatggattggatttaggattacattgataatatatggatgaaccattttgttcgtattttataaaatttcaaactgtactataacttaatatacaaactttaaatttagtgtatctaggatttagagctgtaccataccaaaccagaccaaatttagtacacactccatatcatgtaagaatattaaaaaaatatatagctctaacaaaaatctgaaaattagctagagctctaccaaaacccggagttttcagctgctggcagcccacagacgacaaaagcacaaaatgccatgatacagcgcacctttccctttgggcaccatcatatcagtccagcgcaagtttaacatccgtgacataatttatgtgtacctaatgtggcccccatgccatcaccctacccacaaaaagagacaacaaataactctagtttgctttgctagccactcccttgttttatgaccaaacttaaactttttattagtggccatcaaattgaatataacggcttcccttttagactagaagaggacgacgcagagagaaaactgaaagtttttttttcactaatgtcttgattaatctcaccctcagtgacgatgcgacactagtttcatatctagattgaaattcactaagggcccctttgaatcacagaaatgaaaaaacggaggaaaaaaacataggattttgatagaaatacaagtgtaaaacaggtgattggaaaaaacaggaaaaacataggaatgactgttcgattgggccgcaggaaaaacacggaaatttaaggagagataaaagactcaaagtattctttccatgaggttctacctcatgttaaatttactctaaaacttacatggggaaggacaatccataggaatttcataggattccataggatctatttctttgattcaaaaggctatatagaaaaaaatcctatagaaatgaaatactctaaaatttctatgaatttcctttgaatcaaaggaaccctaaagttttatatcaagtacaaattgggaaattaccggttggtaggctagctaactttaacttaactagtggcgccaattaaggatgtgttcggacccaagggttcccaacacctctccatggttttccgcgtgcacgcttttcaaactgctaaacagtgtgttttttgtaaaaagtttctatacaaaaattgcttaaaaaaatcatattgattcatttttaaaaaaaaaattagctaatttctaattaatcacgtgttaatggactgctccgttttccgtgcgaagaagatttgttcccaacctcccccagcaaacacagcctgaagaagctttcgtgcagcgcggcgcgcgcgcgcttgcttctcctttttctttaagattgcagctaaagcaaagagctaaaaggtggcgaaacgggaggcctttctcgccgcgctgcgccccctcttcttcgtgccatcgccattgccgcgcaacatctgagctcgggtagccattgctagcccatgcagggcctcgcgtccccgcggtgcgctcccttctgcggccgctccggcgccggcgcgggcggggcgccacgcgcgcggcggcagcagggaggtggctgcggccggccgctggaccgcgtggccgggtgggtcggcggcggcatcgccgcggcgttcttcgcctccctcgagcggtgctcctgcgtgaacgtccgcacgcacgacgagctcgacgacgagacgagggactccgaggcgctgctcatcatgttcgacgtcgtcgacggcagcgaagacgctgcctccgccgccgccggcgccggcgggaggaggggcaggaggagcgagaagagcaagcgaggtggcggcggctgtggcgggcagctatggtgaataattaattagcagctatatataatttttgctatgtatgatcgagatcttgatgatgatcgatggatgcttgttaagtttgtgcaagattatttacgtttatatatatatgtctagctttcatcttgtgaaagatacatattttcttggatgtatggatcgatgataaattgtattcaaggtggttttttgaagttcaatggcaatggaacactgattctcccttccttttcattgtgttctcaagatgtattttccatcctcaaatgatacactgttctattctcaagaaaagttttaagttatatgtaaagatcaattatatggcataatatgtttttatatggttagattgttaaaaaattttagggcaatcatcctatattttgttagttcattcctctctttttttaatgtgcacactaaagcagtggtggttctcactgcaacaaaaagcatctctacggattttttttttcaattgaacatgattgaaaaaccattttcttatggggtaacccattttcttataatccacctaggcgttcaacccaaatgcttcctggctctacgttctaacataatgtcgtgtgtgctccgattttctttttgtaatcatcaggagtttcgttctcattgatcgcatataagagaaggaagaaagtgttccattttctttaagaaaaacatgtgctatttcatgtttttaataataggctcagagcctcagattacaatcggtggaaaaatatattacaatgtcgaacaaaatatgctcaattgccggaagcacattgctcaaccaaacagc

SEQ ID NO: 62268 - DNA, 1724 bp, Oryza sativa
ggcctacggctccatcttcacaggcgctcaactggggatgatacaaaaggcacatctttattatatcgataatatttacattattacaaaggcacttaaggcctgacaatcaaaaataaatagcagcgaactagcgggcctacggctctatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagtaaacagcttttaaaagtcacttagttgcccaaagccattttataaagatgatcctagagctacggagtgttattaatcaaggccgggaaccctcacgaacctgccttaacccaaggcctacgatgattcagaccgaacttgtaacccgaccctgggtcccagctcgtcccaagccaacccaggccaaccattccacattttagttgttaagcaggttttaagaattaaaacgctaacttgggtacattgctaggcatgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccaaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccacgaatagagtacccactagttggggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaacctttggcgacgaccgcgaaccacgcttctggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatca

SEQ ID NO: 62269 - DNA, 921 bp, Oryza sativa
agccatgtgccatgacatctcgactatcgggccacagctcgtgtagccttcatttgtcctagagatgtccatcgacccccgacttcgtccatctccatccgtgtacctttgtttataaccagactgagccacaaactaagccttacccactagacatgtggaagtacggtagtgctttgcaacaaaagcccgagcttaatccttatagtacccgaggtacaactaacaaaacccaaccacacacctcgagcccagcctaaaaccgttttgggggttttgaaaagaaggggaggtgtgtgtccaattccaacataagccagccattccatactgtccaaatgatatgagaattctcaaagtctaaagttataaaaccacctaatgttgcataattaatcagcgaagcatctaccgaaattcatactagtggaaccatgaatagagtacccactagttggggttttgtttatcctagggtgaacaaggtaataatacaatagcaataataataaggtcataacaaaggtaaataggcatggctaaataaatcagtgataacgcgggaatttaaataaagcgacaatgcattaatttaaatcaaaataattttataaactgggattcaatatgctcaaggatgatgtgacttgccttgttcagagacaacggccttccgaaccttcagcgacgaccgcgacccacgcttcgagaacctccggaacgacagaagctacgcgaagcacacaagcaaagctacaagcctataaagaagccaataccattacattaaaaagaaagcgcagggttttttaggttatacaaacattaggagacttgaacgggtcgattcagagttggtatgaccaagacatggtcatcccgaagtttaatgatgttatatggagatttgcggattattat

SEQ ID NO: 62270 - DNA, 1280 bp, Oryza sativa
ccccccccccccccggccccgcgacgcgcacccgtgtcgacgtcgcaacctgcaaccaaattaaggtgatcgatcagtgccgtcgttgcccgcgcgcgcggtcgatccatccatccatccatctatatctgtatcgatcgagtacgttgatggctgtgggatttttaggtggtttggctcctgcgggcggctcgacgtacgactgagactgtatttagttgcaaattttttcaacaaactttcaacttttccattacatcataactttcatacacacgtaaaattttaaccttttcatcacatcgttctgatttcaactaaacttctaattttgatgtgaactaaacacactctgattcagatcctttatctttaaaagcaccatacatttatcattgacgggtggatgtatgagtatttatcgagctcacgtggtagtgataaagacacgtatgttttaaggtagagatgcgtacgtacgacgcggccactagggcactgcatgctcagcttcgctgatctctctgtcgcgcgcgcgcgcgttggaacaaattaggctggtggtgggggctgtgcaccggcggagtcgggccggcgccgccatacaccgcgcgcagctggaattgttatgtacgttatcgtgttactgtggctagccgctctcgtttggggcttttaacctgggaaaaccagagtttggtttccccaggttgtaggcaatgggagtcaattaaagaacgacctactcatctgttggatcgacttgccgtcgtccttggtcacccactcgatcatctgtgtcttcttctcgatcgggccgggggtaatcatcgcggggaaagcgacgcgatcctcgtctgcgcatggacacagatagtgaccggccccagcttagagcaagtttaatattatattataaccaaccactagctctaaaatatttatagctaatttaatactcttaattcatataataattgcttactgtattattaatacctagttccacatgtcatatatacattacgtattaaagtccgtactgcagctggctacagatagactgttgctcttctctcttctcttttatttctataaaatatatttatagctagctagcttataatctgagtacctgctctaaataggactggtaaattaagctactacatcgttaactcttcatgtaacgtttgactatttgttttatttaaaagtagtataatattatttattttgttacgacttgttttattatcaaataaaatataatcttaatt

SEQ ID NO: 62271 - DNA, 977 bp, Oryza sativa
tgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaatgggtcccgtcaccggcatcgacgacctcgtcttcccacccgggcaggcgtttcggttcggcagcctcgacttcatcaccagcaacttcggcaagatttctctccttgactcggaatcgaaccagtcgggagagaaccggatctcagtcccgtttggattcccaaacgcggctgaaacctacttcaagaccatctcactcgagtcggcttcaaaccactcggccgagatcgcatcttctccaacgaca

SEQ ID NO: 62272 - DNA, 3753 bp, Oryza sativa
atatagttcatccccactaagtgtagttaatattatttatctcttctctcgttaagccacatcaccctaattatttctaacctttggatgatagatctatggctcaaattatctcttcttaatttcttctctcgtaaaatcatgcaatctcaatttttttaggctcaaaattgtatcaatttgttttccttttgataatcttactacatcttatttgtacatattatgtaacataattttccatagcaacgcggcagagtatttactagttatataggattttagcatatcatccgccaatgagcccagaacaatcgtgcaaggttacgggatgtggatctgccatcgtcatgaatctattgattggcacactaaccagatagttgctttggtttaacatttgttattcggtgagcattggtagagaaaccatctttggtcggtcgacccaaatctacaatagtcccggttcgattaaaaactgagactaaaaagtcccggttgttgttaccaaccgggactaaacattatctttagtctctgttggtaactccaaccgagactaaagttcatctttagtcccagttaattccatgtcaggccgtgtcagggccctaggatttttagtcccggttagtaacacctaacgggactaaaaacttatttttagttccggttgatgttactaaccaggaataaaaatcaaaaagcactatataatccctagtacctatactctttttccgtccacacaacaaactcctccctctatctcttttttcctgtctaatttcttatgtctttccttatctctaactctggcttttctttcctttttttccttcaattcacagcgaagaagacgactggcacgaggagaacgggccggccgggcggcggcctgcgtggcggcgccagggtggcgtggcggcagccggcgcggcggcgcggggggccgcgcggaggcggcctgcgcgcgcggcggcgtggggggccgctcggcgacggccggccggcaaactgcaccagctagaacgcccgccctgtcctccgatcctccttctgcatatgtaaatcaacacatctctatatagtattgtgtggcctctgttgtatgcctgcccaccaaacgaattgtgtctctaactcgtgagattgctgtcctcgtttggtcgtattacatttgaattaagctttaaacttgtgatgtaatttttttaagagtttgtgatgtatttggagatgatctatttgaggatttggagatgttatgtgatatgtgatgatttagatttgggatttcttggtatgatttgaggatggtgtgaaatcaatattgaatgttaaaaacaatgaaaaagaaataaagaaaaaagatctttagtgccggctgataacaccaaccggaactaaagatggatgtttagtcccggttatttgaaccaggactaaagatagcgatctttagtcccagattcgtagtcccggtacagggggttacgaaccgggactaaaaagcacttctccaccagtggagattatgctctattggaacctagaaattttggaaatcttgtttattataggattaagggactactccgtagttgtgctactttgttttcgatattaaggtaaccaaaaacaataaatagtgtagactgtgaaagttgttcgatatttggggcttgtttagattgtagccaaaataaaccttaccaaattttgttattaccaaaattttaacaatttggcaatattgctaagttttgtcaggatttattatttattttttagagtttggtaagaaactaaatggatgcacatatttgacaactttgaaaaaaaaaatatggtttgaaatggcattaatctaaacaagtgcttaaacaagtgcttggttttgatttcgtggaatcttccagatgggaaagttgaagggaaacattaccgtttgaccctgtaaaaggcaaggagaaaaatcttgcatggtgttgcacgcatattctgctataaattattcctgaatatgcagtagtatatctctcttaaccactaatgttgatccttttatcttctctatcgatcaataaggcaaatattttgccttaatttcaattttcttaaaaaactaatgttagaaaaaagaaagttgtttgcatccgaatctctacatctatgtttacgcagacataaaggccaatgttgatttgtgtttccataaacattttttagttatttatacatgtatctagattatagataatttaaattagtagttgaatacaagtgctttgctacagataataaaacaactttatctgtctaaaaacacaactacctatgcccttgtctttaacaaaagactaaatttgggatgataaatgtttgtggttgattgagatgagaacataggtggagaaatggttgtattttttagacaaatttaaattctagaagtagttatattctaaaatagatggagtatattataatattacctaaataaattataaatatattttctataaaatatattatctatcatgcttgtcagtgtcaagcgtaatgcataccatacatggattcatggaatatgacaataccatatacccgattgtatacgagaaggtgtctttgattaatgaaatatggcggataaataataaattagctactcggaatagaaggtgttagagtctaagtcggagaagataagatctccttgcccgtattctgttttatctctccgattctctgagttctacttgaagaagaagaggatctacactatatatacctatgttttaaatagcgggttaaggcatttagcggttagcgcttctcaaacagctataacagcagttatggcggtctaaatggagttatagtgcctaaattgtacatgagatcaaatagttagaacccttatcaaaccactatagccggagatagcggcagctatagtgggagatttaaaactatgatatatacaaggcccccgtgtgttcagggaggggcatcgagttacaagtcatagccaaagccatattaagaaacaatttggaggaagccagaaactgtattcgctgaatagaactcgtcggaccattctcgacagcttctaattggtgaattagactagttttcctatttcccattgtaatctttgtgacatcctatccataaatccagataaactagactagggttattactctccttttgggcccgaaccagtataaacctttgtctcttgcctgcttgatctgatcttgtgtataccatggttccaataatctttatactttacaaattaatctcgtcttcgggtatagcccgtcgacaatgctgctatagggaatgttcatcttaatttaactttagatgtgactatccatttagatttaatttattttttatactaaggagtttgagggataatttataaaagtacaacggagataggtgggatgacagatttactgtccgcttcactacttttttataagtaatatagaaagctagaagaccactctaagctggtccactttgcatcaagttgcattattattcaacaatgactatgaattttaaagtttttctgagaatagtagttttagggatactctctaaaaatctattgagtaatcatgaaaatagagctagataacaaaattgaaaaaaaaacttttaaaattaggtgtaaacacatgctaaaatgtggataattatttactcgtttggttcagg

SEQ ID NO: 62273 - DNA, 540 bp, Oryza sativa
cgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgacatgacgcgccgccgccgctcgccgtcgctaccgtgcgcggtgcgcgtgc

SEQ ID NO: 62274 - DNA, 2235 bp, Oryza sativa
catacccctcaccccatcctagccgtgacaaaaagtaccgacccacccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaattcatactagtggaaccacgaatagagtacccactagttggggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaacctttggcgacgaccgcgaaccacgcttctggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgctgttgacatgcggaccccacatgtcaacctaaaggaccacggtagaccgagtacacagagacggtccacgggtcgacggaagcggaccccgtgtgtcaaccgaggcgaggggccaacaaacggactccactagacaccacacgggctgcacacgtggaaaccacgtggctaccgagcgggcacactaacacggtcaccacacgcacaagcgaacgactaccgacaccggtacacgggtaccggggtcgacaaccgcacaacgagcatgggcgacaccggaaggacgaggacggggcagcgagaggagagagatccttaccaccacgcgacgaggcgtgggaacgacaacgacgaacgggcgcggcggaggcggacggcgagggaacgacttcggcggcgatccttgaacgaaggcgagacacggccggcacgaggcttgacgacgcggaagcgaggacgacgaacgagaacggcttgacggagggacgaacgccacgacgatcgggaacgacgagaggacgaggacgacgacgaccggggccggcgagggggcgacgagggacagccagcagtggctgcacggagacggggacgacgtggaacacgccgctgcgatgacgatgacggaggcggcgccgcgagacgatgagccaggcgaccgatgggacgtcgatcggcgaggacgaacggtgacgaggaagcgacgatggcagccagcagcggctgcgcggaggaggggacggcgtggaacacgccgctgcgatgttggtgaaggtggtggtgcagcggggcgacgagccgacgaggaggaatgggtggttggcgcggcggcggcgttccggcgaacttcgggcgacgccgcagccgggccggagaagaggatggcactaccgcaccgacagaggtggcagcgacgtcggccggcgctcaggcgaggcggcagggatggctggagccggtggagtggtggcgacaccactagtcgtcggcgaggacgcgtctccggtgatttccccacgaaacggaggcgaagccgggaaagaggaggcag

SEQ ID NO: 62275 - DNA, 6168 bp, Oryza sativa
aaacaccacgtctaagaaattaatatctactttagtgtgtataactcaccaaagcaatcattatgcttttgttgattatagtgaacaataatcccgtatgctatttaggaactaaccaagagataattctcataagataaatctaaattactcaggaagaatattatattgaattcagagtaataaacagaataaaagaaataggagatgattaccgacaactccggaattcttccgacttcttatactctactttcttcctattctaatatacaatatagtatagtagagcttcttataattcagctcaagcttggaagtgtgtgagtgaagtgagggagtgatgtctttatatagaggtaggtatgacggttggcgaaggggaaatgtccgaagtgccctccaaccgtcatctgggatgcatctgagacgtccacgccaaaccccacatccaacggtggagatgatggttcggccgaaccagggggttcggccgaacctgggctgggcccatcttgcctggcctttagcccatgttctcccctggtcttcctctattcattcttcggtattttgggttgatcctctgatgttttgatgaagtttacaacccttccttgtatggatacataattctcctcactttagtctagatttcctcccaacatcggggtttatcgcctgcatacaaatatacaccaacacttgtggaatatgtgagattaagcacctatcactatgttggatgttttattatctgaactttatgcagatgttggcggtatagaatcggcatttaacagccgccaacaaaaccccccacacttagctctttgctcgtccctgagtaaaggttagtgtagaatgaatttcttcaagatatgaatcaagcatatacaccattaacaaccatacctgtacttgtgaactttatcagtggctatcttaccatcttgagtaattgatagatggaatgatctcaattccagtccttcttgcttctttgtcagactcatgggattttttatgaattttcgcaaaccaactcttttcctcatattgactttctctcttgtctctcaaggattttctttttggatcctcaccaaggcaaagtgtgccagaattttatcccttattctaaggctgatatgtggagcttggtagggataaattgtgatatacctgcatcatatatatcgcgaagccaaaaatatggactcaagaagatcatcagtcatactcctagatcaagggtctttatttgtggtggaaaatggaaaagtaaaatattttgtggaatgatggaataaagaaatgattctcccctttttcctataccttctcctccattttgttttcttggcatgaatatgcaaggggcatggctatattttcttttcatcatgctcaaatattttgagagcaagttttatttccttttctctcttttctttcatagccatgcctttccctccttttctcattttcctttttgccaagaacttttctaggagaagaaagcatagtctaatgtaggagtttatttgaatgaaatctttgtgggaagccagcttccagtgtagaagcttagcttaattaaatatgtgaaaatgaaagtggaaatgaccccttgatcatgagaatatgaaagatatctaacatgagtcacacaaatttgacaaagtttaatataatgtcaagcagtcatatgcataataaggtttatcaaagatactcttgcatatgcccttggtaggtataacatggagtcaattggaggattgaacttttgaaaaaaaaattattttgaaaacaaattcccaagagtcataacaagagttgcaaaaattcctttcatcttgaatcatctcacataaagcaattacttagatgcataaggttccctaaacatggatggttgttcaaaagcacaagtccagctgagaatcatgaatatacaagatcaatcttatgaagaaatttcattagttggaaattttatattttacttatgcttgaaccaattgttttctgaattttcagctctagtactatatcatggtggagatatacagataatagacgtgctcacctgcttacctgtaaaaattgagaggaattggagccaacactggttcggccgaaccactctggtgcccaatccttctgcaattttctgtagagtacagtgcctttcaggtgttcaaagattcaacaattttcagagtatatgcacgtcagaagctgggatatctcccccacacttattcaaaatctaaactttattaacataaaacaaaaaacaactttggcaaccattggggttaacaccaatgagccacattattcatagtaagtactttacatgattggaaaaataaaaaccaagcatctactaccattttatttatgggaaaggagacatctaattagcataatacttattctccttccatctctatgaatgcacgcttgattttagcgcacaaactgcggctaagggtaccaacattatttctaatctcagcgagttctacccctagctccgtgttgcgatccctaagctctatgttctccttgcggagtttcttcacttgagcggtgagcttatggaccgagggctccggcgattttacttcatcctcttggattttgctgggagccctcacgattggagggggcgtcaagtgatgcttcaccttcataggtggagggctacgggattctgttgccccctcattctccgatgccgtcaaaggccggagtaaacctttgccatacctaccgctgggaattcgcactcccatgatgcagaatcgctcctcctttggagtggatggagtagcggtgggtgtggtgtacttgtggagcacctcatcccctgccttggtgaatagggtgcccacatatcgctcggcgggaggcggagcgtgtaacatcccgcctctcccaggctaggcctacttacatctggtagttttcataggtcatagactgccctcacaaaccaacacaagtcagcccacttacaagactgccctcacaaaccaacacaagtcagcccgcttatatctggcagctttcgtaggtcatagactgccctcacaaaccaacacaagtcttttctgcacactttgtcctcactcatgagcaatcgggaagaatttcctgatcggtcatccatccctaaattgctccaggccaaacacgcttaaccctagagttctttggagatcggcttccggaaaagaagttgcaacttgttgatatgggtattctattaatcctattaagccctaggccgggatgtcacaatcctcacccccttaagacaccgacgtcctcgtcggttgcctgcgcaactgcgacacacacgcccgtgaaaccgcgagagtcggctctgataccattttgtaacgtcccgcctctcccagactgggcccgcttacatctggcaactttttaaaggtcatagactaccctcacagaccaacacaagtcttttgtgcacactttgtcctcactcgtgtgcacccgggaagaatttcccggtcggtcacccatctcgaaattgctccgggccaagcacacttaacctcagagttctttcgagatcggctttcggtaaagaagttgcaacttgtttatatgagtattctattaatcctgttaagccctggcgggatgtcacacagcgaccttctcatcatattgaaaaaggcgtcgcgctttcaaaataccgagctctcccatagtcggccatcacgcaggtgaatccccctgaattttttgtcttcataacatggcgaggggagagggatcgcgttgccgaacggggccgaggagggttcggccgaagccctggttcggccgaaccacggagctcaccgacgggctacaaatttgcaggggagcctgacactattgcgaggggctgcgcccacagtgcgtttaccccttccatcgtgtagttttccaccgggatcaattgattcgctggtgttggctctccgtcgagattataggtggaattagaggaggagccaatgtatgggatcaaggacttgccagccattggtgagttgtgtgtggagaatcaaggaattgaattgggatgaagaaggagtttgcacaagaggaggagaggaggaagaataagtgctctgagctttgatccgatcgatctacctccgaaagcgcatcacaacagactacaaacgagcgagggaattggaactaatcgggcgccgtcctggtttggccgaaccagtaggttcggccgaaccctggtgggtccaactggcggccaatttttccctaggcccactaaattctaaactaagcacaaaagtgacaactatacatggttttaagcatgcattagatgagatcatcatggttcatgatcgattaattcaataacatccacttcttcatctaaagtttcatttggttcaagaaaaatctttaagcgttgaccatgtaccttgaatattttacctgagtcgtcgcggagtgtgattgccctgtgcgaagaggtgtcgatgacatcgaacggtatgttgatgatatgctgatgattttcccctagaggtatgtacttggataccatgtagttcactatgttggcataccacgggttggagtcgcgaaccgtcatcagcatatcatctctcaagaagtcatttatcggctgttcctgcatgtcaatgatctgcagtctagacaaatgatctgctacagaattttgtactccctttttatccttaatttctaagtcaaattcttggagcagcaaaatccaacttaagagacgtggtttagcatctttcttagtgagcaagtatttcagagcaacatgatcagtatagactatcaccttagctcccaccaagtaagatctaaacttatcaatagcaaaaacaaccgcaagcagctctttttcagtagtcgtataattcaactgagctccgattagggtttttctagcatagtgttgacgaccaaatttggtaagatatgtacgaggttcgacattggaatcgaatcggattcagcaaagagaggattcgaagaacagagcatgcatcggctacgaaggcatcggttggagtctgcatcggctgagatggatctgacagaggacaaccgatagaggtgatgcagccgattccgatgatgatggtttcaaagatgtttctagaatcgatcaaggtgcttcacgaggattgccgtgatggagataaagctctatgatagggaattgtatctattaattaggatatttcatgtaatttccttagagatatgtttaggcaaaagtctgtcacaaagacttatggtatcttagagtttgttagagataagtgtcgagtccggcaattacatattttgtacctcgagtataaatatgacccgaacccatgtaatcaaacaacaataattcaatacaatctcggtgcatcgccaccctttttactttcgtttatttcgacgagttcttgctttcgggttgagctgcatcggattcgatcttcaactagaggtaaaacttgttatggtggcttgcgttctcggggttaatgcttccatcttcatgacattttaaccctatttatgtaattcgccgagttatcatatacatgacacaatctatgttgtgctatataacttgttatcggctggttcttattgttaggaagcaatcgaaagagttatgtgtcgcgaccgggaaaatttcattttcccgaacgctactgtattaatccccgtcccaggaaaagccggggtacaccatacaaacatgatataaaagacgcatctttattatatcgataatatttacattattacaaaggcacttaaggcctgacaatcaaaaataaacagcagcggactagcgggcctacggctccatcttcacaggcgctcaactggggtataagccaggactccacctaagacttcttctctaaagcttctcttactgaagggggaaaagatagagcaagaatgagtacacccacagtactcagcaagccacaccggagatgcataattaatgcaagggagtacaaggggataataatataggggttaagttttgcagtaaacagcatttaaaagtcacttagttgcccaaagccattttataaagacgatcct

SEQ ID NO: 62276 - DNA, 2880 bp, Oryza sativa
ccactcgtcaaatatggccgtttcatatgagaatgtcaagaagcagggatgtgttgagatcgtaggttttttttgtgcgtgttctcctctttaacgaggtgtgagtctaagtgctcttgtatcatttggctgtgtatatccctcgtggatatagaggccggattaatgaaaatccattatctattaaaaaaaaagatagccccccagaagcccagttactcgtaggggatcttttctgcacctccggcagatatcatgttagtaggaacctgcaaaacaaatcatctaaaagaaactactggaaaattgctaaagcgaatcatagaaatttttttgagtaaatttcacattggaccaccattacttaccaatgttgtggcttggaccaggcatgagcgtttcttttcactttggaccgaatgtattaaccaaatattccatttggactggttcttcttcctttggttgtcctcccttttctgttttgtgatgtgcaaccttgcagtacccgtgaacttggcctccatgctctctgtgctcaagctaacaaatttactgctagagccaaccggagctagcggcgttgagaaaaatgtgagaaaaatgtgaatgcaagtggaacgaaaggaggtgcttgtgctcctggacccggacaaggcagagtgttggaggttgagaccatcaagatcaaggagaggaaaaaaccaggagtaacagagagcatagtgtcgctgcgtcggtgttggtggagcctaccatggacaagcgtgggggtaggggaggggtcctgctcaccaacatggagggctcgatattgagaagggagagagaggatgggggagagctagaggaagaacaggtccaatgtgaaacatttttcaaagaacctaggtccaaagtgaaaagcaagggttacccatagcccaagctgcaacattggtgaaaaggggtggccccatgtgcaatttacttaaatttttttgaagtttttttaaatgagtttcaaacaccaacaccctgtaaaacttaacaaattaatgttttagaatcgaaaataaagaaatccaactgaaagcatagagttatcaaaggatggaatatgaagcgtcaagagagaaacctagaaacgtttgatacaaggaaactgcgattttcatacaagcttcaaggtgcaacaaaatcgatgggtctagctcactacaaggttatttattttcgataaacatggacacaactatacaactcaattatacaactcaatcataagttcaaaattaacttctgagcaaaataaatcggtcaggtgtaaatgcaaaagaatattttgtttttataaacgagaaaataaagttcaaacaaacttaaaggagatgaaccatgacaacccaaaaaaatttgaaactcgaaaaaggatatttgaagaattgatgcaagacgaacgttttaaaatcaaagaatccaactaaaagtacaaaatataaactcttggatgaaaaaatgaagcctcaacggagaaaccaagatattgtttggtacaaccaaacttcgatttccataaaatcaataagatgtgaccaaatgtagacgtctagcccacaactaagttttttttttcgataaacaaggagacgtaactctagaactttgttataaggccaaaattaaaacgtcagagcacagaaaatccgcaaggttgaaatgcaaacagatattttcttttcgcaaactagtaagtataagatcaaacaaaattaggaaattaacaattcagaactaaactaaagctttaaagtccaaagcgaggatcaaaagtgttaatacaagagaatattcgaaaataaagaaatccaactaaaagcataaagtataaacgaaaggatggaacacgaaacgtcaagggagaaacctaaaatcattcgatacaaggaaaccgcgattttcataaaagcttcaaggggcaacgaaatgcatgggccttatgcacaacaaagttatttgttttcaaaaaacagggagaccaacctctacaactcaattcaaaattaacgccggagcaaaataaaacggccaggcttcaatgcaaaagaatattttgtttatataatctagaaattaaagttcagacaaatttaggtaagacgaacgataacaaccgaaaaaacaggaaactccaaaaaggatatttgaagaatcgatgtaagaggaacatttcaaaatcaaggaatccaactaaaagtgcaaaatatatctggatgacaaatgaagcctcagcccgcaaggttgaaatgtaagaaaatattttcttttcacaaactattaagcataaattcattgaaaatgatatttccgaactaaaataagcattaaagtccaaaggaaagttccaaaaagataaactttgtaattgaagaaatcaaacagaaaataccaaaatgcatgggttcaggtcataataaagttatttgttttcaaaaaacagggagaccaacctctacaactcaattcaaaattaacgccggagcaaaataaaacggtcaggcttcaatgcaaaagaatattttgtttatataatctagaaattaaagttcagaaaaatttaagtaagacgaattatgacaaccgaaaaaattggaaactccaaaaaggatatttgaagaattgatgcaagaggaacatttcacaatcaaggaatccaactaaaactgcaaaatataaacttctcgatgacaaacggagaaaccaagaaatcgtttggtacaactaaactacgattttcataaaacaataagattcaaccacatgttgacgtctagcccgcaaccaagacattttttttgataaacaaggagacgtaactctagaacttagttataagtccaa

SEQ ID NO: 62277 - DNA, 1121 bp, Oryza sativa
taaaacaaagcttttaaagtacaaagagaagataaaaaaagagaaacattgtaactgaagaaatcaaaccaaaagtaccaaattgaagctcaacgatgaaacggtaaagaagtccaattaaaaacataaagtcaaagcataaagcataagttcaaacaaacttaaggaagacgaactgtgacaactaaaaatattggaaactccaaaagtgatatttgaagaatcgatgcatgaagaacctttcaaaatcaacgaatccaactaaaggtaaaaaatttaaaacttatagatgaaaaatgaagcgtcaacggcgaaaccaaattttttttttaggacaagcaagctacgatttttataaaatcaataagatgcaaccaaatgaagacgtctagcttgcagccacaagattttttttccataaatagggaaacgtaactctagaacttatttataagtccacaattaaaacgtcatagcacaaaaaagccgcaaggtttaaatgcaacgaaatattttcttttctcaaactagtactacctccgtcccaaaatttagctatttttagcacagtaacttgtctcaaaatgaagttatttctccacgtaccctctcctctcaaccgatcacaaccattctcttcacctactctctcttctccaccaatcacaaccatgctccaattatttctatctactttcctaatatccgtgcctacctaaaaaatacatacattctaggacgaaggaagtatgcacaagttcatagaaaattacggaaaatgagatttcagaactaaaataagctataaagtccaaagggaagttccaaaaagagaaattttgtaattgaagaaatcaaactgaaaataacaagttgaaactagaggacgaaaaaacaatcggtaagtgaggaaccaaattaacgttttaaagtccaaagagcaaatcaaaaccattaatagagaagaacgttcgaagataaataaatccaactaaaaacataaagttcaaacgaggaaggaaaatgaagcgtcgagggacaaaaaagccgcaaggttgaaatgtaagcaaataatttcttttcacaaactagtaagcataacttcttagaaaattacggaa

SEQ ID NO: 62278 - DNA, 6540 bp, Oryza sativa
  unsure (1)..(6540): unsure at all n locations
cgctgcctctcccggcacagcagcgccatcctcttccccggccaggccacggcgtcgctcgaattttaacggaatgttgtcgcccgcgccggtctcgccctccgcctcgccggagttcctccggcagccccttccgccgtgcccgtgcgtcagccggcgctgccgtcccctccctcggcaaggtgacgtagccttccacctcatccactcctcggtttcgcccagaagccgccgcacatcgccgcgaacctctccatccgcctagccgcaatttccccggtcggcccttcctccacccatgcgccgtcggccgcaccaccaccaccttcagaatcgcagcggcaaggtcatcctcggcatcgccttccctccatcccaacccctccactgtccgtcgtcgtcgtcaccgttcgtcctcgacgtcgacgtcccgtcgncggcccggcacatcgtctcgcggcgccgcctccgtcgtcggattcgcaacggcgtgttccacgccgtcctcgtctccgtccagccactgccggctgcccacatcgcctcctcgctggccccggtcgtcatcgtcgccgtcctcccgtcgttcccggtcgccgtggcgttcgtccctccgtcaagccgttctcgttcgtcgtcctcgctccgtcaagtgccgcagccccgtcatcgtcttcgtcctcggctccgcgtcgccaagccttgtgccggccgcgtctcgccttcatccaagaatggccgccgaagtcgtcttctcgccgttcgtctcagccgcgcccgttcgttgtcgtcgttcccacgcctcgtcgcgtggtggtaaggatctgtcctctcactgccccgtcctcgtcctttcggtgtcgcccatgcccgttgtgcggttgtcgaccccggtacctgtgtaccggtgtcggtagtcattcgcttgtgtgtgtggtgaccgtgttagtgtgcacgcttggtagccatgtggtttccacgtgtgcagcccgcgtggtgtctagtggagtccgtttgtcggccactcgcctcggttgacacacggggtccgcttctgtcgacccgtggaccgtctctgtgtacccggtccaccgtggtcccttaggttgacatgtggggtccgcatgtcaacggcgcagccttcctgtcttttccaggctagcgcttacacatgttttacagttgcaaaacctaattataataatccgcaaatctccatataacatcattaaacttcggatgaccatgtcttggtcatacgaactctgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttctcgaagcgtgggtcgcggtcgtcgccgaaggttcggaaggccgttgtctctcagcaaggcaagtcacatcatccttgagcatattgaatcctagtttataaaattattttgatttaaattaatgcattgtcgctttatttaaattcccgcgttatcactgatttatttagccatgcctatttacctttgttatgaccttattattattgctattgttattattaccttgttcaccctaggataaacaaaaccccaactagtgggtactctattcatggttccactagtatgaatttcggtagatgcttcgctgattaattatgcaacattaggtggttttataactttagactttgggaattctcatatcatttggacagtatggaatggctggcttatgttggaattggacacacacctcccgttcttttcaaaacccccaaaacggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgagctgtggcccgatagtcgagatgtcatggcacatggctggtgtcctgctgctaggggctcaatcttgcctgcctgtcccgcaggttccggccgtaggtggggttgggtcggtactcttgtttatggctaggatgggttgggaactatgtcacgtctttcatccgtatgccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatggttgttaagccccatcaaccgttctcagcgcgacccctacctgacacgtgaactgtcgatattttgtatcggtaataataaaaggggtagcacacaagacttaaaagtggatggatacgaaagacaaggattttagacaagttcagaccctttcgatgagaggtaatactactcatgtttgaggatgttttcgacgtttgagatcgcgactacagtatttggatggtatggggatcgtcggtaccagggtatatgcgagattgagataaagagatagagatagggatttttataaaggttcgggccccttatctgacaggtaatagccctacatcctgttggccaaagccggtgttgctcttattcatctgaatcacacaagtacaacatttgggataacctatctagctgtcgtcgacttggcggcgagataaccaacacgtagtcgaagatagggcagtcttcctccttgaatatgaatccgtcgagatccgagatggcgctagatccctcttgccggtctccgtatacaccggatagggtatgtctagactaatctctaatgccgatatttggcggcgtattggtttgtgtatatgttgtatcttgtgtcttgtcccctctcctcctaggggggcttatatttatacccataagtgccctcttgtccaagttgaactagggagaccaatatggatacaaatcaagtagtccttgttgtttccatatagaactctactcgtccttccttatctggaactccttctatatacgaagtttgtttccgtataagacatggtatgtggtgggccccgccgagcttaatcgattactattgggtatgtggtatccataaccctaatagtagcccccgacttcaatacaaatgaacgagttaaggttctcgatcgaagactttggaacaactattgtcgtgctcgcttgaccgttctcggtatgatcagaaataacactagattcctcttattggcctttgtaggcactatattaggtttgtctaggttaatctccgatgtcgaccgagaagatacggaacatgcgactaagtctcccgtcttgttgtaatcgagaatttggattgaagtgaagaaattccatctcggcgggtataccatcgcttgattccatattccttgacaagccccatcaaccgttctcgagtaatcgagtaggcgtagagtctgcaacaaagccttgaaatctgacttgactattctaatgtctgactctcctaaaatcaatactcagaacatttgctgtactcgcttagtcgatctcggtgtagaaccatagagacacagagtcttcgacaatgttgaatagaattttcatgaaatcaacactcagaatagaatattaaatagaaatagccctcgagcgacactcaaagggtaacatgttataatacgtatggaaaaattgaaaataaacaaaatctgcgtgtgacaataaaagagtactctcgctagagttgccctcagcaaacggagtttggtacccttcctagcccccagctgtttttatggaaaaactattttccacaaagacagcttgaatcttataacaaatcatgctgaagctgacaaatcctagccccaagccatgaagttggaaaagtcaatttccaattacacggcttggttaatacgcatccattgagcactcttacatgaccaggttttacatggttcattcggttcttataatccaacaagaccttatctgttctgggcgtcccctgccgaaattcccttgggtttctcagaggcttgtcagaacagtgcaaagggacaataggaccaccttcaagacgaggcgatataagaagagatcaacggataaatattgcacatgtaaatacttacaaaaattgatgtagatgatgagacgaccaccacactggacaaagaccaagtgtatagttgtactcaacaaatcgcagaagtagtaggagaatagctacaccgctggtcaaagaccagttgtagtcataactcgaccactaaaaattgaggtgcgagaaccgctacgctgctggttgaggaccagtcgtagtcgtaacttgaccattggaagtcgtggtacaaggatcgatatgttgctggtagaggtccagtcgtagtcgtacctcgaccattagaagtcgtggggcgaggatcactacattactggtcgaggaccagtcgtagtcgtacctcggccacctgaagggaatccggagtaatagatggacggcgtcctcgcaacttgcgagaaccgcctcctgatgacgacgaagatgataaggaattattgtagtcggaggttcggctcctggacctactacctcatcctcgggctctctagaagtctggggatctcgagtttcatcgtcgtcgtgtgatgtcgtgatgtcataaccttgtttgttgtcatcctaatgtcgttagtcctagacgttgttgttctggtgacaacggcgatctattcggccttggttgtcgctatcacgataatgttgattgtcgcgttagatgtcgagagattgctgtaaccgactggtcgaggaccaggagtagacgtatctcgatcacctgaagacgaatttttaggtggtgagagatcgctacgatctactggtcgaggaccaggtgtaggcatatctcgattacttgaagatgcatttttaggtggtgagagatcgctacgatctactggtcaaggacctggtgtaggtgtatctcaatcacatataggcaattgataggcacacgaaaacaaaccgtattcgcgaaagcatctcttgttatccgtgactccccttatcaatatttgccgtactcacttggtcaatcccggtgtaagaccgtagagacatggagttttcgacaacgatagatggagttcagcgatgcacaagtgaatttagattgataggcggtgagatgtcgttacaactgtctggtcgataaccaggagtaggcgtctcttaatcacctatagaggcgctagagttggttattacatgtgcatctcatgtggccaacatgactcacatacccaacttatagccggcgctgtacatgagataagtcgtcggtcttcgttggtaggttggttgtgacaactcagcatttttcgagaatgttcacgataaagggatgtactcgaccacatcctactcgagtgctcaattgttcctgaaaaagatatatatagcagagaatatcgagcatgtacttgaaagactgcgtgaatcttctaatattatcatgatataacgagcagattaaatattaggcattatgtaaactgtaaacaagcatgatttatactaaagaaaataaagcgagcccccagtattaaaccgtagtcgacctaacaccggaaacactcgcacaataaatattatatagaaaacatgctctagttaaatataataaattatagatctaacaatttgtattgatctaaagaattggtacggtaagttgtataaaatattacgtacctttacagatatatctacgaagttagtagattgacttaaaaaatcaatataccagttaccttggttgatggtgtatacatgcagtaggcctgtagattaataaatattctcctctagccactcatgtacacgtacaagatcttctcggctgcactgacttgctttgaaaaatcaatatgtcccgtcatcggtagaactcctgctggagactgcccgcgtcgagatgatgcatgtgaagtagtttaatctgagctcctgattcatctgatgcccacgctagtcggcctcccatgaaattttgccacctgccgtctttggttaagtacgaccaaatagagggcaaattgacagaaacaaggggcgccgccatgatggaatcagattcgttgagcagctcggaagtagttgatcaggccgaagtcctccggtcaacaatattggaccattgttgcccgtggcggtgatagtgttccgatctcgtcggaagacatactccggtcgggttagatctccctatagttgaagtcattgagtagcttgttgttggaagaatccatttcttaaacccatttcatcgaacccttgaagcaccaaaatc

SEQ ID NO: 62279 - DNA, 1634 bp, Oryza sativa
tttacgaactagtaggagagaggacaaggtagagctatataatatttggtaggtttaatttgtttgcatgaaagtatcaataactaactaattatctttggtggtgtacatccgagaatttttttgagaattaatattatttttatggaaaatcgcaaaagtagtggccaaccggggaaaattgcgaaagtagctccctgtcgaacgggtgcagttcgatagggcacctatcgaacgacgggcagtcgacaaatccctatcgaacggctggagttcgacaagctcacctgtcgaacggagggagttcgacagggcccatcacccggcgccgcgaggcctgtcgaaccgggggcgttcgacagggccctccaccgaccctgtcgaacaatgggcattcgacaggccggtttaaagccccgtccacccaggccgcgatgcttgttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtatggttaaattagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgttaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaaactctgccttatgttcaccccacgcagggagtatctgggtcggcacacttcccttacatgccaacgggggacaacgtgttgaacacatcagcatggggacttcatatcactccgcgtgcgccagagcagggccacacaccgcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggagaagtagggatggattactggcacgcagcacctcaggtcacacagccgacgcaggagacggaggccggtcaggggccagacgtgacaccaca

SEQ ID NO: 62280 - DNA, 1912 bp, Oryza sativa
aggtgttgttaaggaaggcgtaggcgtggtggaaaatggggtgcgggcgcgcgtggtcgaggcgctcgcggaggtaggcgtgccacagcttgtagctccccgggagcgcattgagcgcgcgctcgtagatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcagggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaaga

SEQ ID NO: 62281 - DNA, 1448 bp, Oryza sativa
agtttcagatgtgtcttttttggatcaaaggcaacaaccgccagtctagtttttgacaaaccacatcaaggtttcactgaaaggcagcaagccaaaggacctcatcgtccccagaagcgtccgcaatccacattaaagaataccagctgttagagataagccgaaagaagattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaagagtgaaatcttcaactcggtatcagatgctacacggagtgaaaagtgcaagcaccggttaccaggcaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagttgcttgttcgtgggagctattcccagttatgaaccaagtgatatgttcgaagatagtctacagaggtcagattaaaatcacatctaacaacgaagcttcaaatttggcaggataatgattagacaataacaaatccagcaataaagccatttgggaagacgtcaaagtatgtcaagtgggataagttggttctcttgagaaacataattcaaaggcaaagttatcgacccttgcatcgaatagcagaagtggctagcacccggagagcaggaaagttaatatgaggcagttggtggcaagttagaagtaaatgacaagcatggtattctcatgatgacaagcatggtatcttagtaatgacaagctagtgttgacgcatgacatgaagtggtaacttgtatgagggtgactccaaagatatgagttataagaagttctagaactgaagccccatcttccaatgccgcagcccagtcgaagtcagctagaggtgcaaccagggaaaagtcaggtgaagagaagattccatctataaccggagatcgagctaagcagtccagagtggagaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattt

SEQ ID NO: 62282 - DNA, 6075 bp, Oryza sativa
atcaaaactctaaaaatacggattttcaaaaactttttaaattaaatgcatcatgccgatcttattcgcctattttatttggatttaatttcgaagttcattaatcgtgagtaaagaatagttaattaggaataaaccctaaaaacaaattgataaaataaatataatttaaaataaagattaggtgtggatagaaataaaatattatcgcgaccatatttggatcaattgaatttaaatgcgatggaataagaattaaccctaattaaaaattcaaataaattatataaataaaatatgagtaatattaatctagagtaaatccattggttggaatgacacaaatattgagtaaacttcatttatacaagatttaggatttatagaatcaaatttaaataataaataggctaaaatcgggttaaataagaaaagtcactattcattgccccctaggtgttcgatcgcgccctagcccctcctctgccacgctgcccttgcgccccgcacgccgcgcgccgctccgcctcccctctgctgtcgccatcgccatcaccgcgcatgccgtcgtcgcctcgcgcctcgtgccgccgcccgcccgtcgccatcgccgcctgccgccgcgccgacgtcgccgtgccgtcctgagcccgcgccgacatcgccacccccgtgctgcgcgtgctgccgtcccgtcgccacgtcgcctcgagccccacgcagccgtcccgtcgccgtcaagcccgcgccgcgccgcgccgcgctgtcctaccgccgctgctgtgctgtcgccgtcgccgtcgctgttgcgtcccgcctcgcgccgcgcgtgcgtcccatcgccgcctcgcgccgcgcgcccccactgccgcgccgtcgctgtcgccatcccgtcgccgccgtcgcgtcacccgccccctctcttccctcttccccttactcctccccctctcccctataaaagctccaccgttctcccctctcctcactccatctccccctcctctccctcttccccttctccacgcgccgccatcgtcgagccgccgcgtcgccgccttcgagccaccgcgccgccgccctcgtgctgtcgtgccaccgcattcgtgccgccgcgccgccgtctcagggtgccgtgccgtgcgccgtcgtcgctgccgccgtcggtgagccgctgcccccccctgtttgttgccgtgccgccgggtagagagggagccgagagagagaggaagggagaagccgagggcgagaaagaagaaggaaggaggagagaaaccgggagggagagagagagagaaagaaaaagaaaagaaaagagagagagaaagaaaaaaagaaaagaaaagagagagagaaggaaaaagaaaagaaaagatagagaaggaaaaagaagagagagataagataaaaaaaataaatagaaattagagggagattagggaagtttagaaaatttaaaataattagaatttaattatagattaattatagtcgtagaattgcaaaatttaatataaattatggattattcttggcaatttctataagaaatcaattcgcggtaataatttagatgtagttaataactaaacaaatagatgaattcttatagattattatagattatttttggtaatccctataagtaatcgattcacggtagaaatttggatttaactactagggattttacccgtgtattatatttaatcatttagtcatagactaaattaaatcgtataatatttctaggattttgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaagaaatcgactttcgcattcgacttttatttggatttatttggatttttatttgaattctaaccaaattcaaatcaatttttgcacgtaactatagagcccgagggagttgcggatccaagcgaaggtcaagacccgcaagacattgagcaaggcaagtcatcactattccctgaacatgttggtcccaattgcgaaattgttttgtttacaaataaaattgcatgcaatgatgaacatcctacttgtgattatgccatgccttgattattatttgccccttattccttcgtaaccatatttacgtatgagtccctagtcaattatgacaattgcttagaaatgctattctagaatcatgcatactcacatttatcaaatgttatatgcttgggcaattacctttgggaaggtaattgagatgcggcatgtggagacatgagcgccacattgccatgatgttgatgacatgatttgtgaaaggagaaataaaattaaacaattgttttcgactggggcggacggtggatttgggtggtatctgggaaaggctagtaccatccccggtcaattaaggaccgagccatgaagttaagcatgaaacgacccccgtacaacagcacttctcgtatgagtatagacctagcggattagatagccgagcggaggcagtatccctgcatagatggttcacccctgagtgaggcaggtgcgctacggtggggcagccgttgaggtagggccgagaggcgtgccctacatcggtgtcgccatcggtaggactgccatgagtgtgtgagagagagaacttaacttgaaccataatttaatatgtgtgtgatacttctctttctcgggagcgccagaactcctctcactgctagaaacatggacgcctagagtgcatgaggatttaagttcatggagcgggtactgccaatgcgaggttatcaaaaagctttgccgtgacgcgtctcatgtgctgggacgaggctcatgtgttgggcaatcgtggagtgcgggtaaagtgtacatccactgcagtgtgagtaaaccaaatctattcgaatagccgtgctcgcggttattgagcaccgggacatgtattacacttggctagactctaaattcttaacttgggtgggatgggatgttgcatgatgatttctatgctgatggagccactttctgagaggcgggaaggtggacgtcctcagaaaaccatgacgactcaatggcgggaagctatccttgggatcataatggatggtggatagaaccgtcattgtttaatatgaacactggtaataaaaatttgatcagtctgtactaggtcttaggtttgtgaaaagaattacaaaacttgctttgcgcaaaagaaccatagccatcctttgaatacccctgtcatatgcattgttgatgtggtggcttgctgagtacggttggtactcacccttgcaatattcaaacttaatcagaggccggagatgaagcttcggaggatccctatgcctattaccaggagggtgatcaagacgatggcgctcagtaggtcttagttacggtcgttgcctgtggtaatggcgtgccgctgccttaactccgctgccttaccttcttctgtttttggaatgtattccggaccgctcggtccgatgatttaagactatgcctgcgggcttatggtgtaatgattcgtactagacactcgtgtatgtgcacttgatatttcagctaagaattcatgtgtaccagactacttgatccagggaaatggtactgtttacacgattgattcctgttataaaaacgggggtccacagatactcttcgacattgttgacatcccttacaactacaacgccatttttggcagaggctcgttgaccaagttcgaagcagcttctcatcacaattacctcaagctcaagatgcccggcccggtcggtgtcatagttgtgaagggttctcagccttcggccgtcacagttacacgtttcggcagagaggttcacactgtagaagtcgaagaacaagagaagacaaaaccagttccaaagccgaccccgcatggcaatgtcgtccagcgacagctagacagttctgacctagccaaggtcatttcacttggtagtgatctaagcgagcaagaagttgaaggcatcctagccgtgttgaaaaagaacattgacattttcgcctggggaccagacgatgtggggggcgtttcgccagatctcataatgcatcgcctcgcagtcaaacctgaagcaaagccaaagctaaggaaaatgtcatcagatcgccaagaggcagcgaaagcagaagtgaacaagctgctgaaagcaggggtgattcaagagatcgaccacccagactggttagcaaatccggtattggtcagaaagtcgaacgccaagtggcgaatatgtgttgacttcacagacctcaacaaggtgtgtgcgaaggatgatttcccattgccccgaatcgaccagctagtggattcgaccgacggatgtgagttcatgagctttttggatgcatattccggatatcatcatattcatatgaacccgacagacatccccaagacagcgttcatcacacccttcgacactttctgccatctcagaatgcccttcggcctgagaaatgcaggggccactttcgccaggctcgtgcagaaagtcctggggttgcagttgggtcaaaatgttgaagcctaatttgatgatattgtcgtgaaaagccgcaaggctttcgaccacacatcagatttgcaagagaccttcgacaacctcagaacagctggcatgaaactaaatccagaaaaatgtgtcttcggcgttcgtgccagtaagttgttgggatttcttgcgtccgaacgggggatcgaagcgaaccccgaaaaaatcgatgccattcagcaaatgaagccaccatcgagcgtacgacaagtacaaaagttcacggggcgaattgtggcactaagtcggttcttgtcaaaagtagctttcggtgagcttaagcaataccttcaaagccccccagcactggtcagcccagcagcaggtagcgaactatagctctatctggcagcttcgcctgtggcagtcagtgtagctctggtgcaagaaaccaaagcgggccagaacccggtttactgtctctgaagccctctagggggtgaaagtaagatacatcgaaatggaaaagttagcttacgccctgatgatagcttcaagaaagctagcttacgtcctggagcccgagcctatcgaacaaccatgggttatgcactcagatggcttgtggtctcacaaagggcgggcaccgctgcaatcctaacttcgccaggaggcataccaattcagtgtgcagcaagattacagttcgacacaaccaacaacacaacggaatacgaagcagtattattaggtctgagaaaggcgaaagctatgggcatgcggcgcttgctagtctggacggactcaaagcttgtcgcaagccaagtggacaaatccttcgaggcgaaagaagaagggatgagaaaatacctggaggccgttcggtctatggacaagagtttcgctggcataacggtcgaatacttgccccgaggccagaatgaagaagccgatgcattagcgaaatcagccgtttgtgggggactgcattcgccaggcgtcttttttgaagttctttacacgccgagtgtgccagaaaacagccaggacatcatggcaatcgaccaggtcgagctgggcgaagacccggacgactggcgaacgcccttcgtcaaatatctcaaagagggatggctgccagatgatgaagcaaaggcgaaacagttgcaaatcagatctacaaagtacagcttagtctctgggcaattgaaccgaaccgggatgctgtagcccatgcttcgctgtgtctccttttccgagggtgaagaaatgataagggaaatacaccaaggaatgtgtggagcacaccaagcagcaagaactgttgcatcaaaagtatttcgccagggcatatattggccaccggtactaaaagtatgtgttgagcaaatcaagaagtgcgaaagctgtcagaaacatggtcgaagccaagcggcccctcagtacgacttgcagccaat

SEQ ID NO: 62283 - DNA, 5677 bp, Oryza sativa
cgcataccataaacatgacaaaggtagtacacatgcacagatgtaaaagaagtgataccttacctttttttgcagcttcatgaagaggagcaaagcctgctgcatctttcttattcggatcagcacctttgtcaagaaaatacttcacagtaatctcttgtccatccaacacagcgcaaaacaaaggtgtcatacctagcaagggcattacaaacaagaaatttaatcagataactccaacaaaacgatacaggtagtgttgtggtataacagctttgcaaatgcacaaatattagctgctacaattccaaatatgcaaaggagcacttcatgaaatacttatagctcagactgcatttatatgacatgcaatattaaacaatggaatcattcagaaacaccacttaataagttcatatcaacaaggataatactatagttaaaactatacaaaactcccatttcccaagttcttagaaccaaaatttgatggcatgtatataccacgcaaaaggaactagaagaaaaatcaagtgcataatagatgagcttcacaaagtgaactgcatgcattgtctagacacaactgtaccaatcaagagtaggcaaaagcaatataaaaaggaaggctgaaggagataatccttcaaataagaataaaaaggcatatcaccaacactttgctattgtgattctttcttggatgatgttttcttatattatctatggcccgttacaaaaaacaaattactagattagtgcaggaattgagttttcttcagggaaattcttgcagtactccctcagaaaatactacctcacaagacatcatacattcatacgtcccaaaggtgccacagaattgtttgttttcattaaaaaaggtgactagtcaagaaacaacacttaagaatcaaattatagtactaaacggatttattcacatagcagtgttacattggtgtgccaattcagatagcagcatgtcagcactatagttaatgtctccatgataaggtaaagacagttcctgaccctatcaagactaacctcctcacatacaacagctcccattacaattgcattgctcacgggagatgcactaagcataataaaacaatgcaataacctggaaaggcacataccggaatcatgattagcttcggcattgacatcgaacccaagctcctccaccaagtacttgcagagatcaatttttcccgagcttgctgcctcaaacagtggctcatacccctccatcctcacagaggtgagcgattgccgatcatcctcatccatgctatcaaccacctcttcaataccgaaagtttcaaaagaaaagtaaggcgcaaatttgcacaaattgtaattctagttcatgcagaagttgtttttttttgtgtgtgcatgtgcataaaacaagatcaaagttctagagaaatggagacacaagtacctcacgaaaatcacatctaagcacttagaaaagaaaacaaaaccaagtggaagagatctcttacagaaatatggcatcataaagataagtagtattagtaattattaatcaaaagaaaacaaaaccaagaggaagagacctctaacagaaatatggcatcataaagagaagtattattagtaattattaatccctattaagaataatggcaaacaaacaaattcatatccagattactagattagtaccaatttgaaccaaaaatagacaggaaaaccctccgccgcattaaacacacatacacttctatcaacaacacgcacgatcggggtatacacgatcatatcgtaacggaaccagaaacgatgcatgaggctaaaagccatctcatccaattgtttacacaaatgcacaaaaagatgggagaacacatttgagtagaatatcccccaacaaagccggcacagaaaatgctgaaaaaaagttcccgatcaccagttcaccaccacacggaagctaaaaaaaaaagccctcaaaaccctaaccaaacccctatcccaggaagaagcacgagcagttcgggagtaagacgggcgcggggtagagccgtaggatctcacccttgaggcgcgcgacgtcgccgtccgtacacgccatcaggaactccatctgcggtggcatcccgccgccgacatctgcaaacacgcacgcacgcacgcacgacgaacaacaccacccaacccaccattagagatcccttccggagagcagaatcagcccgagcagaaacgatcggggagcagcggacagcggccgcttagcacgtactgatggtgcacccgaagccaaggcgggtggcgatgccgctgattgccgcggccgccgcctccgcctgctggccacgcgcatcgctcccgcgccgccccattcccggccctcctcctccgctccctccaccgccgcgatccacaccaccaccaccaccaccaccgccgccgccgcctccgcctccgccgtcgcggccgcggtgccttcccttatccttcttctccatggagctcagcgagcacggcgagcagaatgggatgggggcgaatgggcgatgtgggttttgcttgcgagaagcggagagacgaggcgatggcttctaggagaatgaaggaaggtggccacgtctcgtccgctttaatcgcagcgcagcgcggagggattgagatcatctctctccgccgcctccgaagcaccttgcctttagtcactgacaggtgggtccatggttcgtcgggaccacatgtcagtgactaaggcatatacataccgaccttttgaaggtagaggagcctgacccagcgggggagaggagggagagagaaagtccggagtggcacgatcggccgacacgtgtatgtacggacggcctagatggagcggggagctgcggccttgcctcgcatgagacggagggcggagattgtgggacgtgccgcgtgtaaaatggtaggtgtaccaaaatatataccagcgtcaacgagatggtcgctgccctgcacttcgccgtgcatttctcctcaagtggataaagctcaagattctctctctctgtgatccaattgtgaaatcatttgctgcagagtttttctttgtaaattcaggtctttcaaaaatagttttttttgggcagatgtgactactaataactattccctccctaaaaaaaaccaatttgtgtagattcgttggggaggggtcacacccctcctaggttgccctccttttttttttaatggagggattacgatctaattaaggtgcttgtcgagcaagaagacgcatgatgatgaggctgccgaatggtggagctcatccttcactttccttttatatatacagtggataactggagatcgtcaccagacaacagcgtacggagatttttctttccttatacttcgcccgtcccaaaatatatatacattttataggttgacacgagtattaagaaggtagatgagaccgtgagaataattggagaaaatacataattggttgaaaagagaaagcagctgaagaagaatggttgtgattagttgataggaggtaggtggagaaatagctttattttgagacaagacactgtgctaaaaatagcttcatttagagacggagatagtatatgcatatgggctaaggggattagggtaagtaggtggcgtgcacatagtaaaggattgcaactgcgaagccacagaccttgcctttaagcaataactatgcaagccacgctatgcgtgtctctagcctatgtgacacacgaaatcagcccaaggccattcaactccacagtgcatgttacttcttttgcatggctttgattggggcgagctagtgtcgagactacaaagctcacaatacaggtgaccaagacaatgaaggtgccccagcccaataaattaattcccccagctacccttctcctctctcttccctatcggcatcgcctccctcaacctgttgcccaccgcctgagctccctctccttcgcctctctcctccctatcgccatcgcctctctcaaccaggcgtcacggccgcaaatgcaccacttctcgaagaagaggaagtcgtcgtcgtcttcctcgtcatccgcacatggctccgctctgtctcctgggcgtggaagaggaagttgccgtcgttgtccagcccgtcgatggcgaagtcaaggatccacctcacggcggaggtggcaggatgaaagtgcgacgcttggcctcatagtggctccactccgtttcctccgctgtgtggatgaggaagttgtcatcgtcatccagcccaccggcgacgaagttgaggatccgcctcatggcggcggcggtgaggcagaagcgcgacgcttggccttgtagtggctccactccaactcctccgtggcgtggaagaggaagtcgtcgtcatcatctagcccgccagcggcgaagtcgaggatccacctcacatcgacggtgctccgttggcctccgtgcgtttctccgaaggggatggcgaggtttgtgcgggagtgacggaatcggtggcatgggagggatcaatccatggccgggagggtgattttgggaataggtttttcgatgtggcgcgaggagacgacgagatggaggctcgaccccaacaacgcaggcacgattcgtttgtgggccatgtgtggactcacgaagagcgagaaaactcatctccctgcgtggaggtgagatgctctgcagggatgcgcaattactcgccacgtaggcattcatttgagctggcggcacaaagaaactcaccacgcaaacacactgtgaagggcctaagcgtaaatggcatggggtgggccagaaacgtgtgtgtttcccatgttaatattttttttcgtacgtgtagtattattatatcgaagaaaatatggtgaactaatattaacatttttttctgcagtagctatgtaatggacgtgcactagagttcttcacaaattctactttcgagatgaccgttaattgaatagttgtaattttgagcaaatatttgctacttcctccgtttcatatatatatatatatatattaatgaatctagacatatgtgtatgcctagattcattaacatatatatgattgtgggtaatgctataaagtcttataactgaaacggaggtagtactagacagtaaaaaaaaagaatttggtattaagtgctgatattacttagttaaagagtgattaatcggttatcactcatgtaattttcaaaagacaatactgagttaatacgtctaatagattttttttatacagaacgcatgtgcgcgcatccatcactatacacatttgtgtgtgcgtaatatttatggagattgaaatttaaatcccgatgataataaggtgacaacgatacataaaagttaaataaatatgaacatatacaaattacatagacatacattcagtaccaactaatgataataatagagtaaagtccatcaccggtccctaaacttgtaccgctgtgttatcccggtccctaaactcacaaatcgactgttcaggtcctcaaacttgttcgattgtgtcatcccggtccctaaacttgcagatcactcgtttaggtctaccaacttgtttagttgtgtcactccggtccctaaacttggatttgaatatcatatagatcaaataggacggt

SEQ ID NO: 62284 - DNA, 4480 bp, Oryza sativa
agccggcgccgaggaaagagaaggaggaggcggggagaggtggtgtggccacaggggagctcgggaaggggctaaaacgagagaacgtagcgagggggttccattttataggcaaagggaaggagccggccatgggaggagcggggaacggcggcggaaaactcggccggcggccatggaaggtggccggggttggcgcgtccgttcccggcgatttaaggcgctattcaaggggaaaattaggggcaattgaagaggaaggaatggggattaaaaccccctaatcaatttcggaaaccccggtttgaatcgtgtggattttggggaggattggcactagggtttgcatgggagagagaaaggaaggaggccgggcgggaggacgacgacgacccgggggtgggacccatgcgggcgcgccgtcagtgcacgcacgtgcgcggcacgggcgggagggcgccgctctgcttgggcccggaggcggcccaggaagagaggagggagaggcaggcctgggagagagaggggaggggagggagctgggccgggagggggagggaagaggtgggccgggaggaggtggagaggcccgggagaggagggaaagagagggaggagagggtgactttgggctgggcttggcccaaaggaggaaggaggatttatttttagctttttctttttaataaactttgttaattgttgttgttttttaataaataattccgttgctctgaaaattcaagtaaaatttgagggctccttttagaccaaggagaatttaacaaaaattctccggaccacattcgaatttttcttgtacgtattttagtgtttgccaatttcttttcgaattttaattaattctattattccttttagaaaatggtttttatttcgggatgaatttatcaggacgtgacaaatccaccccccttacaggaatctcgtccccgagattcgaggaggctagcaagaaaataggttgggcggtcttctcttcttgcctgacttcttccgctccgtcttctataacaaacttgcctagcacaacttctccactctggactgcttggctcgatctcctgttgcagatggaatcttctcttcacttgacttgtccctggttgaacctttagttgacttcgactgggttgcggcacttgaagatggggcttcagatccagaacttctcatagttcatatctttggcgccaacctcatacaagttacccacttcacgttatgcgtcgatatcagcttgtcattactaggataccatgcttggcgcttccttccagcttaccaccaaatgcttcagactaagatatcccacttaccaaggataccatgtttgacgacttgccactaactgcatcatattagctttcctggtctccgggtgctagttacttctactattcgatgcaagggtcgataactttgcctttgaattatgtttctcaacagaaccaacttatcccacttgacatgctttgacgtctccccaaatggctttactgctggacttcttattgtctgatcgttatcctgccaaatctgaagcttcgttgttagatgtgattttaatctgacctctgtagactatcttcgatcatatcacttggttcataactgggaatagctcccacgaacaagcagctcggattcactttctttacattcagtttacttcccactattatcttcaggtggtcattatttagcattcaacgtattcctttacaccttcgaccttgatgagttccttcccattggatcatcttccaagacatggcattgccttgtaaccggtgcctgcacttttcactccgtgtagcatctgataccgagttgaagatttcactccttgccttcatagaaacacttttacctaggtcatcttgcttactcacgatttttttttctctcaatgacaaggtgactgttgcagggcgattactgtcaggagtcttccttgtgtgatgcagagcatgtttctgatgatcctttatcaatcacctttcggcctacatctttcctgctagagaacatcttggccaacctcttttatcaatcatctttcggcctatctctaacaggtggtactctttaatgtgggttgcggacacttctggtggcgatgaggtcctttggtctgctgcctttcagtgaaaccttgaagtgtttcgccaaaagctatactgactgtcattgcctttgatccgaaaaagacacatctgaaactcttagtccaaacaaatgtctctttggttaatcgcttgattttcttttccatcatcaggttggttattaactcgaggttagaacatagttcctctgaaatgagaccctaggtctcctttgacagtaaacaattatacgcataatcccatatcagcatcttccgaaagagtcctcatagaacttgttgcattacacatttctccctcattacatgaatactaagcattgcctaaaaggaaaggtgcttagcatcggtacattgcatccttaacatgaatcatccataaacatagcaaactcactgtttataaacatgaatatatttatttattacatgattgctgcaaactcccgattacagtgataggtagcgaattgaaaatcacaaacatggctactcattctgattctggagagatatagctagcattgttctagtggctacatcatccttgattggttctgtgatgatgtgataggactgcatattgctatcattcacgagagaaacttccttctgattgctggttgaagcggatgacggtcttctgcttggtatcgccctcctgaggttgattgccctttgctcggcctggagtaggtcggggagagacacaacttcttccatgcatgacaattctttgctgaggctgtcggtgcagagaatggttggtgctgaaggtattattgctatgatttattgcagagtcaggtggagcaggaggagcattggtgctgtggatgatatcgtcgatgttgctgttggagctgactagctgatgagacaatcgtagggttgttcgttggatttctgcggtcttggtcaacaacacactgagttggcaatccttgggcacatggtttgtaccttcgcatagaaaacatgcgaccttgcgggtgggacactcccctggtggatggtcttcttcacaatgagggcagactgtgagacacatgctagcaacgtgtccaatttctccacaatgggtgcatgcctttgattccatctcttcctcgccgagatgtcggggagactcatcttcatcatccgaggagacttgatctgacccttcactatcagatactctgccaccatggcttaggaggtgctgggtcaattgtcgtgcacctcggaaggtatttcctctttgacgtctaggaatagttatccctactggagtccattcggtgctggtaatagttatcttacgtacttcttcagttcgcatcggtgcttttctcttctgagtcttactcttcttgcctttggcttgcttagtacgtgaccccacgtggtacgaaaggctaggaggaaagcatttccggggattcaatggattctctccattgggctctctactttgcacactaggctgcaagcttgacttggtgcgagaaggctggtttagcgatgtctgccctgctaaaccaaaggaagggtcttctttggcatatacccatggacaattcagggcatagtgtccttgttctctacaatcatgacaaatggggacatcctcttctggcattggaagctcattgacctagggggcaaatgctcgatcaaacacatactgattttggtcttgacttcgaaccaatggtagctgtgaactaagcagcatgcttggaatggaccaagggtctgcccttgttaactctcttgaggccagtggtggattgagttgaaaacttgagttactagaggcatacccgctgacattctttcctttttctctattaaacatctattacagggattgaggtgagagaggaaacaagccaggaaagaatagaccagaactagagacaggtccttaaaggaactaactcttcttgttgatgtgttgtttgcttcacttattctgcaagttgattaagcaaacaacttagcatggttacatcacaacccaccgatgcaaaccacgcgctacacacacaagcaaggaaacacatgacaaacgaaacactagagggtggcttaggttctgcgacgggttctccaagatcttcactgcttcttccactttgctaacaaacacaacagccttctggagcttcggcagacaactgacgatttcttcttcttcgctaagttgaccatctagtactagttgaaatccgaagaaggaagaagggagtaaaccttttgcaaatagcattaggggaaggagaaaaaaaaggaactttcgcatagttttatttataaaatatgcccttaggttttatccat

SEQ ID NO: 62285 - DNA, 23033 bp, Oryza sativa
tatatatatattataatagaaaaataaagtcaaagatatattttgtagactgtgtcattttacaaaacgtcaattaaaatgaaactggagggtttggggtatatttgtcgccttcccttgagtgcggccccgtataggctgtgttcggggcacatccgtctccgagcacacctcaccatgggttgtgcaagcacatctagctccgggtgcggtcccccgtgggatgttcctggggcacgtccgcccatgagtgaggtcccatgtgtgttatgctcagggtacatctctcaccttcccttgttcgctcaggcagcaacaatgcattgacccaatcaagcctcgcattcaataagaggtgacgtataccaacccagcttgcatccgggacgacaggcgacaaaacggctcatgccgcctctaaggatatgccatcatcaccactaaaaaggtacggagcatgggcagtcagacaacatgcgcctgtaccaggctacagtagtgcggtcccacctagcctctaaagctagcaagcgggcccgacaaccatcatggtgtccatgtcacctacactaagccacacgtcgaatgaaggatcaaggcagcggaaaaaagctgctctacgtcccaccagcacaatcgacacgaacgttcaggtccaacagtgggcaccaccaattgttggggacaagaccgaccctaaccacccctttgagctgggttccatctgtgtacaatgtacgcatgattgggcactgtgtaatcccctcgatatataaaagaaggatcaatgccactgagtaattaatggggggtattggaaaactactctcagtgagtctaagttagattctagaaaaaaacaatgaagacggattcatcatcttccacttagaacatccacccaagaacacattgtgaacttcatcatctagccatgaacataggagtagggtattatgcttccgagcagcccaaacctatctaaatgatcgtcttttgaagcccatgttgatccacgtgacacgaatcgtctcgcttccgcacacccacttcaaggctgaatccaaaaaggagtaccactcctctctgctagaggagcatcctgctccgaaaaatacgtatgaggcaaaggctttgttgatgtatggccgccgttgatcggtacactaggttaaagggttaatttgatcggtgccactgtaaatgtgtctattcagataaatatcattacaattcatctatttgtagctgtgctattcaaattttacaaaactgaaaccataccatctctgtcacgttttccttcttctttcctatctacacgtggaacccatccatccgatttatttctttctttcaccctcccttatcttgagcactagggcatctgtgagacggccatgctccagggtaagggatccagggcgtcgtcgtgcacgagcggaaaaagcgtcgggacgagaccagcttagggcgtctagagacagtagctctatggtagcgatggcagtgtcacatcttcggtgtccttgtcctttcccaaggatgcggcgacggtgctcgacggcggctctcgaatcgggagatcaagaggacggagctctggtctcggacatgctgctgcatccagacttggtgagctgttgctagacatcgttcgcgttttggggaggagcaggagcagcaacatcagtagcagttggggaagatgagttgttgtgctggtggttgccgtctgcatcttggggaagaacaggagcaatggcagcaatagcagtggaagggagaacagggggatggaggaagaagataaatgtgatgggtcggtcccatgtgcagatgggagagaagatagaaaaaacgtgacaaaaagttatggttttaattttgtaaaatttaagtgattcggttacaaataaatgaattataatgatatttatctaaatatgcatatttataatggcatagatcaaattaaccctaagctaaaacacctaaccaaatgtcctttgcagctagtcacattcgtgagcgcaaaagagaattaaccaacataacgctaggctaactataacaaaagcacatacaaataatataatatataatgccatggaaagttggtgcacctaggatttgccctgtttattgagctcaaactcaaaagaaatggttccatattctagtattagctgaggcattttaacttttgtactactaggagtaattctctgccacgcagcaagaaaaagatgtgcagaaggctctcaaaagttaaaccaacgaaaggataaggacatatatatatgctctttacccaaattgtttgtttttaaataacagtagccacagggccacacactgcgaatctgatcgcacacagcatacgaccactcctgagtcctggccatctaatttcacgcgagtcaaagcccatccagtcaattggctacgatcgagaaatcgaccgtcctccctaacaacaaattttcataagagaccaaccaagatcaggtttttttttggggcccgtctagacgctatctcgcgatcacattcacatctcgcatagttgcatggcaggcgagccgatggttagagaccttggtgcccaaagacgaggacgtgtgggcgtgtggcagcatcaagcgtggaacattgcagtactgcagcagggccgtccagtcaaattcgggcccctgtttaaaattgaaagataaaaacttaatttatgatataatataaaaataatttatactccgtaatatatttcatagcaatctagaatggtctaaggccctgtttgattcagcttagcattattataatctaacttattaggagtaggctgaaacaaactggtagattattataatctataagctagattacttttttcagattattgagtggctaaagacccactacccctacatacttgagaaaaattacccacctatgccatcaaccgaacagatagctgagggcattatagactttagccattcaaacccaacaatccatgccttcaataatccatacaaacaaacaactcacagcttattctatgcctgcttattataatccagcttatagtaatctggcttaataatctatattataataatcataagttgaaacaaatagggtctaaaatgataatccaaaattagcgattaccgaactcgaaattaccagaaagaattaggtcagggtgcgtcaggcggcacgaccgcatgagagagagaggtgaggcgtcatttactcctctcgttcgttgcgattggcgattggctaggtccacagtaggaggcgattcaagattacgaaccagcgcaactgtgcgaaccggcaaaaggcgtaatcgaagctataacgacaagaaaaataacaaattttcggaactatttagattaccaatttacttattaagttgtatatctagtgttgaggttttgagcctagaagacccctgaaaattaggagccctgtacagacgcgctggtcgcacgctggtagggacggccctgtactgcagtgcagcgggggtccggaggagaaggggtccaggtgccaactgcagccatccagcccacgggaaaagggcaaagatgcgccttgcaagttgtggaaaatatatattctccaaaacggcaacagctggaggaggcggcgtttagaaaactcagatgagagttgtggatcagttacgtgcaagaaacaacctccggcacaaatggggcgcagatatgctcgaggcaagatgttaaaaaagccacaaaagttggagagaacttttgcttgaggtggatggattcaatgcatatgtttagagcttgataggtccattttaaatttgatttgagctgccgaccactcgtgatcgtaaagaacaattatattttaccgtttcaactattgtacaagcgtgcacttgagaaaaagagctatcgcccgagtaaaaaaaaatcccaatagtttgctacacgtactaactgatcctgcatgcgagtagggcattctcattttagactgttccgttgggtaataaggtgggttccgatcactaggagagatattatcttcaataccggtttttaacccctattaattctggttatagcagccgagactaaatttcttgatgtttagttttattagtaccggttgaagcatcgttactaaacatatatgctaagtcaaaaaaaaacatgaaaaatccctattaattctggttgtagcaaccgaaacaaataaccggtactaaagttgttgatttttagttttagtatcggttgaagaaaccgatactaaacatttatactaagttacatatgtgtgatgtgggattcgaactcaagatatctcacctcagcccttaaacacgttaccatctgttggcggatggcatgaggcccttcaaccaagtctgccgaaacccgtggcgtaggctatggagcaagaatggcgtgaggcgaagagtcgtatgagtgccttgccgggccagaggcgtctcaagcgaagggtgcaaggcaaagactatccgccgagggaagacgacttcgccatgataagttcgcccccgcgagggccgaagaagcctttccgacccatcaagcctaggggttataaggccggcgatcgcctgacggcccatcaggggcccatgagcccctataacattatgtacccctgtaaatatccctttcgtaagggtaatcatgtaaattcccctgtacaacctaaaccctagtagtaagatcctgtaatggggctataaatagtcccctagtgccatgtaatggggggatggaaagaaaagaattcaaaagttcaatacacttcgtttccttccaaccactgttgagtaaccacgtctttcgacgtatgcagttgtcatttcgacaacagctggcgccgaccgtggggacctctgagcgaaaccactgagagcgaatgccaccgaagagggtcgtgaaggagaaggttgccaggcggaaggggagcgacgccggaccggacatggccgccgaggaaggagcagagcattcggcgcccgtggccgaagatggaggagcactagcgccgtcacaaccgccttcggcccctgcaacctctgtgcgggtgccgaacgcggccgacgtggcgaaggcggctgcggtggcaagggcgctccagaccagggaggagatcctttcgacaagccaaccggtgatgccccaagccgctccatcgcagccggcagcggccccaactgcgctcgccgttgtacaggcccaaatcagccttgaccccgaagcacaagccgaagccgacatggaagccgtgtggcagaacatgacacggctccaagacatgcttcgccaaatgcaagagcaacaacaagcatatgaggcggcaaggcggaccaaggcctcgtcggctccaatgcttcagtattcggcagattatgtcccacctcaagtccatccgcaagtgacgacccagccctttccgccacaagccgcacaggcgccggtgtacttcgcaaggcagcatcaaccacctggccaagcgccacaaacagtggcggaaggggcttcggctctgcaggcgcaactccaagctttccttcagcaactcaaccaaccccactacatttcaagtacaaccccatcggctcacccggaggggaatacaagtcagggtgcgcctaattggttgccaccaattcagccgggcctgggagtttcgccgtggaatcaaggaccgcaattcgacttcgtcaacgctgctcaggcaccgaccgttcgacagcaagctccaactccagtcttcggaacaaaccaagcaccaatccaagctgccatgatgtggtcgcagccaatttttgactcatccatggcggctcagcaagtacctccagttggagccgggcagtcgaatgccacggcccaacctcacgcacaagctgcgattttgcccttcgccacaccgtacccgcagcaaggtgcggtaaacagggcgggaggcgaaaaggggctaccactgagtgggggaatcaagactcgtccaataccaccccagttcaagttcctgctcgtcccgcgctattcaggcgaaactgacccgaaggagttcctctccatttacgagtcagcgatcgaagcggctcatggtgacgaaaatatcaaggcaaaggtaatacatctcgctctagacggcatcgcccgttcttggtatttcaatttactagccaatagcatttactcatgggagcaattgcacgattcttttgtccttaactttcgaggcacttatgaggagccgaagacgcagcaacaccttctcggcattcgccaaaggccgggggagtcgataagggagtacatgcgtcgcttctcgcaagcccggtgccaagttcaagacataaccgaggcgtcggttataaacgctgcttcggccggtctgctcgagggcgaactcacaagaaaaatcgccaacaaggagccacagacgctcgagcacctacttcgcatcattgacgggttcgcaaggggcgaggaggattccaagtgacgacaagctatacaagctgagtacgataaagcctccgtcgccgctgttcaagctcaagcacaagttcaagttgccaaaccacctcccctctctattcgccagtctcagccggcaatccaaggatagccgccgaggcaaggccaagcccccatgacttggagaaagttcagaacagatcgggcgggtaaggctgtgatggctgtcgaggaactgcaagccctctgcaaggagttcgacgcccagcaaggaagcaaccatcagcagccagcccgcaagaaagtccgaaaagacctccactacgcctttcacggacgctcttcgcacaccacggagcaatgccgaaacattaggcaacgtggcaactcgcaagacccaaggccgtagcagggaacaactgtcgaagcaccccgcgaagcagttcaggagcaaacacccctagccgaacaacgccaagatgcacagcgaaggataatccaagtgattacatgggccgacccgccaagccagttatccaaacggcagaaaaagatgcagatccgtatggtccacagcatcacttcggcgggcaaaggggcgccgcaatatctgaaccagctaatctcttttgggccggaagacgcagaaggagttatgttcccgcatcaagatcctttggtaatctcagcagagatagctggtttcgaggtccgacgaatactggtcgacggagggagttcggccgacgttatctttgccgaagcatatgccaagatggggttgcctacccaagcacttaccccagcaccagcatcactccgcggtttcggcggagaagcagttcgagttctcggccaagcactcttgctgatagcctttggctcgggggagaacagacgcgaagagcaaatactgttcgacgtcgtcgacatcccgtacaactacaatgccatcttcggccgtgcaaccctgaacaagttcgaagccatttcccaccacaattacctcaagctcaagatgcccggcccggcgggggtgatagtggtcaaggggcttcagtcttcggccgcttcaaaaagcgatctagccataatcaatagggcagtgcactgcgttcagaccgaaccgcatgaacggccgaagaacacgccaaagctcacccctcacggcaagataacaaaagtgcagattgatgatgccgaccccacaaagcttgtatcactgggggacgacatgggcgaagaagaagttgagagtatgctagaggtgctcaagaagaacatcaacatcttcgcctggagccctgacgaggtgggggggggggtgttccggcagatctcattatgcatcacctggcggtcaagccagacattaagccaagaaaacataagttgtgcaagatgtctgccgaccgccaagaagcggcgaaagccgaagtacaaaaattgctcagggcaggggtaatccaagagattgaccatccggagtggctggcgaatccagtgctggtgcggaagtcaaatggcaaatggcgcatgtgtgtcgatttcacagacctgaacaaagcgtgtccgaaagacgacttccccttgccacggatcgaccagctcgtggattcaacagctggatgcgagctcatgagtttcctggacgcatattccggctaccaccagatccacatgaacccacttgacatccccaaaacatccttcatcactccgttcggcacgttttgtcacctcaagatgcctttcggcttaaggaacgcaggaacaaccttcgccagactggtgtacaaagtccttggcaagcagttggggcggaatgtggaagcttatgtcgacgacatcgtcgtaaagagccgcaaggctttcgaccatgcgattgatctgcaggagacattcgacagcttgcgcgcagcaggcattaagctgaatccggagaagtgcgttttcggtgtccgcgcaggcaagttgttgggtttccttgtttccgaaagaggcatcgaggcgaatctcgagaaaatcgatgccatccagcaaatgaagcctccgttaagcgtacatgaagtacaaaagcttgtaggccgaattgcggcactcagtcgattcctctcaaaggcagccgaaagaggtctgcccttcttcaagaccctccggggcgcgggaaagtttaattggaccccagagtgccaggcagcattcgacgagctaaagcaatacttgcaaagcctgccagccctgataagcccacccccaggaagcgaactgctattatacttagcagcttcgccggtggcagtcagtgctgccctcgtccaagaaacagagttcgaatagaaaccggtctacttcgtctccgaagcactgcaaggagcgaagacaagatacatcgaaatggaaaagctcgcttacgccctagtgatggcctcacgcaaccttaagcactacttccaagccaacaaagtcatagtgccatcacagtaccccttgggcgaaatactccgaggcagggaagtcacgggccggctcagcaagtgggcggcagagctatccccgttcgacttgcattttgttgcacgctctgctatcaagtctcaagtgctagctgacttcgtagctgaatggacaccggtacttgccgctgaccccgagcccgccgaacaattttgggtgatgtgctctgatggctcgtggtcgcacagtggggcgggtattgcagcagtcctcttttcgccgaatggtgtgccgattcggtacgcagcaagactgcagttcgacacaaccaacaacgcagcagaatacgaagccgttctcctgggcctaagaaaggcgaaagcactgggagtccggcgcttgctaattcggaccgactccaagttggtagcaggtcatgttgataactccttcgaagcaaaagaagaaggaatgaagaagtatctggaggctgttcggtccatggaaaaatacttcactggtataacggtcgaacacttacctagaggccagaacgaggaagcagacgccctggcgaaatccgctgcttgtggtggcccacattcgccgggcatcttttttgaagtcctacatgctccaagtgtgcccatggacagttcagaagtcatggtaatcgaccaggagaaactgggcgaagacccatatgactggcgaaccccatttgtgaaacaccttcaaactggctggcttccggtagacgaagcagaagcaaagcgtttgcagctcagagccacgaagtataagatggtctcgggtcagctttaccgctctggggtacttcagcccttacttcgttgcatctctttcgccgaaggcgaagaaatggcaaaggaagtacatcagggactatgtggctcgcaccaggctgcaagaacagtggtctccaaagtatttagacaaggagtttattggcccactgtgttgaaagtctgtgttgagcaaatcaagaagtgcgaaagctgccagcgtcatggccgaagccgaaccgcgccccagtatgatctgcagcccattgcgccaatatggccctttgccagatggggactggacatcatcgggccgttcccagtggcgcgaaacgggtataaattcgcaattgtagctgtggaatatttctctcgatggattgaagccgaaccccttggggcaatcacttcggcagcagtacagaagtttgtatggaaaaacattgtttttgccgtttcggagtgccaaaagagttcattactgacaacggcaagcagtttgactctgataagttcagagaaatgtgcgaagggcttaacctagaaatcaggttcgcgtcggtcgcgcacccgcagtcaaatggggcggccgaacgtgcaaatggcaagatcctagaagcactaaagaaaagactcgaggaggcagcgaaaggcaaatggccagaagaattgctatcggttctctgggccctccggacgacccccacaagaccaaccaagtttagcccgtttatgcttctttatggcgatgaggcaatgaccccagcagagctaggggctaacttaccaagggttatgttctctgggggcgaagaggggcgcgaagtatcgctcgaactcttggaaggggtaagggtcgaagcgctcgagcacatgcacaagtacgtcacaagcacttcggcaacttacaacaaaaaaagtttgacccacggagctgatgcctggtcatcttgtcctaagaaagaagacgaacccagtagcggttggtaagcttgaatcaaaatgggaacgaccgtaccttatcaaacacaagtccaggacgggatcttttcgcctaacgacactcgaaggcgaggagttcgaccattcctggaacgccgcctctctcaagcgcttctatgcctagaatgggtggcacccaaatcgccaacttgtaaaaatgtacatatagtcatgtaagcccttcggcactatgtaagtctttcggcaaaagaaaaaaaagaaaaaaaaagagaagagagaaaaaagagaaaaaaaactggatgtagggctattatccactatggaggaccgaaccagtataaaatctctgtgtcctccgccttctttttatttttcgtgtgattgataatttgtggaaaaaccccaaggcaaacgcctgatcagcgaaaaaggccagggggtgaaacgaatcggccgaagcattgcttgccaaacgttgaaaccgcaacagcttgtctcggaaaaaaaatagccgaacaacgttacgaccgatcagcataaaagcaaaagcgtttctctcgacacagaacgctacagatcgaaaacgaacgacgaaaagctgaaaagtcagtacacctatttcgctaatatacgcaaaggggccggcatgttccgacctaacaaaagcacaaaatgtgacgatgcgaaaaatagcgaaaaggaaataaagcacgttctttattaacttcgaaaaaataatcgaagaatacaaggttcacaacccgatacaattcacttcacaagtaaattacatctttgcccccgtaatcattatccctccctaaggaatggtcagacgaactaggttcgtcatcactactaatatcatacacaaccttaagaggagtagggggcgaaacacagactaaactgtaacgacgctgaaagatcgattcctgacgtttagttttctgatggtttcgccaaaagcgagccatatcctccaaacgtcttgaatgaacaagatcgtaatcttctaaggttcgcccggggtgcgcccgcagccaatcggcaaccttgaaaaccttatagctgcgaccgtttatctccatttggcgataaacaggccgaaatggacatcgcaccttcggcagacccttcaacgccacaaatttctcgttttgacttcgccagctcccagaagggggccaactgcaagattttcagcgaaccccctggtagacagtgcagaaaaggcaaaacacaacttacatagtaagaataggcaaaagaaggggaaggtatggcataatgcgaaatgagcgaaataataatatgccaaaaggctttgatcattaaaaagtggttaaaattgtgtcatacagtccaagtatgcaaaaaggcctctgctaaggtttagcggcagcttgccgaatatacaacggttcgccacatctagcgaacaccaaaagaaaactatgaaaatctaagagaagggcggagggcctcacacctctgggtggtcctgggcatcgcctccaccctcttcggccgccgcgccttcctcttcacaaaggtccgccgcctctgctttcgtcagctgctccaaaaggcgcgccttagcggcggagcggccgtccttctgccagaattgttttcaccacgcacgaagtgcaggcgaaatgtcttgcgcgctgatttcccaatcccccttcgcgtacttggggaactcggcgatgtgctcgcagccgaactgctgcaggaggcccatggtaaaggccgctgacacgcgcgcacagcagtcgccgtatgcggtggcgcagtccgaaaccgaaccaccagcctgttgggtccattcggagaagtcgaaggctgaggcatcttcggaggggacatcccgcactttcatgcccatatcagtaagggcgaggcgaagcgtttggcacgctgtccgcgcggactcggtggttttcaccatctcccgcgaaaaccaccgcgactccaccgcagcgcttgctttggccttgcgaacctcctgccgaagagcctccatcttcggctcggtgaggttgtaataatctatgagcacggcggtgtgggccttctctttctctagttcagcctttaagcgatcgacttcggccctagcttccttctcttttccagttccgattggagccgcttgtttttggccttcgcctccttaagggtgttggcaagggcctccatctccatatttttgcggcctaattcatcatccttggcccgaagacggcttttgaacccgtcaaggcgggctcgcacagttcgctctgttgaacagtgagccgcgaggatctgggtgcagaataggagcggcgaagagaacaagtgtcagttgtaaaaaaaagagagggagagtaaaaataaaaaaaagaggggaaaacgtacccgaacagccaggctttttatagcagagcacccctcatcgaactcattcagttcggtgaacaatctcggggcactggcgggcagtacaagattgcttaccccctccacaaaaggaaggaggtccgcccgcgtctcgaaatcgccaggggcgaagcggggtaacgggagcgaatattccgaagcggacgtctcaacgaccgctctctttcccttcgcctcaatcagcggcgacgcaaccggctgacgtgaaggactgccgaatactttcgccgcggccgtgacaattctttcggcagaggccgaagccccagcggcggtactaccgcccgctccagcggcgccgagtggaggaacgggggcagccgaaagatccaggctgcggccagcaggcgaagtaggagtcccgtcggaggactcatcatctctaaaaacgcgagcgacatcgacgagtcctttcttcttagccacctttttgacaagacctcccttcgccgctgcacccgaagagaatgcaactagggccttcgccccgtctaagtctttctggagaaggggggagctattcgactccaccccggtctcgttatggccaggactcagagtaggggtatagccgggagtctcagcgcggcccccgaccgcctcgcccgttgtcttctcgaccatgatctccacctcctcttctccccccctcctctttgccattatgttcttcggcatcctcctcgtcatcagcatcagagtccgacgaagcaggagccctacgcttcctaggggcaagctttacctgaccgcgcatccgtttccgcgaaggccctgtttcgtcatcggtcttgtggagattcgcccggggaggcagttcgccattgcaaacccggttcgcccgaccagctgcctgccgtgtcagcaactggctgaactcaacgacagacacatcgccgatcatcttgcgggattcggcttcagcttggtcgagggttagcactgtaaaagcaaggagggggaatcacgattaaaagtcaaacaaggcaaaataataaagcacaggagtacagcaaaacaacagtcttactgttcgtccccttaggaagaaccaagttcggtaaactgtcaacctcttcgctttgctcaaccgtgacttgccatgactgggagaggggaaagatgcgaagcatacagaactcctccaccaagtcacgacagctaaggcgggagcaagccttgcgcagcagaacgaaccgcgcctccgtagcgccgtccacggcgatcttgggtttccggttcggcgcaatcgccctacgccggcaccggagggctttcgccgattcagaaccagcctcgaaggggatggtgtgatagaaccacctcgccatccaatggcggtcccacttcgacatggcagcgttcaccggccagagatcggaccgctcggggcgaacgttgaagttcacactcccgaacacggtcttcctcgtcccagctggggtaatcaccgtcttcgagttcacggtggcaaagaatatggcgccgaaaagctcggcgttaggctcaaacccggaagtccggcatgcccagtcaaaaatagcggtccgaacaagagccgacgggctcggctgtggaagttccacctggaagaggcgaaggatctccggcaacaacacgttgtagggataccgtagccctgcctcaaaaaagatggcgaacaccaccgtccgattgtcgattggtttcagcaccatggctttccctagagcgaaagcctgcccctcaaccaatgctccagagctgaccagcttcgccagctcgacgtcgtccataagagaaacccccaaaaaggcggtgctgtcgtcatcgactcggccgggatccagccctttcgccgaagcagggtttggcctgcgaggggccatggcgaacggtgcgtttgcaatggcgaagaaagagaatgggcgaaatgcttgaggggtcaagagattccgtggaagaaagaaatggaggaagagaccgcccacggtaaaatggcaagtgtggcggtgaaaaggaaagagcggcgggaatttatagctcacctgggcgaccgttcgcctacccaccagtaataaagcaatacgtgtcgcaagggtaggcgaaatggtaaattcccaccatccgagcggcacagtaaaaagcccacgaagggaaagcccaatactgttccgttcggcccgggaaaagaaaatatataaccaccaatcgcaggaggcgaagcgtggcaaaataataccagccgcacaagtaacaaacttcattcgcaggaataatgtaggtttcggcaggagcatcggtcgaaaggagggcgccgcataccataccacatggtttgcacggtctcggccgaagctccaatctcacccttgtccgtgaggggcttgttggaggatggcatgaggcccttcgaccaagtctgccgaaacccgtggcgaaagctatggagcaagaacggcgtgaggcgaagagtcgtacgagtgccttgccgggccagaggcgtctcaagcgaagggtgcaaggcgaagactatccgccgagggaagacgacttcgccatgacaagttcgcccccgcgagggccgaagaagcctttccggcctatcaatcctaggggctataggaccggcgatcgcctgacggccctttaggggcccatgagcccctataacattatgtacccctgtaaatgtccctttcgtaagggtaatcatgtaaattcccctgtacaacctaaaccctagtagtaagatcctgtaatggggctataaatagtcccctagggccatgtaatggaggggatggaaagaaaagaattcaaaagttcaatacacttcgtttccttccaaccactgtcgagtaaccacgtctttcaacgtatgcagttgtcattttgacaacaccatccgttttcttttctaaactaaccctgtaggcatcttcagtaccggtactaaaaatatctttagtccctgttggtactaccaaccggtgctaaagatacacttttagtaccggttggtaagatcaaccgggactaaatatcttttttgggacttgagctttcagaaccgttattaaaaagttttcagtactgattcttaataaatccgacatatctgtggtttggggcaatggataaaagatgagttgtctagtagtggttatcaaatatgataattgctatagtgtactccctccatctatcttgagaaaatcctttgtatacccctaaaattatagctaatcctttttatgcccctaaattttgcgcctcaaattttgattttgatcccttccattccatactcctcccatcagttgaccgtgagttgatcatctaaattctataaaaatgacaattttaccctttgaatgagtatagaaatttatgaactatattattgaaaatgtaaaagtttgttatgggtttgctgtgcgatacactatttatgacaaaaataatttttagataattaaataaaaaatatgtatttattttattttcaaaaattcataaaaaattagtagcaatcaaataaagataggactaccaatgctcatgatatttttttttatgaatgctcttgataaaaaaatttcactgccgtattaaaattttaaaaaataattttaatttatacatttgttttattttcaaattaatgttaaattttttcactaattatttagtcccattaatttcataaaatacacatactgtgaactcaaacaaaatttccaattgttattcaagctcatattcaaacctaaatcatcaaaatgtaacaacgaaatgaaggaaaatgtaacgacataggcatgaaaaagatcaagttaaaatttcaggggtataaaataaatcgggtaaatattaggggtgtcaaaagggatcggttgaattttcaagggtacacatggaatttactcatctatctattgctccctctgtccatgaatttagtggattatggaatgtaaaggatttttgttaagaagtacaacagcaataaaaaattgagtactcccttccgttcccatcagaaaaaaaatatagagaaaagtacatgtagtattactctatagctctgaatctaggccctgtttagttcccaaaataaaaattttcacgctgtcacatcgaatgtttggacacatgtatagagtattaatgtaggcgaaaaaaaccaattacacagattgcgcgtaaattacgagacaaaacttttaagcctaattgcgccatgatttgataatgtggggctacagtaaacagtaaacatttgctgatgacaaattaattaggcttaataaattcgtctcgcagtttcctggcagaatatgtgatttgttttgttattggactatatttaatactccaaatatgtgtccgtatatctgatgcgataaccaaacccaaattttttccccaactaaacaaggccttatgtttatttctaagtctaagggccagcttagttcacgaacgaaaatttttggcgtgtcacatcagatatacggacacagaaaaattcgtctcgcaatttacacgcaatctgtataactagtttttttctatatttaatactccatacattatccaaacattcgatgtggcatggtgaaaattttttatttgggaactaaagagggcctaaatgtatactttctacacttctttcattctaaagatgagtgtcttttcacactaccaaatggctcagatgcatttcttcctcttccttaatttgggctatattgggcataataccctataatcttcgacagagggagtatatactaaaaatacattaaacttcttaaaaaggctctcaagcttacatgtggcattaaaaaatgctctcaagtttacatgtggcgctttaataaattagataaaatgctaagaaaaaacaaaacatatcacttgattttcacttaaattggtgggtctaatattatgaactattatgttatattcgcagcaagccggcatctcgtctactccgagcaccagctgcgaatcggcctcatcggccgccgctgccgagcacctgctgctccaccaccacgagctcgacaacagagaacttggcggtgagcctcaccttcgcgtcccggatgatgcgcaccatgtcaacgatgtcggcccccggtcacctcgcctctgctccccgtcgctgccaccgggtagaagcagttgctgtagaaccccatcgccgccacgccgtccgccttgagaatcaggtggcgcgtgttggcgaagaagcagacgcgcatgatgcactcctgctcggcatcgccggcggcaacgagagcgcgggtgcgggcttgccatgtcttggcgacacagacgtcgaaggagtagcagcggtggccggtggacgcgaagaaggtggacttgaccttggcgatgtggtccaggctgaggtcgacggtgaagtagcggaggttgagcagctcaagccgcggcgatggcggtgccggcatcttgggtgggttagggatgacgttgcgcgcccacaccagggacacccatggcttggcgaggccgcgcgcgtagtcggccacggcattgatgaactggccagcgccggcgaaggagctcgatgtcggcgagggagctcagcggcggtgagggagggagcttggtggcggcgaaggagctcggcgccggggatggatggatggacgatgaaacgaaggaggaagggggatgacgacggcgtgagaggaaaaagtgacgggagtggcatggttccaattttagaaatttctagtgatatgatgaatagtagtggcatttttgtaattaggcaaagttacattggcatggatccaattaacccataataatatgggaggtgatatggaggatgtaatatgaagagaaaatcccttctatacccctgaaattgtagctaatctcttctatgcccctgaattttgcttacttctttgtatcctcccaaaatttgattttgacaccttccatatccctcccgtcagctgaccgttagttgatcgtctaatttctataaaaataaccattttaccctttgaatgaacatagaaattcatgaattgcattattaaaaatgtaaaagtttgtcgcataagactattatagttatgagtttgttgttgtcagggttacggataaggtatacactctaccattggatatacgctttacatcaatatggtatatctgcgcgtgtacggacgtcctctgtatgcgctaaggaaattcatcacagagtccatagatggagagattcctaccaggataggactgggtcgtcactgtatcgtgtagggtccgatgtctctgagtccaacttggagaccacctgacctgcggtataaaagggacccctcgggagaacctaacgcatcaaatctcacaaccaagaccaccacagcttacgaagccggagcctataggagccaagttgccgggtgatttagtcgaaccaactcgactacgatctcgtcagtatcatcgagttctgttattccctcgagttctgttattccctttgtaacttgtggtagggctattacctataaaggggcctgaaccagtataatctttgtcttctgtttccttgatgtcatactatgtagatcctcgtaccaacgtaccccagtaccctctatatccggtctatgggtatcccctgtcgacagtggcgcgccaggtagggggccttggtgctcaaggttctactactatgaaatcaagcctcgtcgacaatagcatcaacaccggcctcatccaaggagtccctacttcaacaatgctggtgtggactcaagtcggcgaaatcgtcttccctatttacaccacaataccgatctcggctagtccatcaatgatcggaagcgagaacaccgtggctataaccccgggcgactccatgtcgaaagatcctcccgctgtagcggagaacggaacgtcgatgacatacgagcccgagaaggatcctagtgcggccaaaccttatccttccgacaaggaccatgcgccgacaaggacaacttccgaggtgacaaagccctggtgtcctatccacaagaccaggaaacacaatttgcaagcttgttgggtttttctcaacgtacaagctaaaattcatgcctgcaaagagcatggaatccagcgtgcttctccaactcgtgatgtctattgtcctattcacaagacgaagaatcacgacttctcaagctgcaaagtccttctccgtgccatgaagacgccgcttcctaaggtccagcaatcaaaaatctctcttagggatgcagacaaggaacaaggagcgacgctgatctcggatcgattcgttggagtgattgacatcgatccccacgagccatcagtcctatacttgctcgaagactatggctcatcatcctccagtacaccacgcgtcgtatttgccattggtgggaccagcacgtccacgcacgctaatgcataggcggagaatcaagcggtcacgccggcccaacacctcggcaccatcaacgcaatactgagagaaaacacctatgatcccatacttaacgatgatctcgcatgatggacagaatgactatgggaatcggttgccaatctcagtaacgcgttcgaggaggccgctaccagagcgcaaccagaacatccgacagctggcggtgctgatggcgaaccaccggaggaacggacgtcgcctagacgagctacccctccacctcgcggcaccggcgatctccgcgaccatttgaatggccgccgagaagaacgacgtgcgtgagacaacgagaatcgttcccgacatcgtgtctcttcacggcgtcgcgagaacgaagagcgaggaggccgctcaaacggagatcgacaccatgataatcgtcacaaccgccacgaccgcgacgatcacgaacagcggacgccggaagatactgttcgaggacgccgacatgacggcgatgataatggggatcggcgccaggacaacaatgctggacaacgacaggactctcaagaacccgaacgtcatcctcggaatcagacaccggagccgagtgacccatcgtcatcgtcatcatcctcttcatcctcgtcatccgatagacatccacggaggacatacgatcgctgataacccaccgcccccagtgccgggtgtagagctttcaaccgttccctacgtgatgtccgatgtcctgagagattccgacctggggcaatagagaagtacgatgggagtaccgacccagaagaattccttcaggtctactccacagtactatacgctgccggagcagatgacaatgcgttagcaaactatttgccgacagcgttgaaaggttctgcgcgttcgtggctgatgcacctcccgccctactcgatttcttcatgggcagatctgtggtagcaattcatcgctaacttccaaggaacttacaagcgccacgcgatctaagacgatctacacgcgttaacacagaatccgggtgaatctttgagggactatgttcggcgctttaatgagtgcagaaatacaatccccgaaatcacggacgcctctgtgattcgcgctttcaaaacctgtgtcagagatcgctatactacccaagagttggcaacaaggcgaagattgttcgaagtcatcgatcgatgcgctcacgcggacgacgcactaagacgcaagaacaacaagccaaagacggggggagagaagaagccagccaagggcacacctgaaccgagcaagaagaaaagcggcaagagtgggaaaaggaaagctcaagcggaagttcccgcgtcggaatacgaacgccctcccaaacacctagacccacaaggcagtgacacaaagagaatatggtgccccatatacaagtcggacagacattctctggaggattgcctcatcttcaaaaagtcgctggaaaagcaactggcattggaaaagggcaagcgagtacgtgtagtcgagaaagctgccgaggccaccactcaggactcgaactcagcatacccagattctgatcttcatgtctcgcacatcttcggaggttccaaggcgtactcctcaaagcgagaatacaagaaagtggagcgtgaaatttgttcgacatggcaggaggctgcacccaagatgaagtggtctgaacagaagatcgagttttcagatgaagaccaccccaaggctgctgttatcccaggacgatatccgatcgtggtcgaacccactattcggaatatcaaggaagcgtgagtccttattgatggcagcagctccatcaatcttctcttcaccaacaccttggacgcaatggggattccacgaagtgagttgacacccaccgatcaaccctttcacggattctgtcacgtcctgataaattcatcccgaaataaaaatcattttctaaaaggaataatggaattaattaaaaattcgaaaagaaattggccaaccctaaaatacgtacaagaaaaattcaaatgtggcccggagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcgggccatcggcctcctcccccgcgcgcgcgccgctgacaggcgggcccgcccgccgccctcgctgacgggtggggcccacctgtcatccgcttcttccgccggtcccgccgatccgccgtgcctaacgcc

SEQ ID NO: 62286 - DNA, 1294 bp, Oryza sativa
tttgggaccctaaacagttttaattcaaacacttctcaactacaaagttgtaggtcacgtcgagggctacaattttgatataaagttcatcttcattagagttcacatgaaaaagttatgaattattttttgatataaaatttttagactgtactgtttagggaccagggtgacacaactgaacaagttggaggacctaaacgagtgatttgcaagtttagggaccggaataacacagtcgaacaagtttgaggaactgaacggtcgatttgcgagtttagggaccaggatgacacaacggtacaagtttagggaccggtgattgactttactcataataatatctgaacttgatcggacattgtatagtagtactgaactcggaatgaacaacaggtaacaatctgatagaaaatagtgtcaagatccgttatgatgaaaattaaaaacacattgcaggagcacaatcagagcaaaattcatctccaaattgttaaccacgagcataaagactccagccacgagcaactttgtccacacgtcatttcacttaacgtttcacgtcagtcaaataatgggattggatcacaggtaaaataattccacatcgcaaacacaaaatggagtgcggagtaatagtttgctgagaaaaacatgattataacatcagaagataatgcccaaattatgttctacaggcagatgattcctatcctacaacataatcggtcaacagaacctagctaaagttctttttcacatgctattgtgcatgtatgggtgctttcaaattatctaggggatacaaaaagacttgttttcttggataatgctacgcaaagatctgagcggctgagcatcattgcattaatgaatgctccaaaacagactaaataattctattatacttacacaaggtgcaagtacaaaatttgatcatttctatgggaaagacaaataaatagctaaaaataaacaagtctctggccatatcaataaattaattcctaataaacaccttccacatgaatcatgatcaagttaaattgaatttagtcagtatattgtgtgctcaattgacaagtggcatgcagctaaaatgtccattatgtagagtttataaattgttttatactttaattagatatgtgcagatagatggtttaaaatcaattgcataggacatggccaacgctttgcaaatttacacggataataaatgtatgactaaatcagttctgggacattacgaagtggtatctgcagaaatcctctcctgttggagaaatgtcag

SEQ ID NO: 62287 - DNA, 6238 bp, Oryza sativa
acgtgaaactatgccggtcattctctttgccgtaagaggaatgtaacgaagaagcacgccagcatggattgtgaagtaatcaacaccctgctcagcttgttcgattaaagtatctctaaagacttcccagcttagattttcagcaataccattaactttctcaagtgcttggtaaataggcaccgtcccaatagggactgaagaattacgaaggatccattcccgggtctcatggatatgacgccctgttgaaaggtccatgacagtatcagctccccacattgtagcccactggagcttgtgtacttcctcctcgatggagctcacaacagcagaattcccaatgtttgcattcacttttacaaggaagtttcgtccaacaatcatgggttccaattccaggtgcctcttgttggaaggaattatagctcgtccacgggcaacctctgaccggacaaattcaggactaaggttctcacgtgtggcacagtacaacatctcctctgttatgattccctgcttagcgtaatacatttgtgtgtatcgaggaccacctaacttctccctcctgtcaatccattccttccttatctttggaagtcctgcaaaaaaattcaaatgcttatgcaaattgtcaaatatgttagggggaaagagagggaagaaccctcaaccatcctatcagtatagttatttgaatatggagaggactggacatagttacttatgtagcgaaaatgtgagaaaaggtagcctaggcactgcatgatgtcaacactggtttgtataccattttggtttaacagtattagttcagttgttctggtgtcatctctttttactggccgttttggtactatcaaattaactatgcaattacattcatgtatcaaactgcacgatacctaatatcatacgtccatgttccctatggaaattatttctattagttttgaaataaattggtataaatgaaaaataaaactccgcaaatagtacagaaatataaaaaaaataaaatttgtaaataaaaataacaaaaagagttcaaaacaatataaggtatcataattgcattagagtgaacataaaagaacaagaaataatttccactaagccgctgatctttcctttcatgcaggattgataaaaaaatgtaagatgttatgttcattagcttggtttgggggtttagtttgacaagagaaatgaggtcagtgagttaccaatccttggactaatgttttgtggaccactggtgtcgtatgtgtcaaaatgcttctcatctccggtcaaatggattctcctaaatgggatcttgaggacatggccagattcctcgtgcacaatttctctgaagaacatagtcacaggcaacataagctttagtggaggcgttaacataccggaatgtaagtaattccaatacagttcttaatgaaaagtgaaatgtaaatcttgcctggattcttttgtgctccttggaaagcattcttcaaatgatgggagtggcagaaattctggagcagaaggatcaacagtgtgcttgttttgcctgggttttgctggctctgctgttgactggtcagtcactgaagctgctctaggccttgaacaagtgaagttagcgctcctgtcctgcacatcttgaggacgtgcaataccaccaaatccaggtaaaactgcagttttgggtaacttcagacttttcatagccattgctgaagagaatgagggttgcagggcagccatttcctgtccaaaggtagagaaaaattaatgattaaagacagtgcaacgctatcaactcaaaagctttatatctgcacttgcagaaaactacagtcctaatcttatctccatgtaggctatctgaagatgacgacaaatgcatgtagcagtcgaaataacccctctagctctgatgcctttaatattcagagttcattcatgatgcctgatgaactggttttgattgaaaaaatgattcatatttcaattctatactggagaactctattcatcccttaaggggatatcccctcatttttgcatgtcacttaaaaagtcatcaaaaaatttaaaataatttagtaagatagatcaatatgtgatatgtaacttcacaaacatgcatattcaaattcaacttatataagtaaaaacaaaaataacaaatttaactatgaatagaacgtgtaattcacggttaaatttgttatttttgtttcaaattgtataagtcgaattttaacttgcatgtttgaaaaagatatatcgtataatgatctatcttgacaatttcttttcaaattttttgataactttttgaacgctatgcacaaaacgatgggatgtccccttgagggacaaaaatacacttccttctatactactctacatctcagatgaaacatgccttacaaaggagttgtggaacttgtgtctcccctctcccgtgtgcactgcaccgaacaagagcatagagcatatacccatgtggaaaaactagcgtccagaatcaaagaggccccccatgtaccaatacgatcgagaactagataaccacggtagcaacagaggccttcaccacgcgcgcacgatctatcaagcatcaaccgtatcatacggaaatcacacccgcaaagacgcaggcaagcaaagcgagaccagccaaaatccttacccccctaatccacaacgcatccagaaacctacgatgctaccgctagaagcagcatccaaaaccgcaaccccggcccgtcggccgcgcgagatcccccacggattccgacgaggcaaatcccccgttcgttctgatcgaaacgaatgccggagagcggaaggaaaggttctctcacctcggggcggcggcggcggtagccgggagccgggagggagaggagaggaggggcgacgcgggcggaggaggaagtgaggaactcgtgagcgggatgggggggaggggtgcaagggcggaagatatttttatagcggggggcgcgcgggggattgcagatttggggggaggatagcggacgggtggccaaaagagagaacggacggccaaaagcgacggccgacgggaggggagatatttctgtccggccaccacagatactttctctgcgccagcggacgcttccaacggtccgaaaaagagaattgattaggacaggagggatgatggcgtggcgtttgcagtagtatggggacggttaattttgggcctgtttattgatgacgttttcagccatacaattatttagtaaagattgaattacgttttgggccagattttattacctaagttttattttggaccacccttaaacatatcttttcactttgaaccggataaatttgctattgttataatttggaccaccacgaacgattttttcagtacaaacaacgaccttaagcacatcagctctagtatacagccgaactcttctatgtatggttcatatgtttgccaaaagagaagttagacgtgacgagaaaagttgttcatgatagttcaaaccgtaataatgataaatttacccggtccaaattgaaaagatatgtttaagggtgatccaaattgaaacttgaaacttgggtaataaaaggtggtccaaattgcaatttactctttagtaaaattgataattatatgaatatatttagtttgttactaaatattggtaatgtgtatagaattttgacaacattattaagccaatcctatcaaaattttgataatattgtcgatttataaaattttagaattttcaaattttgataaggtttatttggcaccaattcgaacaaaccctttgttcgttggttgaggtggtattgtcgtgctatcctctaccgaacctcgggtgttgtatgttagtgtttgatatgctatatgacggatgatactgtaccggtggggacggtattgtgctaagaatataatcccacgggacatggattgttttgttcgccgagagaaatggacaaagcctttttcactgtgtatatagggtctaaatcatcgtttcaagtgacgaatacagggaaatacatgagaaaataactactccctccatttcatattactaagttgtttgacttttttttagttttacttaagtttatagaaaaatatgttagtatttcaactcaaaataaatatattgttaaaatatattcaatgttacattaaatgaaactaatttgatattttagatgttgctatttttctgtaaagttggtcaaacttaataaagtttgactaggaaaaaaaaccaaataatttataatatgaaattgtggggacacccgataaagtcatggtgtcccacgaatacgtaactgcccaggatgttcagttacgcatgaaatgatataaaagcataaacttcgattatatagtacttaagtcacttaattcacaacacaacataaatacaaaccattacatatatggcctataaagccttatttctacaaacagataaactgctagacttcaccacaggaactgcctgagcgtaggatgacctagaaaccatagctgtcccactctaacgggtcaacaggatcttcacaagcatcctcctcatgatctgaacccatttatgagtacaaaaggtactcagcaaaacatgcttatgatagcaaatgcagtaattgcaatataaaacatgcagtattaagagctggaaggtttaaaccctaaccttaacagttatttcatagagcctatcttaataagcatttgatataaacaacagtattgaacatttaatttaaacaataataacgagcataaaaatataaatgttacctataaataacttgaatagaacatcaagtaataaataaattaaccatattaattaatagccatttagtttaacttgtgcccataatctggaatcacccatagacacatctccattaaccgggagcacggcgtattcgaatactcaacgactctgcagtgtttgcccagctttacccacacgatacccacagctggccgggctgaaaagtaacaaggtgtaatattgctccatatatctctcccttctacctagtaagttaaaggatgctcgggatgttgctcggagtgatccggtctgaggtgtgtaccaacctacctccgcatccacttaccattgttcgttactcgatgggcagcccagaacttcatgggcccatagggcagttctgaactctcggggcccatcgagcctacatatataaatcatataaacatgaaccatgtcactttgcttcacacacttgaaagctaatggccagtacaccgaaaggcctgcagaagttcaatcaattggagcaatatacggccaggttcgacaaatcgatcctgtggatgggcgaaactatatcattcttattgacaaagggggttgattattatatcaattttaaataagaaataaccataaatatatccatatatccatcacgaccataaacaggtccataaaaccaaacacatgaactctatcatgtgtaccacccgctcacatgcggtgtcaacagttcttagcatatagccataaatagttccataagcatgttttcatatgcaataataatatccatattaaatcaatagcatgttaaataatgaaccatttgcttaggtgtttctcaaattttatcctaagtttgttagactctaaggctcattaaggtgtttataacaacaacagaaaatataatgcaataatagtaatataattaatttaaaagaattcgtgcagtctatcgtactccaaaggacaagtacgctaccaaaataactctctaactactgggattaaattgttcaagggagggtgcatgtcttgcaaccttcgggctcgatgtagtcgtacaaaccatctcctcctggcgcggagatttcacttgctccgactaccggaccaacgtcaatgctttctatttacgcaacaatcatcaccacaataaaataacagaaaaataaagccacccaaaagaaaatagtaccccaaagtgcaacaatgggtgaaaaggatttaaagaaataattttagggatttttggaatttcggtgaacggcgttgtcggtgacatggggccggggggtatcatgactagaggcttggggagccacggtcacccacgtggcctgaccccctcgggggggtcgggcccgagggtgacgtggccacccctccctccctctgtctccccgaggggt

SEQ ID NO: 62288 - DNA, 16618 bp, Oryza sativa
ttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggatggggattaatacactagcgttcgggaaaaggcaattttcccggtcgcgacaagctggtatcagagccatcttgactgtaggataagccaagtggataaaacccaaggacatattttataaataaaaattatttgcgaaagttcctttttctccttcccctaatgctatttgcaaaaggtttactccgttcttccttcttcggatttcaactagtactagatggtcaggtcagtgaagaagaagacatcgtcagttgttcgccgaagctccggaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgattgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaatgaaatagaacttaaggcatgctctcgttgtggagaaatcggtcatgttgccagctcgtgtgcctctacatgcgttcattgtgaggaagaccatccacccgataggtgtccaatgagcaggatcacttgtttcttttgtgaaggaactgatcatgtaccaaaagattgtcgattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaatttcaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgacttggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgcagtcctgtcacatcatcacagaaccaatcaaggatgcagtcactagaacaatgccagctatatctctccagaatcaaaatgagcagccatgtttgtggttttcagttcgctacttatcatggtgtaatcgaaagtttgcagcaaccatgtaatacataaatatattcatgtctataaacagtgagcttgctatgcttatggatgattcacgttgagaatacaatgtaccgatgttaagcaccgtccctttttgtttaaggcagtgcctcgtattcatgtaatgagggagaaatgtgtaatacagacaagttccaggaggattcgtttgaaagatgcggatatatgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatccggtatcagaaaaaggtcaaaggtgatgtggcagaagaacaatttggatgctccccatctcgaggaagcactaaagatgaccattggcaattaaaccctagtggtatagatacagatagcaggcaatgtatttccctgaaggtagtcagtgcagcttttgacgaaccacatcaaggttccactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctatgaaggcaaagagtgaaatcttccgctcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtaaatctgagttgcttgttcgggggagctattcccagttatgaaccaagtgatatgttcgaagatagtctacagaggtcagtttaaaatcacatgtaacggcgaagcctcagatttggcaggataatgattagacaataacaaatccagcagtaaagccatttgggaagacgtcaaagtatatcaagtaggataagttggctcccttgggaagcataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcggcacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggccaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctctctttccccccgtttttccctctctctctccctcggattcgtccggaatcgctcccgcaaacctcgccggcgccatcaatggcggccgagatctccgcgcccgtttcctccctctccggccgcgctctccccctcccgacgctatataagcgttccccgtgctctccccctccgtttccgccactcgccgtctctcctccccgtcggaatcgagcccgcaccgtcgcaccttctctccgccgtcgccgccgagctccggttcgccgccgtcgtcgctccggacctcctccccactcggcgtcacctccatcggctttgccgcgtccccgtcgacctcggccacccctccgcttcgctcgccgaccgccagagcaccgtcgcccacgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatgttgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactggtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctagcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacagattcacccctcagtcatcatccaagccattgggcaagatcacgcttcctgtgactttcggacaagcgagcaacttccgaacagagcagatcacgtttgatgtcattgagtttgacatagcatacaatgccatcattgggagaactgcactcgcgaagttcatggccgcatctcactatgcatatcaagtactcaagatgcccgagccgaagggaacaatcactattcaagggaacgcaaagctggcgctccaattcgacaagtggagccttgacatggtcgagcacactcctagcccacccgccacagctgagccacccaagaaagtgagcaaaacaaccaagacgccgaaaccagacggcgcaatcaaaattgttccactctccagcgccaaccccaacaagacagtcaagatcggggcatcactgaacaagaaataggaactcgcgctcatcaccttcctccgcgacaatgctgacgtgttcgcttggccatacgagaagagctcgacaaacttctcaaagctggttttatcagagaggtactccatccagagtggatagccaacccagtcatggtgcggaaggccaacgggaagtggacgatgtgtgtcaacttcaccaacctcaacaatgcgtgccccaaggatcacttccccctccctcgaatagaccaactagtggactcaacagctggttgtgagctgttcagcttccttgacgcttactccggctaccaccaaatcagcatggcaaaagaggacgaggagaagacagcattcatcacgttgttcggtgtattctgctacgttaagatgctgtttggactaataactgcaggaaacacattccagcgtacggtccaaggggcactcaacgatcagctgggaaacaatgttgaggcctacgagaaacctttgacaacctccgatgatattgcctcatgctcaatcctgagaagtgcaagttcggagtaccatcgggcaagctgctcggcttcctcgtctctggcagaggaatagaagcaaaccccgaaaagatcaaggcaatcgagaacatgaagtcgcccacgagactcaaggaagtacagaagcaaaccggatgcatggtggcactaagcaggttcgtcgctaggatgggcgaacgaggacagcctttcttcactctactgaagaaacaagaaaaatttgtatggacacaggaagccgaagaggcgtttatcgcactcaagcgctacctgtcaaatctccctgtacttgttgctccccaacctaatgaagaattattcctctatattgccgccacgccctattctgtgagtacgatcattgttgtcgagagagaaaaggtgcaaagaccagtctactacgtcagcgaagctctccacgacgcgaagataagatacccacagatccaaaaactgctctatgcagtaatcatgacgtcaagaaagctacgccactacttccaagcccacagggtcacagttgtctccaccttcccccttggtgaagtggtgagaaatgggtagtcgagctaagccagtttgatgtccactttgtaccacgaacagccatcaagtcccaggttctcgccgacttcgtagccgattggactatgcctgaaaacatgttagacagtcaaacagacaacgaaacatggacaatggcgttcgatggcgcactcaacagccaaggagcaggtgcggggtacatcttgacatcaccttcaggagatcagttcaagcatgcaattcaccttacttgagggcgaccaacaacacagccgaatatgaacgactactcgctgggataagagctgcggttgcacttggagtcaagcgactgatcgtaaaagtggattccgaactagtcgcaaaccaggtgcacaaagactacaaatgctctagccccgagttgtctaagtatctcgcagaagtcaggaagctggaaaaaagatttcatgggatcgaggtccgacacatatatcgcaaggacaacatcgagccagacgacctaagacggcgtgcgtccagacaagagccactcaaacccagcacctttctagacatcctgacaaagccatcagtgagagaggccaacgatgaagatagcccagtcgcccccgacatcagctcgggggctatagaggcagaacgcatcgttgccgacattgagaccacgaacgactagcggatcccattcattaaattcgtaagtagcgacgagttacccgaggacgattgttaacagtgaaatttggtaaatccggaatagtcatcggcttagagtcagcatcggcttcgaagtcctgagattagccgataagagttgtcaagtcgccagttgtcggattcttgctatattcggttaaggaaattgatctactaaaggaagcttatccagaagagaccgagttcaaagagaatacggcatggcaagttatctattaattaggaatagtttgttagtttccttttatctttaggaaagtgtgtttagtgtcctataaggactttatcttttccttttatctttaggaaagtttctttcttgtccgacaaggacttgtatcaactcatggttataaatatgtacacccggggtgtatgtaatctatctctacgatcaatacaattcggtgcatcgccaccttttaccttttctactttattttatcgtccggcgggaattggaacttgatgcggggctgcatcggtgttcgatctccgcctaaggggtaagtccaatgttccaccggcccaggcaattgtatcgtctacatcggcatcgttcaaggctgcatcagtacattcgatctcttggattgctctggtttgaatgatatatttgcctacctatttatcatatgtctctgttaatctagtcttagcatctcaatttagctctatcggctgcttctcgttttagggtttctgccggtatcggctaaatcgccatgctagattagattagcttagatatctaccaccctgaaaatcagtcaacggcttgattgtatagatattgtgtttcttttcatacttagtgctgcatcagttaagtttgatctactaagtcgtgcttagattcataatctctagcctgctttttgactgccaataagggtttcatcggggtttcagccgatgaggtatctggacattgcatcagcttataaggattgcatataagttggatttagcttatgacaataaaggtttcactgttttatctaatcatttggattttatggcatcggacccccagccgatgtatgctttagccttcggatcaatgcttattccatcatattattatcagccgattggtttttatcggattatattatcgttatattatcatcagccgattgcctttatatcattattaatatcaagtgtcagattctacattggatatatagccgatttatcaaaaccctatcgagatcggctggtatcggtatcggctattatcggcatcggctagaatcactccatcggcttgtcagctatcagctgtttgatctactgtttgcatatcttgtcagttgtaggatcaaactgactggcacgtccgcatctcatcaagatttggacatgcacaggagctaagcagatctcctaggctggtgtgttcgatttttttcgtcaacaacgatgcagaagccgagaaaataacccgtcaggcaaaaatctacagtatgatcggcgacgatctatacaagaaggcgccaaacagggtacttctcaaatgtgtctcgtccgatgacggcaaacacctcctcctcgacatacacgaagggatctgtggatcacatgccgtcggtcgtacattggtcgggaaagcctttcgacaaggatttttctggccaactgccctcaaagacacttgcgacatggtacaacagtgtgaaacttgtcaatttcatagcaaacacacaaagctaccagcgcaagcgctgcaaaccatccctctcacttggccgttctcgtgctgggggctcgacatactcggaccgttcccacgaggacagggcggctacaaattcctgttcgtaatgatcgagaaattcaccaaatggatcgaagtgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccacaggcgcttgacgacaggcacgagctagacaccaaagccttcatcttccaagggctcctcttctgggtttgggaaaaattgagcaagactgagtacaaccaccgtactcaacaagacacacccacaagtaaacagcattaaaagacacttagttgctcaaagctattttgtaaacacgattccagagctatacaatattattaatcaaggccgtgaacccacacgaacctgtcttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgtagctcgtgtagccttcatttgtcctagagatgtccatcgacccccgacttcgtccatctccatccgtgtacttttgtttataaccagactgagccataaactaagccttacccactagacatgtggaagtacggtagtactttgcaacagaggcccgaagaccggtccttatatggccgaggtgctactatcaaaaccatacaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattctgtaaactgggattcaatattgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactctacctaagacttcttctccaaagcttctcttactgaagggggaaaagattgagcaagaatgagtacaaccacagtactcagcgagccacaccggcagatgcatgattaatgcaagggggtacaaggggtaataatatataggggttaagttttgcagaaaacagcatttaaaagtcacttagttgcccaaagccattttaaaaagacgatcctagagctacacagtattattaatcagggtcgtgaacccgcacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcatgtgcaaccacgtgccacataccaccacggtatacagacggaagacatgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcctaattaaacagcgaagcatctacctaaattcatactagtggaaccatgaatagagtgtccactagttggggttttgtttattctaaggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctactaaactccatataacaagcagaaacaaagcacaaaaatgagttcttggcttcttaaggaaaaattagatacttgaacggtccaattccgagttcaaatggccaagttatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctctcggtccacgatggaccgggtgcacgcggcttacgccggccggcgccgtgggtcccacgcgtcagccgcacccgaaggcgcgggcggctgacggccgggccccacatggcagccgcggggcgcgcccgaaggcggcctcgccggcacagccgacgggaggcggcgcgcccgcgccccgatggtcgccgccggcgaccaccggcgcggcggagcggcgcccgagagaggggagggaagggggaaacgaaatgggcggtccacggctcaccccgggtcgacggcgacgacgggaacggcgaccggagcggaggaaggcggcggcgcggctcgggtcgacgaggacggcggcgttccggcggtcggcgggcgaaacggaagggtggacgaggtcggcgaggacgcggcgaagccgaaggaggcgacgccgaggcgggaggcggtccggggtgacgacggcggcggaccggagctcggcggcgacggcggagagagagagcgacgtcgcgagctcaaatccggcgaggaggaagggcggcgagaggcggaaccggacggaggaggtgcggggagggtttaaatagagccagtgcgagagagggtggccggggaagggaggaaaccggcgcgggaggtcggccgccatcaatggcgccggcgagattaggggagcggtttccaaccgaatccgagggagagagggagggaaaaatggggggaaagagagagggaatcacggggagtgatttccccctctttattgcgcgcggggacggcgggaggcggcgggattcgcggcggcggcggcgctaggtcacgggcgaggcggtgggagcggcgggaggatagggatgacaggtgggccccacccgtcagcgagggtggcgggcgggcccgcccgtcagcggcgcgcgcgcggggagaggccgagtgggccgcggggaggaggagagagagggagggagatgggccgagccggcccaagagggggaaggggggggaaaaagactttttagagcttttctttttataaaaccattttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgatttttatttcgggatgaatttatc

SEQ ID NO: 62289 - DNA, 32681 bp, Oryza sativa
  unsure (1)..(32681): unsure at all n locations
ccgaccccctgtggtgtcgccgccacgtgtgtgggttaggtgagcacagcggcgctcacctaaccgcatttatagcgggtcagacgcgcgcgccacgccgcattcaatgcggcgcagcgcatgcttatccggtccatgaccggtcgcagggtgtgaccggtcacagaccggtcagatcgcgggttaggtggcaacaggcggcctgtcgcacgcctcgccccgtctcgtcggaatgatgagagcttcctggctcttgtccctagccggagccagcgtgctaactcctggagttggtatgtcagtcccggtcagatccattccaggcttcagcgcaagtatagcaaggaagtcgctggccattaaatgaaggttgaaacgggcgtccaccgggagagcgaacgagcggagcagaaggcgtgtgctctgcttgtcagaggtcacttccggctgtagactagccctcattgtaaaaagcatgttcctttcttaggcagtaagaggcccatgtggtgacccctaaccagataaaaaggaggcccaggcctaagaaagagagaagaaaaagagggtgctggagcggaactctctctggctctccggctctcggtaattccttcacacacagatccaccagaacacaggagtagggtgttacgcttctcagcggcccgaacctgtctacgtcgcccgtgtcttgtgcgcttcctctctcgctgacattcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagcccaatggccgaacgggcagtggcgcacaacctctctccgaacgctagcggtgacgacggggagcagaacccgcgccgtcgggctcgcaccccaccgtcccctctcgccgaaatcttgggcggggagaggcgctcggggaggtcagaggatccgcgacatcgccgcccgcgggcgacgggggaggacggtgtaacgccccgattttcgttcgggtttaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgcttatcctccctcccggcctcccctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccgacgccaaactgcccccactcacccacgtcgccggcgcccctttcccccttcaaatccgtcgccaaccggcctccccgtcgactctcgaggctataaaaacgatccccgggctcccctcctccgtttccccctctttcccaagcttccccatgcccgaaaccactccgccaccaccaacctccctccgccgccgccggttgccatcttcggccggccacctccgccgccgtagccgtccccgcgccacaccgcttgcgccaccggcctcgccacgcattgtcgcacaccgtccgcaactccgtttccccaaaccacaatcaaaacaccgattccatcgctcacccgagcaccgccgccgtttcgccgccttcggcagcctcttgccgccgttcccgtccacctcatgccgcgctgccaccaccactagcttcgctgctccgccggcaagcccggccaccacgccgctcctccattccacccccgagccgcccgctccacggtgaacccgagccacagccacttttgtgcctccagtcgcacctctgccgtcgccctggccaccgccaagccgtgccgtttccttcaccggctcggccgcttcaagccacagatcggtcgccgctccaaaccaccggaaacccaccggtgctccattcctttcgatccccggtgagcccgccgccgcctaatccgtgccgccggccacctcctcgtcttcgtctcgccgccccattcgctcggtgagaaccgcctccctctccactctctcgccgcctctcgcgccgtcgccgctcgccgccggcgtcgtcgccggtggtctaggctcggcggtcgccgccgcctgtgggcgtgcctgcctggtcgtgccgctcggccgcccccggccgtccgatcggccccggccgatccggagcgtcgggtgcgcgcccacgtggccggctgccgccgtggactcggtccacggtgggctttgccgctgacgtgtggggcccgcccctttgtgacgcggtccgcgcctcaccccttgctgacgtcagcatagcctttttcctttgaaaaattaaataataattgcgcaataaatcggtaataattgtagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttgtcctcgttttgcgtgccagcgtgtagtttccgtcgtttcggaagtccgcggtcgcgaggaaaagagttcggaagatcaaagtgaataagcaaggcaagtcacatattccccttgagcatgttgatcccaatttacaaatgttttactgtttgcaaataaatatgcatattttgctaattacatggggtcagggtattacctatctgctcgcttgtgccatgtttacttgatatctatcctttgtcaaccgggggtaataaatcgactagctcatgttacttatgtgacctagctagaactatatgcttagccatgcttaattaccactagctcagttgatgggataattacagtattagacctttctagtatcttgttgagctgcgtgctcgagacatctggccatgcttcatggtcgtaattatccaactaaaatgcaactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgtggcttccggattcacctaggcacgagaggggactgcccgctgccttgcgaggagtgggggtgaaacctgagatgtggtgtgcttggttagagggggttatgcgaagggtcctgtcacggcctctttccggtatgtcgtggtggcatgtcggcgcacggaaacgtgtcgtggggctgtgtcttgtgggtacagttgtagacctctgatcagagtaaaactattcgaatagccgtgcccgcggttatgggcggtcgaccagattcaccgtgattagtcccaccttaataaatcgactcaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccataaaccgtccttgtgttccccttgcacgtctgcatcgttggtgtggcttgctgagtatggtggttgtactcagccttgctattattcccccttttcagaagtgtagtgtttctgagctgaagatggagttagaggaccaaggctcagaccccagttgagttttgcgtgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatacacaaaatagtctggaaatttgggctaaatttctgggcgtgacagacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatgacggcgcagcagcgcctaagcgccggcgggcggtcctccgccaccgagacctctggcgctgccgccgccggctccaggtcgtcgaggcggagggcgcggcgagcggcggccgttacccgccgttcgtccgccattccctcatcaatgcctccgacccaagaagatgtgcgtggggggccggatgcccgcctcgatatcgagcgccggcgcgactctcgtcacgccgcccacgcaacggagggcgcttcctcgtccgaagcgccacttcggtccgggcacgggggccggccccccgtgtccccggttggcggtgctggctgtcgagcctttgtggcgagccttcggaacgtccgttggcccccaaggttccggcccaccatcaccgaaaaatacgacggaagcgtcaaccccgccgagtttctccagatctacacgactgggatcgaggccgccgggggtgatgacagggtcatggcgaatttcttccccatggccctgaagggacaggcgcggggttggctaatgaacttgccacccgcgtcggtccactcttgggaggatctgtgccagcagttcaccacgaacttccagggcacatatccgcgcccaggcgaagaagcggacttgcatgcggtacagcgaggggacgatgagtctcttcgctcgtacattcaacggttctgtcaagtccgcaacactataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggtcgcccccgggtccgccgcttggtcagagcggcgggacaggaggaggaagaagaggtcggcccgtcccgacgacgagggtcatgtcctcgccgtcgagggcgcctcgcgggccccccgaaaggggaggcctgcgagcgacaaaaagaaggaggccggcgctcccagcagggagcgcccgacgggcaagtggtgcaccgtgcacaacacctccctccacgacctcgcggactgccgcgcagtcaaaagtttggctgagcggacgaggaagtgggagaaggagaagaggcaggagcgccgtgagggcaaggccccggcggctcccgccggcaaccggcgaggtgaggccaagcagaaggcccccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgactcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggagacgagaggctcagcacctccgtcccggccgccccaaggcggcggatggtcacgtgcgacaaggtcccggtcaaggaggttgccctgggcgacggcccgtccaagaccacacgaatcggtggtcttctggacgacaaataggaagacgcgctcgtctccttcctgcgggcaaacgccgacgtctttgcctggagaccggcggacatgcccggggtccccagggaggtgattgagcaccgtctcgccgtgcggccgggtgcaaggccggtccagcagaaagtgcggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgtggggtgcgaccttttgtgttttctagatgcatactctggttatcatcagattcgcatggctagggaggatgaggaaaaaactgcgttcattacccccataggaacttattgttatacgacaatgcctttcgggttaaagaatgcaggtcctacttttcaacgtactactcgaatttctttgggtagcaaattaggacgtaatgttgaggcctatgttgatgacttggttgtgaaaacgcgcaaccaagagaccttactctcgaatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttaaggatgtgcagtgcgtcaccggctgcatggccgccttaggtcggttcatatcaaggctgggagagaaggcgctacccctatttaagctcctcaaacgctccgggccgtttacctggatggaggaggctgagagggccttcactcagttgaaggcgtacctcagttctcccccagtcctggtcgccccggagccagatgagccgttgctactctacctggcggcaaccccgcaggtggtcagcgcggcgttggtcgtggagcgcgacgaggagaaccctcactccgcgcatccccaccctgtgtcgactcgacccgggagagagcagggaggagaggcccccgagccgaacggcggcccgaggcccccaacggccggagttggccctccgcctgcttgtccgacggtgccaggcgcccccgacccccaggatggccccggggccactgcgggaaggccgcgcctgtcgcctctgaccccgaggtcgtcggcacagaagccgagtgcgccccgcgcggcctctcggacgaagagcgccctggagatgcggccccaggcgaagaggatcggccccgccgaaaggtgcagcggcccgtctacttcgttagcgaggccctccgggacgtcaagacccgatacccccaggcccagaagatgctttacgctattctgatggcttcgaggaagttgcgccattatttccaggcgtatcgggtcacggtggttatgtcttaccccctcggccgaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtccccgctcccgaggccagctcgggcccctcgcagctgccccacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctccaaggagtaccgatgctctgacccgcagatggacgcttacgtgcgccaggtgcggcgtatggagcgccatttcgacttgatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctaggttgattgcttggatcactgagatccaggcgtacctcgcagatatgactctacccgaggaccgcgaagggagtgaacgcgtccggcgcatctccaagcgctacgtgctggtggaggggaccctctatcggtgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccaacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcattaagatcgataagcactccgcgcttaaattcatcaggggcatcactgctcggtttggggtgcctaaccgtatcattacggataacggcacccagttcactagtgagctcttcggtgactactgcgaagacatgagcatcaagctctgcttcgcctcccccgcccaccccagaagcaatggccaagtggagcgcgccaacgcggaaatcctcaagggcctcaaaaccaagaccttgaacatcctcaagaagcacggcgactcgtggatcgaggagctgccagcggtgctctgggcgaaccgaaccacgccaagcagagcaaccggggaaacgcctttcttcctcgtctacggcgcggaggcggtcctcccatctgagctcaccctgaggtcccctcgggtcaccatgtattgcgaggctgatcaagatcatcttcaccgagacgacctcgactatttggaagaacgaagacggcgcgcggcccttcgagccgcgcgctaccagcagagcctgcggcgctaccatcagcgccacgtccgggccctatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcttaacccgtggaacatcgaacaccttcgtcgcttctacccctagtgggggtcgggtgtcatgtctcgggctcgggcgaaccccgcaccccccctcgggcgtgcagggttggccgggggctaccacatgcatatacttatcttttttctcttccgtatttcaataaaagcattttcgatttcctgaggactgtgtctgtgccatcgttcccttttgaagaatcttggcttggattagcacgctcgtgcccgaccctgccctcggtggcccgggccggctaaaatcgccaaacggggcccagaaccgagccgtgccccggggcgtggtgaactccgggggggaattggcaaaggcccacaatcggggcactagcctcaaaccgcgctcccggcctggccagtctcgacacgtggatctccccaggcactagccccgacccgcgccgtttgaggctggggcctgggcacgagcccttgttcaagccaagacacagaaggactgcggcacagaccatcctcgtctcatgcacacgacaaacagaattgacacagaaatttcctctttacttgattacagattaaatcagtctatacaagaagggggcccgaaggcctcggaagaagaaggaaaagttattaagattggcggggccctgggggctcactccgacgcgcccgggtcgccggcctcgtcgtcgctgtcgtccgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaactcgtccagcgctgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcgtacttcgcggtccgcccgccccaaaggcccgcctgccgcccggcgcggtctagacgggagacggcgtcccgaagcatgccaggccctacctcgctcgccaagcggagggcctcgacctccccggcggacgagtccagtgcgccatgcagcccggcgatggtgtgctcggcggctgtgaggcgggcggctaggtcgccgtcgcccgcggccgccccgccgctgtgagccctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgtagcctcggcctcctcgagagctcgcccccgctcggtgagctcgtcctcgcggaggcggagtgcggactcctcttcggcgcaagcggcctcgtgcgccgccagtgttgcctcccgggtggcgacggcggcctcaccgtccgccaggtctctctccttcgcgtccagggcgcgggcgcgctcctccagcgccgtggcgcgagcctcgagggcctcttcgcgctgtcgggacgccgcctcgttctccgccgcccgccgttcccgggcagcggcggcgtcaaggactccctgggcggcgtcgagcttcttctctagctccgccgcccggctcccgtattggaggcggaggtcgtcccgcgcctcgtcgagcacggcggtggcgatgagggcagtctcccgctcctcctccacctccctagcgatctccgccaggtccctacgacgggcctcgagctctgaggcgtgccggcggtgtgccttgcggcccgcctccaccatggcctccaccgagcgccgcccctcctcgacgcgcgcccatgccgcgtcgagctccgcccgctctacctgcaggacctccatctgggcacttaacccgtccagcaccgtgctgttcgcggcggccaaggcctgcaggaggggctccgcgctcactggggcagcggaaggcagaggggagagccgcctcggtgtgggtgccgcgcgactcggcccgccgatcgacgtgccggactcgggggcgtcccccgaagctggctcgtcccaagcgtcgcccgaggggtcgggcccgagcggcgcgcccgcgacctcgtcgtgggtggcctcggaagtcgtcgtcgcctcgggcggagtcgggtcgggggcttggcaggccgcctggcatgcgcgcgccgcttctgcctcccggacggactccccggcccggcggagtctggcctcctcccgagcggcctcctcagcctggcgaacccggacggcctcctgggcagccttctcggcttcccggaggcggtccgcggcttctcgccggtcagcttcctgcctccgggcctccgcggtcgccgtctcctcggcctcagaccggccggacttggaatggcgggggggggggggcgacgggatctcgctgaggcagaagaaaaaccagaagacaaaaagaaacgggtgagtgaaaactcgccttgggagatgggagaatgaatacggccgcggtgggcgtggggacgaacctgcggggaggtcggctaaacgaccacctcgggggcgagatgagattcccccggcatggctcggtcccccccatcttgcggagccgcttcttcttccgctccccctcgggctgcagcgtcggcacggcaccctctgggcgcctgctgctggcacgcaccgccccgccccctcggggaggagatgggggaggggtaccctcctgcttcctcttcccccgggcgtcggcagggcggctgccccccgggcccccgtcgcggggcccagaaacacgaccccctcccggggtagatggttcccccctgcggctcccgcccgcgccatcgtggcctcggggggcccgctcccccgacgccccgaccgcctgcatgatggtcaggatgttggcgcgctccggatcgcagcagagggggaggactccttgggggatgagggatgcctccacggagctgagattcagcacccgttggaccaccatcttgaagtcttcagggacccagtcccatttgcgtccctggtgggtcctcatgtagtcctcgggcccggtgtactcccaggcgccccgggagcgccgttggagcggcgcgatccggcgacgaaggtagtcgccgaacaccatggcccccgtgagcccctgggatcgcagacccgccaggcggtcaagaacggtgtcatagccgtctcccagatctaccgtcgcccgccagctggaggcctgcgtcgggggctggctcggaagtcggaggcgcgcttcgtcggcgaggggggtgtagaaccagtcgctcttccagtcgtcccacttcttgcggagaacgcagggaatgtagcggttcagcacctgcccccgcggctggaagtagcagccaccaactaccgtcggcggcgacaccggctgtacggtgaagaaccaccggaacagccggagagatgggcgcaccccgataaacatctcgcacaggtgtgcgaagatggctaacgtcattatcgcgttgggggttaggtgcgccatctggagatcgtaaaactccagaatatccatgaaaaaagcagagaatggcgggaccagccccgccattgcgaaagagaggaagaagacggaccgccccgggtagtgtggcgccgggcgtccctcgcccagcgcgaccacctcccggccggcggcagattccggcatgaatcggcgcggcagcccggcctgcctctcgctcacgatacgggaaggcggcagcacgctaccatcgagcggtgcggagccccgtgccatgacgccggcggaggaggagcttgagagcgagcgagtgcggcaagggtagggcacaggaaacgaagagttagagcgcaagtggcgaaggcaaggggaagagtggcgaggggaaggaaacgaatcccttcctcggcgtctttattcccttgccaacgctatgcccgtctcctcgcttcccgcgcccactacctcgccccctcgtttctcgcgcccacgcctccactaaccccactcgcccgtttgcggcgcgcgcggcagatgtgtggccgtggcggttgagatggggcagatcgtgcgcgcattaactgcgctcgccaaccgagaaaaacgccatcatcatgtctccaggcgaaacgaaccggctcgtcccgattcgcgcgctgctcgagtaatgtagcggtcttgaagaggccgctcattattatcggtcggttttcccttaccgatgcacgcgatttacgaccgctgggtttctgcccgcctgtagagaccggccccacctgtcaccgggcctaaggagtgacgtcacgcccgagcgcttccctcgaggggggcgatcgccctgacgtaacgccgggggctactgtcggtgacatggggccgggggtatcattactagaggcttggggagccacggtcacccacgtggcctgaccccctcgggggggtcgggcccgagggtgacgtggccacccctccctctgtctcccggaggggtcgggccgctcccgtttcggccccgagggctggggcgccccgaccccctgtggtgttggcgccacgtgtgtgggttaggtgagcacagcggcgctcacctaaccgcatttatagcgggtcagacgcgcgcgccacgccgcattcaatgcggcgcagcgcatgcttatccggtccatgaccggtcgcagtgtgtgaccggtcacagaccggtcagatcgcgggttaggtggcaacaggcggcctgtcgcacgcctcgccccgtcccgtcggaatgatgagagcttcctggctctcgtccctagccggagccggcgtgctaactcctgagttggtatgtcagtcccggtcagatccattccaggcttcagcgcaagtatagcaaggaagtcgctggccattaaatgaaggttgaaacgggcgtccaccgggagagcggacgagcggagcagaaggcgtgtgctctgcttgtcagaggtcacttccggctgtagactagccctcattgtaaaaagcatgtttcccttcttaggcagtaagaggcccatgtggtgacccctaaccagataaaaaggaggcccaggcctaagaaagaaaagagaagaaaaagagggtgctggagcggaactctctctagctctccagctctcggtaattccttcacacacagatccaccagaacacaggagtagggtgttacgcttctcagcggcccgaacctgtctacgtcgcccgtgtcttgtgcgcttcctctctcgctgacattcctcagatcgagggcgaagaacctcacttagcgcccccggccgaaccggcaaaggggggcctgcgcggtctcccggtgaggagccccacgctccgttaggcgtaccctagggctaaaattagggtggcgtcaacgggtgctcggattgcaacgaaactgacacggatggattcagaataattctaggagtttgttataggtctcggatttcgatttcgaggtcaaacagatgtcaacttgataggaaaataaaaatgatttttcttatttatttttcaacaggaaaatcggatttcctgttcttctcgttctctgcacaggaacaggccggaatcccacattgccggtggcagaggaggccggttttggacaagggggtgccggttttgtgatctacgggttgaggcgattccgtttttatggttgacggcgagagaaacgccgacggtgaggctggtggcggtgggcggaaacgggaggcggaggcgactccggcgaactccgagaagggaggcggcctgatgaagttcactaaggctagaggagtccgagggtggcgatagccgaagttagggtggcctggagcggcggcgcgccatgtggccggcggcggccgaacagagcagtggcggcgggaggcgacgcttgcgacattccggcgatgaattggatgggtaaagagagggggaagggagtactcgtcatggagaatccaattttaccttcaatttctgaggatttgcgacgtatgcgacgaattttgaagctcaatcaatggcgtgttttggggatttttcctccggtgccgacgattgagtcaacggtggttggggcggattcttttgcctccggtcttgagccttctagttgagagacgaaggaaatacggaggcgggaagctggaggtgtcgtggcggcattcgttcgtcgttcgtcctcgtgcgagagcgtgcgggcgtgtggcgtgcgcgggctggcacgagctgggcgcgagcgcgcatgagcgcagcgcgggattgccgcgaggcaacacggggcggcacaggcgctggctcagcctagccgagtagaggaagaaataaaaggaaaaacggagagaggaagaaaaacagagaaagagggaaagagaaaggaaaaaaaatggaaaaagaaaattaaggtggaaatagggaaaaggaaaatatggggaagattaaaataaataggatttgaattgatgtggaatttagacggtccaacattcgggatagaattaaatcggattaaaggaattatttgagggatgatacgcactttgcgacaaaattaaacgagaaaagaaacaccggaaacaaacatggaaaataatattttaaataaactactaactcgacagttatatttttagagaatcaaagcaaactaaatcggttttaaaaagttgtcaaattttagggctgttacagaaatatagggagtaattgtatatcaataaaaaaactataggaggataaatattcaattccaatatagatatgagctcaattttctatgcacacaagaatgataacattttcgcacgcggtttgcactacccatatgaaaagatactgaaaataatttttaaatgataagtgcccttacagcgaaaaaaaatctttagacctagcagggttccagtcaaatgcaaaaaatcattttttatagtgcccttgcaacaaaaaaaaatctttatgcctagaaccaataggtaaatatacgtttaggtatcgattatctctacgtgaaacccacagcatccatgacgcgcatgagacccacccaggttcgtgaaaaaaaggcccccaaatatgcatcattaactctcaccgtacacaaaagaagtaacatatgtaatttggatttcccatcgcaacgcacgtgcatctttgcaattcttaaaagaaaaagaaatgagagatgaaaggaaaaggtccacttgaggtcccttatcttgtcgtcgagtttcaaaatcgtccctgtgaagcatctaggcccccgttgttagttttggtaattaatgacaagcgctaattgtggactaaccgttctatcgagttataagttttgagttaggttcacatcatgtgtgcacatggatgactaccgatggattaaaatttgatggcgcaaagcaaagaaaagaagatggttgttggtatttcttaacgacattactagaaatataattcccaacaatggcgcagaaatacttctggtatattatggttacagagttcatccgcaagcgcacggatataccattgtagcatttcacccgagagtattccaagggtatcgtatttattttatcctgtgggaagatcttgtagagagaactcaactaataatttatatgttacttgtgataatcatattttaagcaggtgttatgataatccaagtgtagagtgacacacaagcattacctactcatcctcataataaataatctaaactaggtggaaagaaaagagaaaggaaatctattcctatacttctaatatacctagtatacatactggctaataccctctatccgatgtcatcctagtacttcgagaagccacccctgactgccgagttccttacgacagctcatcatgaccatccaatcggggctaaatatggaggaataccctccccaggaaattaacttaggattatatataggcgcagaggaatacccgtactgagctatcaccatcagcggcccacctctcatccgcaatttataacctcaaataatgatatcccgtaatctagacaccacgtctaaactaccagatactactctaatatcatcgtcatgatatagagtaattgcataagcaaacactatacccgcaccaaagcatctcccagataagctagccatatactcagtataacaagaacataatgtanagttggtactcatatactcgaaaagtatttcaataccagaaatgtatatagaagagtattctaataaaagtacaaagcttacaaaagaggaaaggaaagctactaaagccatacccgaactcttccgaagactttcggactcctgattcctattctaattctattccaccagctagatactactaaactaaacttgagaggaatgagagagctcttgcttgaggtgtgtctttaagtgaagagagtgagctccttataaagaggtggttatgatggttgtggaaggggaattgtccgaagtacccctcaaccgccatcaagagaagatctggagcgtccctgccaaaccccacatccaacggtggagaaatgctttaattttaaattagtcgaggtgtagggcgatcaaatttgctagtttatttttagctttcgccgtactattaagaggggtaatgacctagcaaagagatgatttaaattgccacgctaggtcatgtttgcatttagacttgtgcttattttcatatcattgtatcttgctgttgctgtggtgagtgaccaggggcggtcaaaccgccacacagtggccggtcgctatgtggcggtctgaccggggcatgtcggccggtctgaccggccccctggtggccggcggcagcgctctgggcggccgatccagagccgccagagccgaggttggtcggaccggccacccaactgcggtctgactggccaggcagttggggcccaatgtcagccttgcaacggctagaaatctagacgttgcacagtagcacggtatgaccagccacacacctccggtcaaaccgacagtacactgagttgggggatttcgcccccaacggctagttttagttggtgggtgtcacaccccaatctagtatcaccgtacaacggcacctgacaggagcgtgtcgtagggaaaacggcgcaaaccgcttcctacgaaaccgcgatctcagtaccagtcccaggacatagcgctggtacccacgatgacaaatatgaatcattgcaatccttaaaataaatagaggacttatttaccttaacttagttgcaactcaggacagcccgagaatgcatccgacgacgcggacgaggaaacaccaacaacaacagcagcagcggaaccaacgatctaacacccaacaccacaggcgacggctgggaaccaggatgaaaccctattcttcacttcacttcatcttcaacttcacagcggaggaactatatatatatttgtatagagcaagggcgagtactttcgtactcagcaagtcacgggaacttaggtgtttgatgcaagcttggaagagaggcaaggttgttttgcaaatcctttgtttgaaatcattttgaagtcactaagtgatttatttctttctaagtttgggccgaaaagagacttgcgtctcgattctactttaagagatgtttttcaacaactcaattcgtaatgtaccgacctcccgggtcagatcattacttctcggctcctagagccatttaacttgattaatcggctcccagagcctttttcattttctcgaactcccagagtccagctgcccagcagcacaacaatttgcttccactcaggaagcctagtctatgatgcccgcagacatcccgaagcacacagattcgtttcagaccacataggtcatccatctgccatataggctgattctggtgacgattcccacaccacaacaatttttcacaaagcactgacaaacaaatctatgctataggaaacacctcatatccgcccatgaccgtgggcacggctgttcgaacagttagttaacctctgcagagggggtacactttacccacacgacattactaacccggatcacccagcccgtgagatcagccacgtcgggagatcctaaggctttcatgacaatgcatttcgaaagtcgacaccaccctgttgaatccacttgtctcttggcatcaaggcttccttggtttgctatttacttagccaggggcatcctattgcacccgtgtggtcacacttattatatgctcggatgaatttcccacaggaatcagtccttatatgcgaatacgggacaatgccacataggcacaacccccgcatcgtgagttttcacaatttattttattttcaaacacgccaacaccacatgtcgggttttcaaggcttctcaaacccacttcccaaattatcgacaaacaatggtgtatgtggaatagttagtatatgcgctcagagagcacggataccgaagtaccacaaaggtggagcaacaaggaatcagggtggtacggcctacaggaattagtgcgactactgggtaggtccgtcggtttggcacgcaaaccgaggccaagcaagttaagtgtgtgattctaataatgcaagttgtagacaaaataataatgactttccaattataggagcaattgattaaagggtgacttgccttgctcaaggtcttcacgaagcttcacgaatcttcgagaaatcccgcgattgacgaaaatccggtaatcgcaactatacgcaaacaatcgacaacctaaacaaaagaccaagaaaaagatcctatttggactaaataatagtgccattagattgatctcaattttagagggttactggaagtggaatggagtcaatcgaagttatgaattgcgagatatgaattttggaagtttagttggaatttctggaatacgagaaatggtttgtggaatttatagaaataatattctccagaatattattgacagtcactgacgtgcggggccaagggaaatgatttatggaatttcagaataaagaattgatttatggaacaaaggaaaaatgatttatcaaatccttttgggaaaggaaatcaaggagggatgtatattggacttgtttagggtggcattggtgcggcccaggtggcttgcgcagcgcagccgaaccgatgggctggcgcgcgcgtgtgtgggagacggcctaagaggggcgcgacggttgcgggctgaggcgcggggcgagtgggccggctgagcatgacccacgcggcgcggggcaggctggtggagcgaggccgagctattgcgggccggtggggcgagcgcggcccaggcacacgacgcgggcgcacatggctgcgggaagggtgagggctgaccgggtcagcttgactcggtcaagccgaggtggctacgacgtggccaccacgcgggcataggagagagagggaagcggtggtgaggccgaccggggatccaacggtccacggcgtgcgaggaattccggcgagcggcggcgaaccggagtgggcggcgggcaccggaagcgagagggggtaagggcggtcccatccaccggctcggatgagggagaggcggccggcgacggcgggatgggtggcatggcccgagcgcagccggcgaggcgggcgactggggtggcggtctgagaaggttcaaggggacacggggagggtcgcggcgcaagaaatcggcgagagaccggccggcgacggcggcggaagcagagctacggcggggcggcacagcactgagaggggcgtcaccggggaaacagagagggggcgcgaggagttacgggagggcgacgacgaactggttcgacgagagaaaagggccaacgacggcgcgcgactgcgtggtggcggacgcagcatagcgtgcggtacgaggaggaagaaggcggcgatgcggaaacagagcgcacagcgagctaggcgagtgcggggacggcgaaaaaggaaggtgaggagctcaccgacaggaggaacggtgtcggcgacgatggcccgatggtgagaagggcgggaagccagcggggagggcggccgggctccacggaggatggtgtttgcgacggcgaacgcggctcgacggggcagaattgcgtcggccgagtggtggtgcctggcggcgaacttgatgccgaggcgagcgcgccgggaaggagcaggaggaagacggcgacgagacggctgcagctccgaggttgacgaggccgacactgaggcgcacgtggccatagacacagtgcaacagcgggaaggaaggggctcgggatgggattttataggcgaggaggcgcttgactggcgctcggctagcgagcggcaatggcggttcgtgggtaacctgaaatcgagcgacggcgtggatgcgtttggatggcgaggtcggtggatcgggcggcatgaattgaatcgtgagtgcgggaggggcagctcggctagttcaaggtggggcgcgacgagctggcggctggcatcagcggcgtcagggcactctgcctccaagagcaaggagacaaaggtgggagagagaaaccaatgtccaggagggaaaaagaaatggaggacggtggaaaggggagcttgctccttccgttttggggaggtgcggcaggcgaggcgcgtgggagcggtatggggcacgcgacgcaggcggcgcaggcgcgacatggcagcttccaatagtaccacgtgtccacgtctgatacccatgagtatcagatctgatacccagttactaggtttgaatattgggttgaataccgaggtaccgagtatgatacctatgaatagcagatgagatagcgagttatcgagtctgatacctatgaccatcggatcgacccatgtaaacctaaagaggtgtacgggtagtgtcgtattggagtattgcatagctattttgtatcgtaggagaaaagagcactgccactagtcgatgtagacctgagggtctccaatatgaaaggacagcacacaacacgttttcagagataaaaagaatccaggtctgtttagatctcctagcaaaattttacaccctctcacatcgaatgtttggacatatgcatggagtattaaatataaatatccgggcctattgagatctcctagcaacattttatactctctcacatcgaatgcttggacacatacatggagtattaaatataaacaaaaaaaaattaattacatagattgcatgtaaattgctagacgaatcttttaagtctaattgcgccatgatttgataatgtggtgttacagtaaatacttgctaatgacgaattaattaggcttaataaattcgtctagccgtttacaggcggattctataattagttttttattagtctacatttaatacttcaaattagtgtccgtatatcgatgtgaccggctaaaactttacaccccttttaaacacccccttaggctgtgttcgctcctcctggttggtaacactcccgtccggcatgaaaaacggagcggtccattagcacgtgattaatttagtatttgcatttttttttcaaaaatggattaatttgatttttaagcaactttcgtatagaaactttttgcaaaaaacacaccgtttagcagtttaaaaagcgtgcgcgtggaaaacgagagagatgagttgggaaaatgggcatccgaatacagccttagtgagtaatggataagtagaatttatacactataccgttgagacggtacaccgtcccatatatttctccaacggtaatatctgcaacggtagcatcgcgtaaaagaaagagaaatctcccgtccggttgtctcctccgctgcttgcgccgccgccaagacgagtcgcggttgagcatgtgaggggcggcgatctccatccggcgagcagagcaggggagaggagaggatcctggtgaggggcggcgatctccatccggcgatcttctcgggcgctcgcgctcccggtccccccggcggcgatggcggccgcggcggttggggtggcgagcagagcacgccggagttctggctcgaggggagtggcattctgccgatggacgaacggcctcctccacccgcgcttcgtcttccccgaggccgccgcggtggcgggctctggggctggctccgctcaaggtacaatccgccgcgaactccctaggttttctttttggtggctcggttgcgggatctaccgcgcgtttgggtgctcggagattccgatgggtgcgcttgcttgcttgcttcgcgttccgatcgatcgttcatcagatcaatgtgatgtgatgcctgtcgcatgattcgagttctatatagtagattgatgcattaattcatttgtgtacttctctgaaatttggggatgtgagtagtaggttatctgaacttcacgggatgctatcggaccaaagtaattagagaatttccctagggtgtttgggtgctggattggagatgtttagagtggagactggacaatctacgttacaggagttcttctggtgctacgcatattttgtatccacttgtttaagcttatgctttaggaaatgtgctgctctgccccggcacacacgttgcattaggaaatgtgctactctatagtgaactgcggaattaattcctcaccatgtgttttctttggggatacagactgcattgcattgagaaacgccattatgccaatgaaaatttctccatatgcttcctatactggttcacatagtgttcaacactgtaagttcctgacagctggaacttacagctaggatgctgtaagttcctcacttcctgtgcccatgttctgaactgttccatatgcatttcccacttgatgttatttcaaattgctgtgttccacttttgggccatatatctggcagtaattcaaacagatatagttttgccaggagttctagctaacgtctcttcccggtccttgagatcacatctgcttggttttgcatgtcctattgtttgaaacttgctgcctattagaacctccttagttgtctcaatacttttacttttattactgctacattaattatcttgttgctgagccctgcaactaaaaccctcccccttcccccctctccactgcagagcacagcgcgaccacctcagacaaacccgaggttttcttcttctcctttttgatcgatgcagccgttgttcttgcggggaaagggttctttttttccttttttattttgtggaggcgcggctgtgggcgatgggcggtggctgatgatcgggggattaccaccaccttcgtgatctctcgtttttctctgtggaattggggtggatggatggatggatactctgttcatagatggcgacagtccaagtttattcctttttatttttgtatgttttttccttgttgggtttgttctgttgctgtagttgccgtttcttggcttcttgctttcaatgtgttctctcttctccttctcttttttctttctttcttttttgttgttgtctgttcttgggggtaagggtgtcccaatcgtattggacaagccttcgcgtatgtaactgattggaattggagtgtggagttagacgccgacaggtgaggcagatgaacaagagttcccaacccaaaagttcactaatgaagtgaagtgtaaataaaataaaaagtaaataaaagggagaaaatactaatagttgcttggggagttgggattctccaaaagatagtgtctttttttcttcctttttcggttacgcttggtgagaagatgatttatttggagatggtggacgacgcctatttctgttttctggctgtctaattctgatgatggcgtctcatgtttttcaggtgcgttttgcgtgaagcgggttttaaggatggttctaaacaaggtgctcgagctgttttgtgtgaagaagaaggattccaagaagaaaggtgctgcacagctgcactactgcccctatttaacatcatctttacgtcagctgcttctgtttgtttgattgatcctaggatgctttcctcatctgatggcatattatcagttcgtcttgtgcactctttcttccatgaattctgttttttttttcaaatatgaacgtgttttctggtgaaaggatactgcagattaaatggggttgtcataatggattgacattattggataattgtggctgctgtacattattgctatatcagatgctttgaggttaacaaagtataccaaaatgtgatatgtgtagtaaacttaatctcaacagattgagagtgctactagtgtgattggatatattcactggagagtgaacttgtgaatagtctggtattatgaatccatgagtcttggtgatcaatattgttttgaagtttgttaaactgtataatgaaaaaaaacttaatatttcattagcctgtatacccagccacgaaatccgcatctccctctgaagcatggaattctccttattttgtttcagaaagataaaatcaagtgttttgctcttctgcctggagctttctaataaaagaatattttcatgcaggcaaagccattaatcctctttgtaaagttatcttttcatgcaactttttcctccttgtttgtttttgtaattcttatgcttcatgtagctgaacctgttcttttaaaaaattaaaatgaacaaaaaaaaaaaaagccccccccctccccgtttacccccaaaggggatatttgttactttaacagaactacacattatctaatgttcatcactctttgctttgctgtcagtcggtagtattgatgcaagtaaacctcttttttgcagttaaatgagcttcagtatcctattctgtatctctgtctttaagattggtgtgcctttttttgtaacatcttggtttgaaactagttactctactggctttcagttgccgctccacaccccactgcaaatgtcagcacaaacaacagccttttggatcccttttcaactgggaatggtactgtgctatctgtgcaaaaacatgagcctgaatgttcaagtgttatatcatcaatgacaaggacagaatatggatttgaaagtgatggttgcaatttgtttagccattttgatgttgttcaagatttttctgaccattactatgcaaagaattcaccagggaaggtaagctgtgcgttttatgaattctatttctatcaatagatccaactgtgaattaatttcctgtctttatctgtggccactgatcagacctccaaagattgggtgaagacaatccaaaatgaatggaggcttctacagaaagatctacctggtcagtacatgcttttatatggcaaatcattgtattcaattttatcaaaccgtcagtgcctagatggtgaacacatataatggtcctttcttatactgacctctgttttatgccaattatatctgatccgtgtgacatgctaacagactatgtttgaaatctttcttgagttaaaggtagtcacatgctcagtttgggtttgaataggatatattcattggttataccaatttgtttgtggtttggagttttgttacaactgttgctgaatcccgaactagctaatgatattgtctatgcttgatgtataaaatactttattcgtgctatatctgatttatctgttagtttttgttaatgtgtcacatatcttttagttatggtctgcatttatcgtcccttttccatgcaatcttgtcatagaagcataacagtcttcagaacttaatcttgctaagtttgggtaatgggacaaatggaaaagaatgtacatatctcaaatcatgttgctgaaggaagctaatgtatcacaagtatcattacatacagtttacatttgcgccttaagtttttcgtttagagcaactgtgactgaaatagctgatgtcttcaatactagaaacttgcatctcagtctggtttcaatcatgcagaatctatctatgttagagtttatgaggataggattgatctgctgagggctgccattgttgggccagctgaaactccatatcatgatggtctgttcttctttgatgtttgctttccttctgaatacccacaatcccaccggtatgaaaccacttcacacacgctttccaccattattttcatgttactaccaccactggtataacctctttaaaataatatccaacgtgtacagaaagttcattaccatatgcatttcccacttgatgtaatttcaaattgctttgttctacttttgggccatatatctggcagtaattcaaacaaatatagttttgccaggagttctagctaacgtttcttcccggtccttgagatcacatccgcttggttttgcatgtcctattgaaacttgctgcctattagaacctccttagttgtctcaatacttttacttttattactgccatattaattatcttgttgctgagtcctgttttgatgattatgcacaaagtattcagttgttctggtacctaaatgagtagtttgcttgctggcgtatcacatgacttaaacaataatacttctctttttgtaactgaaattaagtcaataaaaagggaaaaaaaacttgctattacatacaaatcaagaaattaagtcaaaaaatggagaataaaagaatggtaccttcagtgtggcccaattgaaaggttggatgtgatagtatgccaagattgttaggtttacatagaatctttcgtgagaaccattgccattgtaagatcatccacaaagaataccatcaatgcatatgtattatcatcctgtgtacaaaaatagcaggcagcaaattaaccaataaaaaactgctcatagcataaacaactaaacctaaataggaccacatatatcattcatgttgaactaataatgagcagcaaaccagaacagggatcagtggctagatcaaataggtacacttgcatatagtatatagaaatcatagtacaacacaaagggaaaaatcgttcattgctttaagtagaactgcataccaaattgggtttatccgagtcgtcgccatacgctggtacagtcatggcttgttattgttgtcctagtcatggctgagccgccgctctcaatctctcttatcgtccctggcgtcctagccatcgctcggatctggcactaaatggagtggagagcgattagaagagggcgagagcgagggaggcgatggtggggtggggatggaagaggagaagatggtggcggcgactcgtgtccctcgcttccctgtggccagatccaccggtgacttatgcgatggcctctctcggagagagcggcggcggcgcggtgaagatggctggaggagggtgaggaggcacgcgggtgaggatgggtggcggcgctagttgtgacgacgcgggtgagaggaggagggcggctagggttttggtgcggtgtggtgacatctgcgccgttcattcccaatctgacgagcgcacggcttaggcagccacaaaggaacacgtgggtggtcagatcgacgttagtgcgagatccaacggacgacaacaatggggcctggcacgtaattaacagaactgtggtggctttttttgcaaaagtgatagctgacgtggcatccctacttccagcaatcccacggcatttagagagattaatatatccagtggtccaaaaccaaattggtgtgttggctggttaagagtgagtgcaacttttatacagtcgcatgtgcctgttaaatatagttgttagtgctccacttgaaaaagttgctgttatttgtttaaatcttatgctttagctggaaaacagtataatctctaaagcagcatcggcattttcgaagatcttaacatttggttgattatatgcagcttgacgcatgtgcacatcccttctttgatgagctacgagagcccaatgcacgcctgccatggcaaatggtcgtccattccctcctctgttcaacttcaagcatgaagtaagtaaacgagaacattttcgaacagtcgctttttatgttacatttatatttacctgtcatggatgcttatcaatgctcatttctgcaatgcagctaactggcgcctctccagaactcgtccacagactcataccggatcatatcagacggcaacatggcctcaacttgcgcatgctgggagttagaatggcaccgtaacgctcaccgttttgttcgtttatttttccatgagctggacattgcaatcctagatgactccattgtcttggattgggactccatctcagattgcaccatccatgattcttccatgatctatccatccgtcaagccatttccgcaaggactcagtaccagagaagtacaattatgtaaaatatctagccatgggagaaatgcgtgctgctgctgctggtgttaagtacgtgacagggcatgctggttgagtagtaggtaaggttaaggataaatgtagttggtggagactgagagacatgttaagctagggaaccctgctttctttttttctcctttcattttggtttcttcccattttgtgatccttagcattgccctacagtagtgtagctgctcccagtttttgtttgctctttcatcatgtaaatgccaatcccaatcccaatcgcaatgaaccctcttcctttacatcctggtctactccctgtgagtcttaggtctgtgagtttgtgctgctggttcttcattcaaggtggcttgggtgtgcgttctgatcgatttggcgtgacgtgtttgtttccgtagggaaggactgcaaggagaagcaccctaacgtcaagcaggtatcttgtggcgcgtttgtgttgctctgctgcattaactgctacaatgtgtgttctgacttggttgatttggtggtgacaagtgcaagtccatgtctgatgctgtgagttcctcacttcctgtgcccatgttctgaaccgttccatatgcatctctcacttgatgtaatttcaaattgctgtgttccacttttgggccatatatctggtagtaattcaaacaaatatagttttacccggagttctagctaacgtctcttcccggtccttgagatcacatccgcttggttctgcatgtcctattgtttgaaacttgctgcctattagaacctccttagttgtctcaatacttttagttttattactgccatattaattatcttgttgctgagttctgttttgatgattatgcacaaagtattcagttgttctggtacctaaatgagtagtttgcttgctggcgcatcacatgacttaaacaataatacttctctttttgtaattgcatttcttggttcaagcttatatctcagttgaccataggctatagtggaaagttcatagatcaaatatgttaagagtaatggaatctatttactctactgtgcatttaattgaagcagagatttcttaatctggttggctatttgatatcaggtgaaagcaaatatttgaatgatattatgtgaaacatacgacaggttttggcacttgacaaatgctttgttgacccacgttgtttattaaatcccacacaagaagtaatgaagagggcattataccattaacagatgctattcccaatattccaatcgtaagttttattttatgttggtgaaaatctagttttcattgttttctccataaatgccttgcgtgtgtaattcttgtacatatactccctgaactgttattaatatatttgaacagtatgattcatatgattctgtcccgtgtttgattaaaaaatttaggatatcgcctaaaagatgctattagctgttacaatcttatcatgagcaatttatgatctgcacaaccagtaagtgattgctaatttcacgttagaatgatggcatagagtagaatgaattgtacctttgtttataagttaaaaactttgggttatttattcttgtatttggtaatacaatgatgtcctgttgccttgcttctataacatggcaataataggtcgggctactcaatgtcgctaagggctactatggctcagatttaccttttttttaaaaaaggaaagcactaaactaattttaatttatctttgtaatgaatgattttttgggattgtgtttctgtgtgtgtgcgggagggggatgcgaatccgtatatgttgttaggggcatgcggatttggaaatttcaatacaccgggaagggcaaatttattgcattgttcatgtatatggtatttctctcaagtacaagagtacattgatgacatatattcagatgtttgcaaatttctttactgtaatcttccattatcagcttatagccaacaggaccagtttattacaagggtaccaagataagtttttttttttctagaaaggaagacaaatggaaaacctgctacaagt
